United States Patent 7,745,391 (HUMAN THROMBOSPONDIN POLYPEPTIDE) - sequence listing, part 198

SEQ ID NO: 467032 - DNA, 2357 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaactaaacgaaccgttctgctacggtacggggtcgggggctgccgggcgtgcacagggcacggggcgggagagacgacggcctccggagaggaccccgggttccgcactgcgttcgccgcctccgcccggctcggggcggctcggggttggctcaggca

SEQ ID NO: 467033 - DNA, 2570 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccaggtcgattccctgggctccaggctcccccgcgcgggcgccgcccaccgccatactaaacgatcgaggaataaagacacttggtttttcta

SEQ ID NO: 467034 - DNA, 1466 bp, Homo sapiens
tgctgagtgacttagtgagagctgctttatttctcactgctccctttcctcttctcacaggtcctcaaggtgaacagggtgagtgcctttcatttgattctggagggagaagtgactaggggttggaggatagaggtcctcgggcagccctgggctggggatccagcaggggaagggggctggcactctgccctgagcatcccctttaacatccacccttcccactcaggagtggagggggcaccagcagcccctgtgccccaagtggcattttcagctgctctgagtttgccccggtctgaaccaggcacggtccccttcgacagagtcctgctcaatgatggaggctattatgatccagagacaggtagtcctgggaggggctgggttgaacggttggagaaatgggtgaggtgtgcagtgatatcttcccattcttgccttttccgacagtgtgaatcttcattctctgatttggggagaccccggctctttcttcatttattcattctcaggcagtggggagaagaagtagtcattcattcattcagcagatctttactggggcctgctcctgcccaggcactgttttaagtgctgggaatgcatagtgaacaaagcccccagttccctgccgctcacattccagtgaggtgaaaagacccagagggtccctcctcagtccaggagttctggtgcgctccccggagcttccctggcccccctgactgctatccttgtccccaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttcta

SEQ ID NO: 467035 - DNA, 4084 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacaggaggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaactaaacgaaccgttctgctacggtacggggtcgggggctgccgggcgtgcacagggcacggggcgggagagacgacggcctccggagaggaccccgggttccgcactgcgttcgccgcctccgcccggctcggggcggctcggggttggctcaggca

SEQ ID NO: 467036 - DNA, 3443 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacaggaggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttcta

SEQ ID NO: 467037 - DNA, 1035 bp, Homo sapiens
  misc_feature (939)..(940): n is a, c, g, or t
  misc_feature (942)..(942): n is a, c, g, or t
  misc_feature (948)..(948): n is a, c, g, or t
  misc_feature (959)..(959): n is a, c, g, or t
  misc_feature (973)..(974): n is a, c, g, or t
  misc_feature (1014)..(1014): n is a, c, g, or t
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctggnngngcaagntgtgtgggtgnaattgcaggagggnntgaattgactggggggaaaagtgtttgaatgaaagaagtngagagtggaagagaatggaag

SEQ ID NO: 467038 - DNA, 2673 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccagaggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttcta

SEQ ID NO: 467039 - DNA, 1610 bp, Homo sapiens
ggcctggtggcgaattcggcacgagggtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467040 - DNA, 1493 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467041 - DNA, 1436 bp, Homo sapiens
gccgaacgcagcttccccaaggtgcaggcgcggtgaaaccatcgagacggagggccagagagtcacggcggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467042 - DNA, 1551 bp, Homo sapiens
gccgaacgcagcttccccaaggtgcaggcgcggtgaaaccatcgagacggagggccagagagtcacggcggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467043 - DNA, 1531 bp, Homo sapiens
ggcctggtggcgaattcggcacgagggtcacggcggatcttattgtctacgatgtgacgatccgtggagaaagtagcagatgggcagattttcatttggggagaatgagggagaaaagaacgggcattccgagccaagagcactgcatgagcaaggagttgggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467044 - DNA, 1607 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacactaaagagacaagaccagaaacacacaccaagaaacagccgggggaaccatggtccggggggggcaaaaacagagcgctgacagaggggccacgcgcatggggcggtccgggagccg

SEQ ID NO: 467045 - DNA, 1823 bp, Homo sapiens
ggcctggtggcgaattcggcacgagggtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaaggtgtgggatggcacaggcaggctttctagggacattgcagggatggggacatttgacatcagatgagcagtttggagaagtggaataagcaggccggggtgagcccatgggaacagggggccagaaggaagctgtttggcacagctccacctaattgaagaatcagccatggtgaagagaattattggctttatctcatcttctccttcccagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467046 - DNA, 1696 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagagtaagtgaggggttctggaggaagtggagtgggtaactgtggaacaggggaagaaagcagaaatccagagggctggtggaagatgcctgggttagtgacaagagcccacaagacacatggataagtaggggaacatagtggggcatgctaattttatgctgggctatgactactcatgcttccttatctttgccttcctccagacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467047 - DNA, 1804 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtaaggtggggagctagggagggctgtgagagtagaaaagaatgatgggagctgggtttgacccattcactcactcagttttgatcgttcttattcaggtatcgggggaaatggattcgggtagaacgaagtcgagagatgcagatgatagacttgcagacggggactccttgggaatctgtcaccttcacggccctgggcactgaccgaaaggttttcttcaacatcctggaggaaggtgtgggatggcacaggcaggctttctagggacattgcagggatggggacatttgacatcagatgagcagtttggagaagtggaataagcaggccggggtgagcccatgggaacagggggccagaaggaagctgtttggcacagctccacctaattgaagaatcagccatggtgaagagaattattggctttatctcatcttctccttcccagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467048 - DNA, 1384 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467049 - DNA, 1365 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467050 - DNA, 1181 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggtgtgggcgaggttcaggagggggttcctgggtgtcgcggaggggccggggacgggagagctttgtctgtggccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggtgaagacctattaaaatgccatttcaagaactacgattttaaagacagtttaggtgggaggtaataaaggtctaaacaagacgttaaatattggggacgtaagggggaggatatttgaaggacattactcataacaagacatagggttactgacaagtcaacggacgcttctcccttgctgactgcagccaatggacccctttttatcatagctggtcccagggaccacaaaaatcctgtccatccattaccctgatgtgaagcctgtttatatagctctttttggtttaaggcatctccagacatggtcctctggtaggaaacaggtatgagtagactaatgaaggacaaaatgggatgagggacctggagcctccacccttgcattccaataccacccttaccccacaaaaggagggtattgacccacac

SEQ ID NO: 467051 - DNA, 379 bp, Homo sapiens
tttccaggttgcctgctacctcctgccatcccatgctccatagcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagagtaagtgaggggttctggaggaagtggagtgggtaactgtggaacaggggaagaaagcagaaatccagagggctggtggaagatgcctgggttagtgacaagagcccacaagacacatggataagtaggggaacatagtggggcatgctaattttatgctgggcta

SEQ ID NO: 467052 - DNA, 895 bp, Homo sapiens
ggcctggtggcgaattcggcacgagggtcacggcggatcttattgtctacgatgtgacgatccgtggagaaagtagcagatgggcagattttcatttggggagaatgagggagaaaagaacgggcattccgagccaagagcactgcatgagcaaggagttgggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggtgagaagcagctggggtcttggctg

SEQ ID NO: 467053 - DNA, 984 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctgggctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467054 - DNA, 1566 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtaaggtggggagctagggagggctgtgagagtagaaaagaatgatgggagctgggtttgacccattcactcactcagttttgatcgttcttattcaggtatcgggggaaatggattcgggtagaacgaagtcgagagatgcagatgatagacttgcagacggggactccttgggaatctgtcaccttcacggccctgggcactgaccgaaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467055 - DNA, 1585 bp, Homo sapiens
ggcctggtggcgaattcggcacgagggtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467056 - DNA, 1591 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtaaggtggggagctagggagggctgtgagagtagaaaagaatgatgggagctgggtttgacccattcactcactcagttttgatcgttcttattcaggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467057 - DNA, 2061 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggtgtgggcgaggttcaggagggggttcctgggtgtcgcggaggggccggggacgggagagctttgtctgtggccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467058 - DNA, 2114 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggtgtgggcgaggttcaggagggggttcctgggtgtcgcggaggggccggggacgggagagctttgtctgtggccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467059 - DNA, 1608 bp, Homo sapiens
gccgaacgcagcttccccaaggtgcaggcgcggtgaaaccatcgagacggagggccagagagtcacggcggtgagagggctgagtgacgggttaccccaaaccatgtggctggaggcgcgagctggggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467060 - DNA, 1430 bp, Homo sapiens
  misc_feature (1)..(2): n is a, c, g, or t
  misc_feature (5)..(5): n is a, c, g, or t
  misc_feature (14)..(14): n is a, c, g, or t
  misc_feature (21)..(21): n is a, c, g, or t
nnccnttctttgantcccctncctgttggcctacatcgagacggagggccagagagtcacggcggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 467061 - DNA, 636 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcagcctctagagttgcggccggcctctgcatgctggacagtgcctctggacttgg

SEQ ID NO: 467062 - DNA, 2945 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaacttgtcaggaggctgaagtgggaggatcacctgggcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatc

SEQ ID NO: 467063 - DNA, 3579 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgggcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatc

SEQ ID NO: 467064 - DNA, 2634 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcacttagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatc

SEQ ID NO: 467065 - DNA, 1714 bp, Homo sapiens
  misc_feature (19)..(20): n is a, c, g, or t
acaatagtcgggcatggtnntgacacctgtaatcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgggcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatc

SEQ ID NO: 467066 - DNA, 2295 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagtagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatc

SEQ ID NO: 467067 - DNA, 3639 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgggcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatc

SEQ ID NO: 467068 - DNA, 954 bp, Homo sapiens
tagcaggtgtatcgtcatatcttaggggccagtcaatttcatcacaacaattatcaatataaaacccagccaacaatattcagggagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatc

SEQ ID NO: 467069 - DNA, 1399 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcaatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatc

SEQ ID NO: 467070 - DNA, 2175 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcacttccagcctgggtgacagagcgagactccatctcagaaaagaaaaaaaaattgtgtctgtctttcttccttaaacaatacagtataacagtaatttgcatagcatttacattaggcattttgtgtagcattgtattaggtataagtaatctagaaatgatttaaattatacaggaggatgtgcataggttatatgcaaatactaggacatttcatatcaaggacttgagcatctgcatgcagattttggtatccatcagagttcctggaaccaattcaccacagataccaagggacaactgcacagattaaaaccttaatgcattactaccgtgtacccaccataataactaaaatggaagaaata

SEQ ID NO: 467071 - DNA, 1470 bp, Homo sapiens
ccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtaccgtgagccaagatcacgccactgcctccaggctgggcaacagagtgagactccgtctcaaaaattaattgcattttgttagaaaggtcacaatggctattaaatttacatctctatttcatcttcaaggagatccggggataatatgctatgcggcttgacctgtttgacaccaccctctttggaataatggcggccctcacttaaggcaccatatggccccaatatatgagcaactggagcaactacccaaagtatacagacaaaaaaatttttcacagaacttcttttgagggcccttgacaaaagggaggttacctacacaacacaaagttggccccattaaattaacggccatcacacccacgactgacggtgatcaaacaaattcacagcacagacaccgcgcaacaacgcaacttctccagcaggacatcgactc

SEQ ID NO: 467072 - DNA, 359 bp, Homo sapiens
tcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgact

SEQ ID NO: 467073 - DNA, 341 bp, Homo sapiens
agccggaccgcacttgggtggctcttcggggggctcttcgcgtgtcatcgggcggctctttgtgtggctcttcgtgaggctcttcgggtggcccattgcgtggctcgttgtggggcaccaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactca

SEQ ID NO: 467074 - DNA, 175 bp, Homo sapiens
cgacgtagaggatcccggtagcacagagtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactca

SEQ ID NO: 467075 - DNA, 859 bp, Homo sapiens
tgggtggtcgtctagaggatcccatcagtttacacggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgttaatcagtttacacaatgtatcaatttccacgtatttgtatagtttccaaaattattcttgttattaatttctagttttacttcattgtgggcagagaagatagttggtactatttcagtttttctgaatgttttaagacttgttttgtgacctaacatatgatctgttcttgagaatgatgcatatgctgaggaaaagaatgtatattctatagctgttggatggaatgttctgtaaatgtctattagatccatttggtctgcagtgcagattaggtctgatgtttctttgctggttttctgtcaacaaagtatagctactcctgctcttttttggtttccattggcatggaatatctttttgcacccctttattttcagtctgtgtgtctttataggggaggtgtgtttcctgtagtcagcagatcagtgaggtaccgacctat

SEQ ID NO: 467076 - DNA, 361 bp, Homo sapiens
gggcaacagagcaagaccttgacttaaaagaaaaaaaaaaaaaaaaggacatttgttttaaatatttttagagacagggtctcactatgttacacaagttggtctcaaactcctggcttcaagtgatcctcccacaaacatccccttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcaacatggcctcagtcgactttgatgggtttttttgccgccttcttccagaggatctgg

SEQ ID NO: 467077 - DNA, 328 bp, Homo sapiens
attagtcacgcatgtatggggaagtaatacactctaaatcccaacgacagtaattgtttgcatcatccccaagtcattggttaagaactgaactaccatgtcaaccaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactca

SEQ ID NO: 467078 - DNA, 416 bp, Homo sapiens
cgacgtagaggatcccggtagcacagagtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcaaaaaaaaaaaaaaaaaaaaaaaaaaaaaaacaaaaaaaacaaaaaaaaaaaaaaaaaaaaaataaacatcaaacaaaaacccaagggggggccgcggcccacgttccccttacgtggcatgacataccaatcttattgcctatcgtttaacatctacccactgggctgtctatccattcactcagcctcagctcccccacgtttcacacttacccctcccttcatagcataatgcaaactg

SEQ ID NO: 467079 - DNA, 373 bp, Homo sapiens
gcggccgctactactactactactactaaattcgcggccgcccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcatcgacgcggccgcgaatttagtagtagtaggcggccgc

SEQ ID NO: 467080 - DNA, 506 bp, Homo sapiens
cgggagttagcgacagggagggatgcgcgcctgggtgtagttgtgggggaggaagtggctagctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtcccagatgtggctcacactgagaatggtaagaactacaaaacaaaatttctattaaattaacatttgtgtgtctct

SEQ ID NO: 467081 - DNA, 535 bp, Homo sapiens
cgggagttagcgacagggagggatgcgcgcctgggtgtagttgtgggggaggaagtggctagcaccttccccgctacccctcccaagtaactgggatgacaggcgtgtgcgaccacgcccagctaatttttgtattttttgtagagatggagtttcgctatgttgtcccaggctggtctcaaactcctgagctcgggcaatctgcccacctccgcctccaaaagtgctgggattataggcctgagccactgtgcccatctccctggcttattgatagccatcttctccctgagtccttacagggtcatccttttgtgtgtgtctgtgtcctaatctccccttataagaacacctgtcatactagattaggacccaccctattgacctcattttaccttaatcatctctataaagaccctatctccaaatacagtaccattctgaggtcctgtaacatatgaatttgaagggacacagttcagcccgtaacagtatccatggacataaagtgctcagcacaggtcatggcacagaa

SEQ ID NO: 467082 - DNA, 11195 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467083 - DNA, 11141 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttccttttttagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467084 - DNA, 11141 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaagatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467085 - DNA, 10789 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggagcctaaaatttccagaaatagatccagagagaaagtaagaacctttgatctagcaatcccactcccaca

SEQ ID NO: 467086 - DNA, 11150 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactatttgtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467087 - DNA, 10144 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467088 - DNA, 10118 bp, Homo sapiens
  misc_feature (90)..(90): n is a, c, g, or t
  misc_feature (152)..(152): n is a, c, g, or t
  misc_feature (10018)..(10018): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtattttttttttttnttttttttgtttttgggtgcctttgggtttttggttttttggtgtttgttccgttgttgttttttggtcttttgctccccctttttcttgcccttggccc

SEQ ID NO: 467089 - DNA, 10172 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467090 - DNA, 3843 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactca

SEQ ID NO: 467091 - DNA, 8795 bp, Homo sapiens
  misc_feature (90)..(90): n is a, c, g, or t
  misc_feature (152)..(152): n is a, c, g, or t
  misc_feature (8782)..(8782): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttccttttttagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttattttaataatgagaccctgagttttatacaacgccctttacgtctacaaatgcacaggtncagttcactctcc

SEQ ID NO: 467092 - DNA, 11140 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467093 - DNA, 6083 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggccagggggggcttgtgaaaccattcccttttgaggtggaaagggcaattcccctttcccaggccaccctttttaaagctctct

SEQ ID NO: 467094 - DNA, 4264 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcaaaaaaaaaaaaaaaaaaaaaaaaaaaaaaacaaaaaaaacaaaaaaaaaaaaaaaaaaaaaaaaaaaaaaaaaaaaacaaaaaaaaaaaaggtgggggggggggggggcccagaaaaaacgcttcaaaacaccattgcgggaggggccggggggcccaaggaagggaaagagaaaacgcggcgcaaaggggtggcccacaggaaagacactgcgggggaaaaagaaatgagggggggaggatatcctcacacaatataaaacagaagccgcgcgggggggaggaacaaagcacgagagccggcttagagaaaacactccgcaaagaggggagcttcagaggagcggacaacaggggggagactacaaccaaaggaggggacgacacaaggacagacgaccagagaattaagaaatgaccgg

SEQ ID NO: 467095 - DNA, 4103 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcaaaaaaaaaaaaaaaaaaaaaaaaaaaaaaacaaaaaaaacaaaaaaaaaaaaaaaaaaaaaaaaaaaaaaaaaaaaaaaaaaaaaaaaaaaaatcatttatcttccactataagccattctactactcctttcctgcggcatactctaacccctaatcttaatccaactttctctttaccttcttttaatttcccatcttttactcttttgattacttcgtattattttacatcctcctgactattctcaattcctctct

SEQ ID NO: 467096 - DNA, 5216 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctcagccttcataacgactttggatgtatcttcatattgtagatttaggtctagatttgctagctccaagtaattaaggccatgtaggagagcatggtaacctcagatagaactggtattatcccaagtggtctgcagactgctgagtggggatgggatctgctctcaattgagagctggtaatcacttggtttgaaatgtgatgtatatctcactcaagcacaaagaaggtgcgcatgtgataagcctgaagta

SEQ ID NO: 467097 - DNA, 11133 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccatttttcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467098 - DNA, 11142 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467099 - DNA, 4116 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcaaaaatctaactatatacaccttctctctattatttttcattattatcatcgttcttcttttttttattttttgttataaaaataaaaaccttaaggggggccccattcccaaatttcccctttaatagacccttttcaattttattgaccttctttttacaacctcttaattggaaaaaccctagtttcccccacttttaattcctttaaaacaaaccccttttttccaatttgcctaattctcaaatagtcccaacgcaatctccttttcca

SEQ ID NO: 467100 - DNA, 11152 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggtttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467101 - DNA, 3941 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcaaaaaaaaaaccacaaccacatccagctctcctttccgcctgcccggcgtctcgtcccctctctctacagctcttatttcgtttcatatcccccacctt

SEQ ID NO: 467102 - DNA, 4285 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcaaaaaaaaaaaaaaaaaaaaaaaaaaaaaaaaaaaaaaaaaaaaaaaaaaaacaaaaaaaacaaaaaaaaaaaaaaaaaaaaaaaaaaaaaaaaaaaaacaaaaaaaaaaaaggtgggggggggggggggcccagaaaaaacgcttcaaaacaccattgcgggaggggccggggggcccaaggaagggaaagagaaaacgcggcgcaaaggggtggcccacaggaaagacactgcgggggaaaaagaaatgagggggggaggatatcctcacacaatataaaacagaagccgcgcgggggggaggaacaaagcacgagagccggcttagagaaaacactccgcaaagaggggagcttcagaggagcggacaacaggggggagactacaaccaaaggaggggacgacacaaggacagacgaccagagaattaagaaatgaccgg

SEQ ID NO: 467103 - DNA, 4238 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcaaaaaaaaaaaaaaaaaaaaaaaaaaaaaaaaaaaaaaaaaaaaaaaaaaaacaaaaaaaaaaaaggtgggggggggggggggcccagaaaaaacgcttcaaaacaccattgcgggaggggccggggggcccaaggaagggaaagagaaaacgcggcgcaaaggggtggcccacaggaaagacactgcgggggaaaaagaaatgagggggggaggatatcctcacacaatataaaacagaagccgcgcgggggggaggaacaaagcacgagagccggcttagagaaaacactccgcaaagaggggagcttcagaggagcggacaacaggggggagactacaaccaaaggaggggacgacacaaggacagacgaccagagaattaagaaatgaccgg

SEQ ID NO: 467104 - DNA, 11137 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467105 - DNA, 11125 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggttatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467106 - DNA, 11137 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtctttaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467107 - DNA, 11127 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467108 - DNA, 11127 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467109 - DNA, 3788 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgggtaagaactaattctgttacgtcatgtacataattactaatcacttttcttcccctttacagcacaaataaagtttgagttctaaaactca

SEQ ID NO: 467110 - DNA, 3844 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgttcatcagtttacacgaaaaaagaaacaacacattccctctccaaacagagatgatcccttaaaaaaacaaacaaacaaaaacgatactggtggttaataaaattcatccacatacattagacaacattcataaaactaaacaaagtc

SEQ ID NO: 467111 - DNA, 4143 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgttaatcagtttacacaatgtatcaatttccacgtatttgtatagtttccaaaattattcttgttattaatttctagttttacttcattgtgggcagagaagatagttggtactatttcagtttttctgaatgttttaagacttgttttgtgacctaacatatgatctgttcttgagaatgatgcatatgctgaggaaaagaatgtatattctatagctgttggatggaatgttctgtaaatgtctattagatccatttggtctgcagtgcagattaggtctgatgtttctttgctggttttctgtcaacaaagtatagctactcctgctcttttttggtttccattggcatggaatatctttttgcacccctttattttcagtctgtgtgtctttataggggaggtgtgtttcctgtagtcagcagatcagtgaggtaccgacctat

SEQ ID NO: 467112 - DNA, 10855 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcct

SEQ ID NO: 467113 - DNA, 3586 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccatttttcgtttgggatcctcagatcaccccacag

SEQ ID NO: 467114 - DNA, 3636 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccatttttatcaatcactgtcgctggaatcacagtgttttagtccccccgtttggtgaatacactcggacttctgttttaaataga

SEQ ID NO: 467115 - DNA, 3761 bp, Homo sapiens
  misc_feature (90)..(90): n is a, c, g, or t
  misc_feature (152)..(152): n is a, c, g, or t
  misc_feature (3661)..(3661): n is a, c, g, or t
  misc_feature (3747)..(3747): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccatttttcaactaattttgccccccactcccactcccacccccagatgacatttggcaatgtttgggagacatctttggttgtcataactgtcgagctctactggcatcnagtgagtagaggccaagggatgctgataaacatcctacaatgcacagaacagccctcccatccccaacaaattatccagcccaaanacgagcactcccct

SEQ ID NO: 467116 - DNA, 3446 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactttgggatcatctagaatagcacacacacattttcttttttttttttttttgtttgttgt

SEQ ID NO: 467117 - DNA, 3605 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgaaaaaaaaaaaaaaaacaaaaaaaaaaaaggtgggggggggggggggcccagaaaaaacgcttcaaaacaccattgcgggaggggccggggggcccaaggaagggaaagagaaaacgcggcgcaaaggggtggcccacaggaaagacactgcgggggaaaaagaaatgagggggggaggatatcctcacacaatataaaacagaagccgcgcgggggggaggaacaaagcacgagagccggcttagagaaaacactccgcaaagaggggagcttcagaggagcggacaacaggggggagactacaaccaaaggaggggacgacacaaggacagacgaccagagaattaagaaatgaccgg

SEQ ID NO: 467118 - DNA, 3307 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattggcaggagagctgcccctcagcttctcaaagtactgggattatataggcatgagccactgagc

SEQ ID NO: 467119 - DNA, 3334 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgggtcttgttttccaaactgatttaggtgatagtttcccctctagtcttggctcatttaaaaagcacaaacattcaaattaaaaatgtcg

SEQ ID NO: 467120 - DNA, 3521 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccatttggagggcactggcccccaacaggcatcaccccgctaaaatccctaaaagtccactcctaaacacatccgtattactcgcattaggagtatcaatcacctgagcttaacatagtctaataaaaaacaacccgaaccaaataattcaagcctgcttaataca

SEQ ID NO: 467121 - DNA, 3109 bp, Homo sapiens
  misc_feature (90)..(90): n is a, c, g, or t
  misc_feature (152)..(152): n is a, c, g, or t
  misc_feature (3087)..(3087): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttacggttncaagtggtcgggtaccgagctc

SEQ ID NO: 467122 - DNA, 3085 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtcgacgcggccgcgaatttagtagtagtaggcggccgc

SEQ ID NO: 467123 - DNA, 5151 bp, Homo sapiens
  misc_feature (90)..(90): n is a, c, g, or t
  misc_feature (152)..(152): n is a, c, g, or t
cagtgagcaacgtgggcttgtgagagtgggggggcctctcacaagaagtgtaggcatgcattgtgtcagataaggttgggaggagactgngacaagatcaagggcagggggcaggggcaggaggctggtagtgctgtggcccagatattggncagaagtacagggaggatctcctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttaggcctcctttcctatcttacccctttgctttgctttttaccccaggcataaggtgggcccacggcataagtgg

SEQ ID NO: 467124 - DNA, 892 bp, Homo sapiens
cgggagttagcgacagggagggatgcgcgcctgggtgtagttgtgggggaggaagtggctagctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctccccatacccaacccctgtttcaaacctcaatctaggcctcctatttattctagccacctctagcctaggccgtttactcaatcctcgtgatcagggtgagcatcaaatcaaactacgccctgatcgggcgcactggaggaaggagcccaaacaatctcatatgaatgtcaccctagccatcatgctactatccaaattactatttaagtggctccttttaacctgctcgagccttatcagaacgagaaagaacacgctcttgattaccttcctgccatcgtgaccctgtggcaataatatgattatctccacataaggagagaccaagcggagccccttggaactgccgaggggagtcgaaggtagtatctaggttaaaagtgataaggcgaggacttggcgtattttaataaggcgataagaacttttatataagagctttacaataaatttctggaaaagaatgagagttcctgaatgttacaaaattttgtcgcagacctaattaactgcggtttttgaatgacaggatcgggattgggtacgaattttgcatctgtaattttagacaccggtatatgatgggcatcaatatgagtctgtgaaaaaaaaaaatgttgggggattaaagggggagaag

SEQ ID NO: 467125 - DNA, 854 bp, Homo sapiens
gcgacgtacggttaactttgacccaaagacaacctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacaggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagcttgagcgggcatggttctcacattttactggctctcccttgttgcgactcgttggagatcataacatgggatcaccaactggcaggttggcaagtggggttggcattgactgtccgaagcaaaccgtgtaccgcggcgaattagcattgggaaaagggccacccgggggaggtggattccgcgaaaaggtgcaggcacgggccccccagtgggc

SEQ ID NO: 467126 - DNA, 420 bp, Homo sapiens
  misc_feature (415)..(415): n is a, c, g, or t
taatcattctatgattattaaggaccatttctgttctgagtggtataggcttgttatctccgtggcctgaattctacgcatattggtgaagataggtgtcgaacttggctgggagaatggctgcagatttcctgcagcctgaaaggtaaaacacatttctgtggttataccactaaaatccaagtcacttttgtattttattctgaggtcattttggagttaattattgagtactgtgagacatatatatacatacatctaattgaaagggcccaaactcacatgcctactgcatgcccggcaggtaacgaagtaggccataagacaaaagggagtagtggggactgtggaaacctaaaagtgaatgcatgctagtgtgaattttccagcctgggcaacaacagtgaaactcccntctca

SEQ ID NO: 467127 - DNA, 2197 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtgagggacctgtagcgagaaaagcatttttgacgtccaggctctttcagtgtctcaaccttgcttgcattctgtctcttaattctcagagttccacgccttggccctggaatttttattcttctgttcaggattcaaactccgatccccactagtgacccggcttcctgaccctctgtactctcagtgccccatattgtctggtttccccgcgtgtcctgagctcatctttcagcctcactttttcggctcaggttttaccgctgctatctcgattccacctctttctgacttagcctgcagttcaaattgtcccacaggcattgcgctctctccagaggcataccctgagttcctttcctgcctggcctttgcctgatttgtgtttcacagtctgattgcctatctcttcttgaccccaagaccttccttggatttcagaagtgtcaagccttgggatacaatctccgagactcctgctttacattagggactcaaggcgtgagggagcttctaggactgattcccagatagtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467128 - DNA, 1980 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467129 - DNA, 2014 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467130 - DNA, 2571 bp, Homo sapiens
tttgagacggcatctcactctgtcgcccaggctggagtgcagtggctcaatcttggctcactgcaagctccacctcccgggttcaagccattctcctacctcagcctcccaagatatttttcttctctcttttttttttttttcgagacggagtctctctgttgcccccaggctggagttgcagtgagccgagatcgcgccactgcagtccagcttgggtgacagagcgagactctgtctcagaaaaaaaaacaacaaatcagttgccttttacatactgggtccacataaggactgtgctatagttagattgtcaacatcacatatagtgtcctggtcaggctgcaactctctccaaagcatgctcttcacatgctttagttcaaaatgagtcattatatctgattgctgcgtggcaggctattctgctagtccttcctttcacatcccatttcagtaatggtgcttgaaattgtgcttcagtgtgtcttataaactttggtctgagagtcacttaagagaaagggctgactgtagtggctctcaccagtaatcccagcacttggggagactgaagcaggaagattgcttgagaccaggagtttgagaccaccctgggcaatatagcaagacccgtctctgcaaaaaaattaaaaacttagccaggcatagtggcctgtgcctgtagtcccagctactcagtaggctgtggtgggaggattgcttgagcctaggaggtcgaggctgcagtgagctgtgatcttgccactgtactccagcctgggtgagagaggggaccctgtctcttaaaaaaaaaaaaaaaaaaaaaaaaactgaaaaagaaaaagaacactgaggtagggaaatagtgtctccatctcttcttcctagtattcatgtctaccaaatgctttctttggcttcctctgaaagaagccagtttcagcaagtgagtttgtgattctttctcctttcaggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467131 - DNA, 2096 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467132 - DNA, 1860 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467133 - DNA, 1880 bp, Homo sapiens
ctgaacaggttgggtcagctggacagggggggtcagctggacaggtagggaaatagtgtctccatctcttcttcctagtattcatgtctaccaaatgctttctttggcttcctctgaaagaagccagtttcagcaagtgagtttgtgattctttctcctttcaggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaaggtattcctgcagttaacccttcctacaaatgtggaatcttgttagattcagtgtgcactaaactaggtaagaggagtagtcaggactttcctaacatctacaaatctcttacctcttccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467134 - DNA, 1758 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467135 - DNA, 2355 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaaggtattcctgcagttaacccttcctacaaatgtggaatcttgttagattcagtgtgcactaaactaggtaagaggagtagtcaggactttcctaacatctacaaatctcttacctcttccaagatacagcgtggtacccacccagcaatacatgatatcttggctctgagagagtgtttctctaaccatcctctgggcatgaaccaactccaggctttgcacgtggtgagcactttgagggcttctcttttccatagcatcaccatgtttcaggtgtttgcttgagctcatactatttgcctttcccctcctatgtggttgtgttacaaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467136 - DNA, 2087 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcgataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467137 - DNA, 1545 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcgaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467138 - DNA, 2015 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagtgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467139 - DNA, 2155 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaaggtattcctgcagttaacccttcctacaaatgtggaatcttgttagattcagtgtgcactaaactaggtaagaggagtagtcaggactttcctaacatctacaaatctcttacctcttccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcgaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467140 - DNA, 2409 bp, Homo sapiens
tttgagacggcatctcactctgtcgcccaggctggagtgcagtggctcaatcttggctcactgcaagctccacctcccgggttcaagccattctcctacctcagcctcccaagatatttttcttctctcttttttttttttttcgagacggagtctctctgttgcccccaggctggagttgcagtgagccgagatcgcgccactgcagtccagcttgggtgacagagcgagactctgtctcagaaaaaaaaacaacaaatcagttgccttttacatactgggtccacataaggactgtgctatagttagattgtcaacatcacatatagtgtcctggtcaggctgcaactctctccaaagcatgctcttcacatgctttagttcaaaatgagtcattatatctgattgctgcgtggcaggctattctgctagtccttcctttcacatcccatttcagtaatggtgcttgaaattgtgcttcagtgtgtcttataaactttggtctgagagtcacttaagagaaagggctgactgtagtggctctcaccagtaatcccagcacttggggagactgaagcaggaagattgcttgagaccaggagtttgagaccaccctgggcaatatagcaagacccgtctctgcaaaaaaattaaaaacttagccaggcatagtggcctgtgcctgtagtcccagctactcagtaggctgtggtgggaggattgcttgagcctaggaggtcgaggctgcagtgagctgtgatcttgccactgtactccagcctgggtgagagaggggaccctgtctcttaaaaaaaaaaaaaaaaaaaaaaaaactgaaaaagaaaaagaacactgaggtagggaaatagtgtctccatctcttcttcctagtattcatgtctaccaaatgctttctttggcttcctctgaaagaagccagtttcagcaagtgagtttgtgattctttctcctttcaggtacctgtttcccaggcaactactgatcagccctggcctcaagagatccatcaacccaaagtgccgagactacaggtgtgagctaccgcacccagcatatttatttatttttcagtctcactattttaaccaagctggtcttgaactcctggcctcaagcaatcctcccatctcagcctcccaagtagctgggattacaggcatgcaccaccacgcccagctaatttcgtatttttttttagtagagaccaggtttctccatgttggtcaggctgatctcgaactcccgacctcaggtgatccgctggcctcggcctcccaaagttttgggatcactggcgtgagccaccatgtccagcctatcctgttctttatagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467141 - DNA, 2022 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattaatgaaaataaccccctactaattaactctattaaacgccttttaatcgg

SEQ ID NO: 467142 - DNA, 917 bp, Homo sapiens
aaggctaggtacgaggctgggtggcgctaccttgggacaaggcgctgaatgaaccatggagcggatggcattgtcctgcagtcgtatagtatagtgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467143 - DNA, 1464 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaaggtattcctgcagttaacccttcctacaaatgtggaatcttgttagattcagtgtgcactaaactaggtaagaggagaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467144 - DNA, 703 bp, Homo sapiens
gcctactactactaaattcgcggccgcgtcgacctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467145 - DNA, 1243 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggtaagagcttgattgcaacatcaaccctcaacccttggtgtgcttttgagcctatggcaggccggaggtttacaggggctccttgtcttgtttgtttatagaacccagcttctttattctctcacttcatttatttatttatgatttatttttatttatttatttattttgagacagagtctcattctgttgcccaggctagagtacatgagccaagatcgcaccactgcactccagcctgggtgatagagtgagactctgtctc

SEQ ID NO: 467146 - DNA, 1196 bp, Homo sapiens
  misc_feature (910)..(910): n is a, c, g, or t
  misc_feature (921)..(921): n is a, c, g, or t
  misc_feature (929)..(929): n is a, c, g, or t
  misc_feature (946)..(946): n is a, c, g, or t
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacacttgccnctgtactccancctgggtnagagaggggaccctgtntcttttaaaaaaaaaaagaaaaaaaaagttccagaaaggagattaaattaatatctggctggggaatacatagggttaatttagccagactttctgaagttagggagcttgatttttaaaaaggagtgaccagtgaaacagaagagggagaccattccatagcagattaccagaagcccaacgtagctagaagagagcgatgtgctaagcggacaaaatgttgagaaaccgtcgattctcacgtcctcta

SEQ ID NO: 467147 - DNA, 1800 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtgagggacctgtagcgagaaaagcatttttgacgtccaggctctttcagtgtctcaaccttgcttgcattctgtctcttaattctcagagttccacgccttggccctggaatttttattcttctgttcaggattcaaactccgatccccactagtgacccggcttcctgaccctctgtactctcagtgccccatattgtctggtttccccgcgtgtcctgagctcatctttcagcctcactttttcggctcaggttttaccgctgctatctcgattccacctctttctgacttagcctgcagttcaaattgtcccacaggcattgcgctctctccagaggcataccctgagttcctttcctgcctggcctttgcctgatttgtgtttcacagtctgattgcctatctcttcttgaccccaagaccttccttggatttcagaagtgtcaagccttgggatacaatctccgagactcctgctttacattagggactcaaggcgtgagggagcttctaggactgattcccagatagtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcagccctggcctcaagagatccatcaacccaaagtgccgagactacaggtgtgagctaccgcacccagcatatttatttatttttcagtctcactattttaaccaagctggtcttgaactcctggcctcaagcaatcctcccatctcagcctcccaagtagctgggattacaggcatgcaccaccacgcccagctaatttcgtatttttttttagtagagaccaggtttctccatgttggtcaggctgatctcgaactcccgacctcaggtgatccgctggcctcggcctcccaaagttttgggatcactggcgtgagccaccatgtccagcctatcctgttctttataggtatttattatagcagtatccctagcctctacccactagatgccagtagcaccccttcacccacagttgtctcaaccaaaaatgtctctagacattgccaaatgtcctaggggtggggaggagagaggcaggattgtccccgttgagaagtactggtctaaaggcattcaaactcagaaaaaaaaacagtctgctgaccaaacacaaagcatctgagggtatgtattaggcttgtttgccccctgtttaggctaggtcttgatgttttgtgggcctttggatgttagggtaggcctactaatcttgaagctgagaaatgtccctagagcacc

SEQ ID NO: 467148 - DNA, 1032 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtgagggacctgtagcgagaaaagcatttttgacgtccaggctctttcagtgtctcaaccttgcttgcattctgtctcttaattctcagagttccacgccttggccctggaatttttattcttctgttcaggattcaaactccgatccccactagtgacccggcttcctgaccctctgtactctcagtgccccatattgtctggtttccccgcgtgtcctgagctcatctttcagcctcactttttcggctcaggttttaccgctgctatctcgattccacctctttctgacttagcctgcagttcaaattgtcccacaggcattgcgctctctccagaggcataccctgagttcctttcctgcctggcctttgcctgatttgtgtttcacagtctgattgcctatctcttcttgaccccaagaccttccttggatttcagaagtgtcaagccttgggatacaatctccgagactcctgctttacattagggactcaaggcgtgagggagcttctaggactgattcccagatagtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggtaaaaacgaaactacaatagaaattccggaatcagctcttgggcagggtcaaagagttagcataaataagatcatttgcaggttctgctatggggatgtgagccgagatatcttatatttcataaatgcctgcgcctta

SEQ ID NO: 467149 - DNA, 602 bp, Homo sapiens
cgaggcgggcagatcacaaggtcaggagattgagaccatcctggctaacacagtgaaaccctgtctctactaaaaatacaaaatactagctaggcgtggtggcgggtgcctgtaatcccagctacttgggaggctgaggcagtagaatcgcatgaacccaggaggcagaggttgcagtgagccgagatcgcgccactgcagtccagcttgggtgacagagcgagactctgtctcagaaaaaaaaacaacaaatcagttgccttttacatactgggtccacataaggactgtgctatagttagattgtcaacatcacatatagtgtcctggtcaggctgcaactctctccaaagcatgctcttcacatgctttagttcaaaatgagtcattatatctgattgctgcgtggcaggctattctgctagtccttcctttcacatcccatttcagtaatggtgcttgaaattgtgcttcagtgtgtcttataaactttggtctgagagtcacttaagagaaagggctgactgtagtggctctcaccagtaatcccagcacttggggagactgaagcaggaagattgcttgagaccaggagtttgaga

SEQ ID NO: 467150 - DNA, 1421 bp, Homo sapiens
  misc_feature (1135)..(1135): n is a, c, g, or t
  misc_feature (1146)..(1146): n is a, c, g, or t
  misc_feature (1154)..(1154): n is a, c, g, or t
  misc_feature (1171)..(1171): n is a, c, g, or t
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaaggtattcctgcagttaacccttcctacaaatgtggaatcttgttagattcagtgtgcactaaactaggtaagaggagtagtcaggactttcctaacatctacaaatctcttacctcttccaagatacagcgtggtacccacccagcaatacatgatatcttggctctgagagagtgtttctctaaccatcctctgggcatgaaccaactccaggctttgcacgtggtgagcactttgagggcttctcttttccatagcatcaccatgtttcaggtgtttgcttgagctcatactatttgcctttcccctcctatgtggttgtgttacaaaagccttgagccgggccatgcttctcacatcttacctgcctcctcccttgttgagacatcgtttgaagactcatacacttgccnctgtactccancctgggtnagagaggggaccctgtntcttttaaaaaaaaaaagaaaaaaaaagttccagaaaggagattaaattaatatctggctggggaatacatagggttaatttagccagactttctgaagttagggagcttgatttttaaaaaggagtgaccagtgaaacagaagagggagaccattccatagcagattaccagaagcccaacgtagctagaagagagcgatgtgctaagcggacaaaatgttgagaaaccgtcgattctcacgtcctcta

SEQ ID NO: 467151 - DNA, 1483 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagtagagaccaggtttctccatgttggtcaggctgatctcgaactcccgacctcaggtgatccgctggcctcggcctcccaaagttttgggatcactggcgtgagccaccatgtccagcctatcctgttctttataggtatttattatagcagtatccctagcctctacccactagatgccagtagcaccccttcacccacagttgtctcaaccaaaaatgtctctagacattgccaaatgtcctaggggtggggaggagagaggcaggattgtccccgttgagaagtactggtctaaaggcattcaaactcagtgccccctgtttaggctaggtcttgatgttttgtgggcctttggatgttagggtaggcctactaatcttgaagctgagaaatgtccctagagcacc

SEQ ID NO: 467152 - DNA, 2076 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggcttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467153 - DNA, 2307 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgaaaaaaacacaaaaaagaaacaaagaacaaggacaagaaaaaaaacaaaaaaaaaggaacaaaagaaaaaacgaagataaagaaatacaaaagaaaaaacagacaaaacatagaaaaaagaggggggggggcccgccctgaaagtttcctcccgtggggggcgccacctaagacggca

SEQ ID NO: 467154 - DNA, 1777 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagtagagaccaggtttctccatgttggtcaggctgatctcgaactcccgacctcaggtgatccgctggcctcggcctcccaaagttttgggatcactggcgtgagccaccatgtccagcctatcctgttctttatagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467155 - DNA, 2012 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467156 - DNA, 1490 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467157 - DNA, 1642 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467158 - DNA, 1827 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467159 - DNA, 2001 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcgtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467160 - DNA, 2569 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtgagggacctgtagcgagaaaagcatttttgacgtccaggctctttcagtgtctcaaccttgcttgcattctgtctcttaattctcagagttccacgccttggccctggaatttttattcttctgttcaggattcaaactccgatccccactagtgacccggcttcctgaccctctgtactctcagtgccccatattgtctggtttccccgcgtgtcctgagctcatctttcagcctcactttttcggctcaggttttaccgctgctatctcgattccacctctttctgacttagcctgcagttcaaattgtcccacaggcattgcgctctctccagaggcataccctgagttcctttcctgcctggcctttgcctgatttgtgtttcacagtctgattgcctatctcttcttgaccccaagaccttccttggatttcagaagtgtcaagccttgggatacaatctccgagactcctgctttacattagggactcaaggcgtgagggagcttctaggactgattcccagatagtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467161 - DNA, 2130 bp, Homo sapiens
gcgacgtacggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttga

SEQ ID NO: 467162 - DNA, 559 bp, Homo sapiens
agtaaatatttataggctttgtagactaacaggcaaattaagtgaagccacagaacagtggacctgatagaggcatggctgaagtgcccactccagggcaggactttcagggcataaggtgccatcctccaggacacaggctgcactttaaagacctttacacagtgctcagtgggaagaatgcatgggcctggggaccagaggccctgcctgtctcatccccagggaccagttgggaaaggaatcggcatttcccattctctgtaagtttgggttctgcaggtctaaagggcctggtcccaggaagacacttctgccaggggaggtgccaccagggcactcaatctccttgtgccaagggaccttgcagcaggaagaggagtcaccctcctggtggcactgactggccaccattaccaggaggaggaaaggcttctgctccagactggaagtatatgtttggcacccaggcgatccatgtgggcacctcaagtgcagcaatcccagctgagaacagcagatgtgctggctgagggatggatgaatggggaacagatgt

SEQ ID NO: 467163 - DNA, 1165 bp, Homo sapiens
gtgtgatgaacttctgcagacagggcaacctacaggggctccagcgagaatgaccctgcaatgcagtgcttgtcaatgccttggggagggctctgatctgcacaggggcccctgtcttgtcccagcatccactaaaaggttcctgagccaaggcctcaatgtcctcctcctggaagtttccaggtttctatttgcaccttggccaaagtggaaaattgaagagcgcagactccacccagccctgcagcctcagggctgggaggaacaaagagaggacctgagctttttcggtctttgttttaactcctctaaatttatttgggtatttaaacaaacagaaactacatcatgcatcattactttttgcctttgtacaacaaaacaaagtactcaatatctctgcagaggtttggtgctcattttctttcctttcagtaacatcaggcagacttttcgatatgatccagttttgcacagtcactagagtgtcgcatcatgaattattaaatcagtgcttcgtggtaatacataatttcttatcaattattcatgctaatgtgtgtgtagtttacttaattgtgttattgacgatcaaaagtaatttcctgaaagtcctcaaggacacaaaatttaatcagcataactacttttcagatgcaatgctgttaagtattcttaatttgctcaacagttcacttatttatgtacctttctggaggaaatacgagtttaatcaaacaattagattgaagagttagtgtacataagggcttgagcttacatccttcaaccaaacattcgtaattacagggaaacggaagcaactttgccgctttttggcaaatcgtttcatctttatactcaacaagcaaaatacagcaggaagaaggatttgatttttttctttaaaggagacagtgggttttatcaaatgcttcgtagtgatcatagacaaggcatgatacactcaggagtattatttgggggtcatggagtgggggaaggtaaaaaggggacaggaaatgtgaaagtaaaacattttgacgataataactgaaaccaaaataaccatcatgaaggcaataaccatccgcatggaaacaccatcagcaaaagccaccaaagactgcaacctttcccatgccgggcgcccctgccagaaagc

SEQ ID NO: 467164 - DNA, 727 bp, Homo sapiens
tgtgaagtccttgtcttgcacatattgagagagcctccacatattgagagagctggggatgctagcacagcagggttggtgctggggcctgtggggcagcacgtgcatgagaaagatgtggctgccaagtcaagagctggagggacgtgtgaaaaccctgcgaagcttccttaggcaaaggcccgtgtatgagtcagtcgtattaagcaccttcctgctgttgtgcagccaatctcctgaactcttcatcttgcaaaaccgaagctctgaccggcgaacaattcccacttcccctccccggccccaggagagggaaaggccaccaggaggttctggtcccatctctacaataaactgtgcaaatctggagcctcagttttcttacctggagagggggatgaaccacgcctacattatgggtggccgtaatgtgatgagaggagcagcgggtggtaaagggggcccactgtgctcttgctgcgtcccagaccccatgggactctccttccttcccacctatggctgccagagtaaccgcacggccagcgtggccaccctgcgcatgaaggcccgcgagcactcagaagctgtcctgcagtcagccaacctcctgccttccaccagcagcagccccggccctgtcgccaagccggcgcccccagatggcagccaggaaaagacctctcccaccaaggaacagagcgaggcagagaagagtgtatgaggg

SEQ ID NO: 467165 - DNA, 1064 bp, Homo sapiens
tgcgctaggcttctgcccaggtatctagcaccttctctgtgccatgccaggggatgcagttctgagctcacagccctggggaaccagcccctagggattctggctagggaaggagatggggatgcagagtgaatacttctcagctgtgacttcactgtcatgctcttgcaatcctggatcagcagggccctccgtctccccacctgaccagcccactcccatccacatcgccccatccccaatcagcctgcagcccccacaggccagcctggcgagaggcaaggtccagactctgtctggcaacatctatgctaaactctgctgtgtccaagtaatgcctactccccattccctgcaatggctctcccaggagcacctgccttggctctcatgtcctcgcccctttaaccaggaaattgtgtttggagttgggggaaagtccttgcggcaggaacatcagagctccaccagttgggtggggctcctttcagaattcaccatcatcaaaggagcactagatggcaggattgggggaggctgtgtcagcagcagaggaggtgggaggacctttgagactgctgcaggtctgcagggcaccgagagactgtccttgaatggcaccttaggttgatctaggaaccctgagttaggagaagcctcagaggtcaccagaacctcattcatgccaggcaggagcccaccaggacctggcaaatgaagcctgaagatgcccctgcctggctgtccccaccttcccccacagacacccctgtctcccagtcagatccaaagaacacacagaacacatctgctctctttttaaatcagttacgttttttcttttaaataaaattatatatcttcactgaagaaaatgtagaaaacatagctaaataagaagagaataaaaaccacacatgatctcactaatgagagaaaagctttccagtgttgactgtaatgaatttctgcctggtgttttttctatacaaatagttgtaaacaaaaataggatcatattgtgaagacttctgtgaccagctttttgaatcaaacagtgttgt

SEQ ID NO: 467166 - DNA, 630 bp, Homo sapiens
gacccgtccagatgcatttcccctgggctccctgcaagccagtttcctggcctcaagcctggcctgggggtggcctgtgggggagaagccacgagggcagcagctctggctccagggctgtttctgaaggagccggggtgggcgtcccagcagccagcatgcaggccctgatctggggagacaaggtggagagacaggctctccaggagccatggagaggcagggagaatgcccgttttggggagggtcttaagggacagagctggatgcctaggaggcaggaggaagagagcatgggcaaggagggcactgctggaatgagtgatgagccagggctcatcacagaaggccaggaatgggaacaaggcagttggattttattccacaggcaacaagaaataacttcaaacttacggaaaagctatgagagtggcagataactcccatgagcttttgatccaaattcaccaactgtttatgtttttgttccatttattttaccatttgtattctctcccctctcccttccccttctttcctcatctctcctctcctctctttctccctctcctccccttctcctcttctgtctttcttctcctctcctctctctctctccagacacatata

SEQ ID NO: 467167 - DNA, 657 bp, Homo sapiens
tgctacctcacccaactggtggagctctgatgttcctgccgcaaggactttctgggggaatggggccttgggggctgtctcccaccctcaccaagactaaaagggccgaggcagttgagactgtcatggccttagtaggagcaggaacacccagattggccctggctcctgccatccacatgaagctctctccagcggaaaaggagctactccgtctgcagtttggtgccacctggtggcagctgttggctctggctgaaatcagtgaggatgattctgggctgggtggctctgtgcaacttcaggacagcagcagctgtttcagaaagtaccaaggctgcatccaggggacctactccctgttgctggaggtctcgatttggcaagctttgctacagtgtctgtacgaggccctcccaacaccccaacctccccaggtccccaggaggctgacggctgatgcttagccctgtcaagaccccttgacaagactctggcgagaactctggggacagaggagatactgtgtctttggtctcttctccactggaagctgcaggagagcacataaggacaggagctcctccccagctagaggatgataaaatgcatatctatcccttgttgtgtatatatattttctgttcctaagtcccc

SEQ ID NO: 467168 - DNA, 590 bp, Homo sapiens
ctggtgtaaatgtatacacttctggcattaccacgatcttttgattactgtagtttcatggtatgttttcaaatcaggaaataaggtactcgcttctgtttcctcttctgccacgattgtaagcctgaggcctccctagccatgtggaactgttctgagctgaggaacctagtgttcacctcattttccccgtctttcgggaattcccgtccttcattgcctgatgtccaatgtgttgaagtccgtggtttcatatattttgactggatcttttattgttccaagtgggagggtaaatatgttccttgttacttcatttcaaaatctggttttgactactatgcacctactagaacggcaaatcttcagaacatagcaacacccaatgctggtgaggaggtggatcaacaggaactctcattcgttgcaggtgctggtggtaggctgaattctaagataatcgccagtgactctcgcccttgtgtgatcacctgcttttgaatatgggcagaacttctaaacataatctgactcccatgattatgttaaattatatggcaaaggggtgttgtagatgttattaagatccc

SEQ ID NO: 467169 - DNA, 997 bp, Homo sapiens
cataagcagtccctgccttcacagtagtttcagagtacagatgacttctggcagaagcgctctctcatgggtcatggttacatggcagctaccgcggcaaagcgagagcctcagagacgccactgcggccagcacagccggagacctgagctgggggctcaactggctggaaaagaaagggaaaagaatcatggatttgattttgattcctttattgcaggaactattcaacttagttcccaacatgagcctactgatgttgttgataaattaaatgacttgaatagctcagtgtcccaactagaattgaaaagcttgatatcaaagtcagtaagccaagaaaaacaggaaaaaggaatggcaaatctggctcagttagaaaccttgtaccaatcttcttgggacagccagtgtgtgagtggtggggaggactgttttctcatcaatcagttttgtgacgtaaggaaggatgaacaagttgagaaagaaaacacttacactcgttacttggacaagttctttagcaggaaagaagatactgaaatgctagaaactgagccagtagaggaagaagagcttggggagagaggaaatgaggaaaggtttctgaacaacagtggggagttcctctttaacaagtttcagtcgcgtccatgtgaagagaccaccaaacaggctttgtcttgggctccgaggcctgacaaaaagcagctcgagtccataggcatcccgcagtttcacagtccagttgggtcaccacttaagtcaacacaggccacattaacaccttctgctatgaaatcttcctctaatattcctcatcaaacatacagtagcagtctgaaacttctgaactaaaacactcagcagacatttatctttgtattctgcatgaaatgtgttttgtctttttttattactagtgtttaagtcattttttacttgaatcagatggtgtcatttagtaaggattttattagttcttggcttttaaaat

SEQ ID NO: 467170 - DNA, 1038 bp, Homo sapiens
tcatcactagaggcggcagagatgatgacctttttggctccccctgcaaatgagccccagaccttctccatggcggtgaagacactggcggactccacaacacatttagtgccaacatcaccccattggattttggtaggatcttggtcctggcaagatgatgatgggatttccattgaagacgagctttccattctcagccttgactgtaccatggaatttgccatgggtggaatcatactagatcatgtagactatgttgttgaggtcaatgaaggggtcattgatggtgacaatatccactttaccagaattaaaagcagccctagtgaccgggtgcccaatatagtccaatccgttggctctggcattcaccttcaccatggtgtctcagggaagaggctggtggtgcatgagaagatgcagctgtctgtcgaaccagaagagcagagagactgaaattgttcttaatgattacaagtacaaaccgaaatgccttaaatgattttaaaagctttcttgaattattaacagttcatttcacctagggggcagtgatgagctggggaaaaaaatgaccacattggtacagtatactgaagtgcaggttgccactctcactcttgcaaataattttaattgctctcctaaattgtctgtcttggaaaaaaattttgagttgaataaatttccaaatattcatgtttctctagcaactcaccaacagcaattccaaattggttgattatatgttgacattcattaaaatattagaagaaaattaaacatttaaaatttggtaatttgatattttttacacctgatgtggtgttggccttcaatttttcacaactgcttaaactaactgcagttgattctcattattcacagagtccatatttgtaaattcccctatgagctaaagcttatttgtaatcctgaaattaatacttgaggtgcttttgccatcatttgcgaacattcacagagcagcaaaaaatttgatttgcctgatatacaacactaaggtagaacaag

SEQ ID NO: 467171 - DNA, 595 bp, Homo sapiens
tgacgttgttttcaaataacaagaatgagacaacttttccaatggcttcagcaggacgaactaggctttgtgggcagatgttataagtgggagaaggaggaaggggagagggagagctccaagggaaacaggaatagggagaaaaggtgcttcctggcccctggagatgtctccaatgggtgcaggtttcgagagggacagcttggcggcctggagcaatcatggaaggcttcctggtggcagactctaggactgggatttgatagagggcttggatatggcagtgggtctcctggggtggtgatgcttgaggaaggatcagcaaacccactgtccaaacctgggcatggcaccgtggtgcatatcagtcttgatcacccgcaatatggaaccatggagactaatcacacatacttacagttaagtaattttggataattgacacatatttggagtaaggataaattcacctaaatatccagatttctggcattctggaaaaatggtcagatttggctccccaccccgcgttcttgcctggcagctcttggctggcacagagctgtggcaccctcccagcctcccttcacgtagc

SEQ ID NO: 467172 - DNA, 1202 bp, Homo sapiens
tcaaggatagagctttcagccatgtgtcagagggtaggagcttcacctcctgcagcccagtcccctggtcctgcctgcccagagcagcatcaccctcaccagctgcatgcagccctcaacacagggcaaggatttgatgagtgttcattcaggaacttatcaatgttccactcctgtggaggtgaggtcctgcagctggcaatgcatagaggctcggatcattggcggctgtccaggcacccaggcagaatgtttcacatccccagcccacgctggcagatccatgcaactgcccagaatgaagtgagtcctgaaccacaacagacaggcccattgttgagctaccatggatggagctcattgaggacttgcctcttccaggactattgctttaaagtaaagaaggaagcggaagtgaaagaggaagaagaaaaggaagaagaggaagatgatgaaggaggagaaggaggggagcagaagcagcagcaatgggggagggatgggaaaggagaggagctgcgctttctaggatgccagaaaagagtgatagttacatgcaatgagaacacatggacacaggaagaggaacatcacactctggggactgttgtggggtcggaggaggcgggagggatagcattaggagatatacctaatgctaaatgacgagttaatgggtgcagcacaccaacatggcatatgtatacatatgtaacaaacctgcacgttgtgcacatgtaccctaaaacttaaagtataatattaataaaataataataataaaaaagagtgatagttacatggatgttggcttttgattatttgttgacttgtaaaagtttgcttagtgcaattttctgaatgtgtgtcatatttcaaaataaataatcttgactcattggtttggcaataagaactagctttaccatctaggatatttggtggacattttccaatgtttggatgaaaatatgtttaaagctggcactcagacaaaagcattccatcaaaaatattatgctgataaagtaagtcagaattacattatttgaaactatttaaacttattaagaattttagatttcaactttaaaatgtgcataaggtacatagtttttaaagcctaatggctgaaacagactaatggtttattctctgacataaaagaagttggagatagacaggttatgcttgtgtggcag

SEQ ID NO: 467173 - DNA, 692 bp, Homo sapiens
aaactgtgagcccaataaacctcttttctttataagctgtggcagagcaaagatgtgagctcgccttctctcataattgcctcagcactcgcctaccctgatgcacaggaagtccaacgcctcctttctgggccctccctcctcccctgtattgtccaagaatccttcttcttcagtcctgctccctggcaccagatggacaaagaacaactccagccctatgctgccattgctggatgctgccacacggtgtcgctatggaaggtgtagcctgcaattggcgctggtggaaagtaccaaggggaaatgtgaggttggagcccccacacggagtccccccactgggccactgcctagtggagctgtgaaaaggagaccacctttctccagaccccagaatggtagatccactggcagcttgtaccctgcacctgcaaaagccacaagcactaaactgagagcagccacaggggatgttctcagtgaagacttaggaagagttgatgggtggatggtcctagagaaatctctttaccctcatttcctgtccttagcctttaccaggacagggctatgaagttggtgaagaccctgtagatgagaactggcatatagatgtcattttgtatttgggactttgggggattttaatacattttgccagctcatgcaaatttgttaaaagttcagct

SEQ ID NO: 467174 - DNA, 1685 bp, Homo sapiens
gtgggcataaggagaaaggggtgtatgagacatcaatggctacacatttccagcaggctgcagatacacgtggacaaaagacttgcactatctgccagatgctgcttcctaaccagtgcagttacgcatcacaccagagaatccatcagcacaaatctctctacacctgccctgagtgcggggccatctgcaggtcggtgcacttccagacccatgtcaccaagaactgtctgcactacatgaggagagttggttttcgatgtgtgcattgcaatgttgtatactctgatgtggctgccctgcagtctcacattcaaggttctcactgtgaagtcttctacaagtgtcctatttgtccaatggcatgtaagtccgccccaagcacacattcccacacctacacacagcatcctggcatcaagataggagaaccagaaataatatataagtgttccatgtgcgacactgtgttcaccctgcaaaccttgctgtatcgccactttgaccaacacattgaaaaccagaagttgtctgttttcaagtgtccagactgttatcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcagtggaaaccaagaaagtggccagtcctgggtggacgtgttgggagtgtgaccgcctgttcattcagagagatgtgtacatatcccacgtgaggaaggagcaagggaagcaaatgaagaaacatccctgccgccagtgtgacaagctcatcccacagcctgtgccagcacaaccggatcaagcacaaaggcatcaggaaagtgtatgcctgctcgcactgcccagactccagacgtacctttaccaaacgattgatgctagagaagcacgagcaatcactcaaccactgaaaaagctgaaaatcaatgtttttaaggttctcaagagtgccatgtgtggcttcaccaccgaaaacctgcttcagttccacgaacacatccctcagcacaaatctgatagttcttcctaccagtgccaggagtgtggcctctggtacacgtctcacgtctctctgtccaggcacctcttcattgtacacaagttaaaggaacctcagccagtgtccaagcaaaatggagctggggaagataaccaacaggagaacaaacccagccatgaggatgaatcccccaatggcaccgtgtcagacagaaagtgcaaagtgtgcgtgaaaacttttgaaactgaagctgccttaaatactcacatgcggatacatggcatggccttcatcaaatccaaaaggatgagctcagccaagaaatagccacagaagatacttgcatgatctactgtagtcaacgttcggttcctcaaaaggtcttgctgctgtcaggtgttatgcactccatccataataactgtgtgaaacacatttcatatgtaaataaacgtgggacatttggcccatgtgcttctgtgagagagttattgattgtgagtctctgacatctttgtgaagtttgggaagtga

SEQ ID NO: 467175 - DNA, 794 bp, Homo sapiens
tacgcaaaaagggcagggcatttaggaggtgcacagtagataatgcgacaaggtgctgtagatgagcacctactaaatatcagagaaagaagtgaattgactgggcccagaagagaggaaaatgccagtctggtgatgccagaccaacagagaggagtgagtgggaggacaggctcagcactgaactatctagagttgcccttgagtcctagccaagatggctgtcactccccagatgggcttacagaaatgcattcccatttcataatgcctgctgtgattccaggtaattcctctaagtgcactattaaatcccagcagctgttccagataacagcaaagtcgacaattccagctgccgccttgtcaggaaatgaagcaaagcagcttggaccatgagatcagtttcatgagtcctgaccgtcattttataaatgaaatgagaatggaatgaaatgaagtggagtggagtgggatggaatgagatggaactagcaggaaataatagaatattccagaatagaaactatcaaagtacatcacatgtagtaaaggattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacatggttcattaaataataaagtcttcatcaggctctcctgca

SEQ ID NO: 467176 - DNA, 869 bp, Homo sapiens; identical to SEQ ID NO: 459604

SEQ ID NO: 467177 - DNA, 658 bp, Homo sapiens
cccaggggtgaggactttctctggagcctgaggaaatggacgtgggacctgagtcagggtgtgggagagaacctgtgagcttgctgagcttccagtggaaccaggcgagcaaagagcaaaatgccaagggagccaaccccagttcagttctacaacactacagcgacttctgccatttttgcagattagagcatgagcctcaggctgtcagcggagaaggcaggaacctgtttctccggctctggcttggctccgttctggggctgcttcctcctgccagcagcccagctgtgaagtcctctcaggaggtggtgaaccctggagagcaactgatgctacacaaaggacagcagctgaaaaggagcctccgggggtcactgtctcagagagcccctaacctggccagcccggaagggcagaggagagggctccctgagctaagctgccagccagaatttgggctgcagagattctaggtctgaagaccacacactatttggaatgttccttttagaaaagaatgctgtaggaggcaatatgaagacattttaaatatagttctcaaaaacacgttctttttttgtttttgttttgttttgtttttggcataaagttatgagcgggggctcgagatctgactggggtcaaatcctgtgcc

SEQ ID NO: 467178 - DNA, 970 bp, Homo sapiens
tgacattgaaggattgcttgctagggaaagtttggttaagtatgaagtctaattattccaatttagcaaacaaaaccttatctgcagtcattccccctcctccccaagcgttctcaggcctggctcctgtcacacagagctcacctccatgcctctgcccctgctgtccccggacaagccccccagccaggcggctctcaacctggtggcctcagtatgatcttcctgatttgcaagctttgtctcttaataatctgcctttgtctgttgatgttcagcaaacctttgggaaggtttcccttggcccctacagtgttggcgtcacagacaggatcctaaagctgctctacttttctggaagccacagtccagggaacccaggacctgacaaagcatcagaaggagccctcatgacccaatcgcctcttaaaggccctgcccctcacgactgccacactggggattcagttccaacacctggcatttgccagacacattaaaccatgaatctcacttagttgatctatattactattttaatgtacttttaaattatctttatgaatattttattgagaattttggctctcatatttaaaaatgaaattgtctgtaatactttcccactctccggcacctgagtccatggctttggcagccatagtgatcatgaacttccggctatgtcctagagtcatttatctccgaggatgtcaggaggaaccccaaaatgtcatcaagacactggctacaggtctaaactccaataaaatccagctgggttacatcaattcagacatctggataaaaggatgaatgaaaccatgtacataatacagaattatgcatgccaggaaaaaaaattatactgcctaaaagctgcaaccttcatgacatcaaatctattttaacactggctggttatgtgaggaaaaggctaataaaaaaaaattctggctgaccaaagaag

SEQ ID NO: 467179 - DNA, 856 bp, Homo sapiens
gcggcttgatattgcttatgttacttctgtggaggcctcttgcctgcagtgagccctgtgcgctaggtcttgaccgtgcagccagcgttgagagctgggggagacagcagcgagaggcccacgccaagcgcctgaaggtgccgctcccggccggctttgaatgaggagctgaggatgcacacaggcgtcctatctctcagagaagtgaagtcacagggaaaaccactgtccccagaattgaagagacaaacaggcagttatggaaaaccacaacttaatagagcagaaacccacaaacaaaaatctccccaggaatcagctccaggacaggaaaacttgaactgcagtggatggattgctgaaggaaaaagaggtttaattgactcagtttcacatggctggggaggcctcacaatcatggcagaaggcaaaggaggagcaaaggcacgtcttacatggtggcagtcaagggataatgagaaccaagtgaaaggggaaacccctttaaaaccatcagaccttgtgagacttgttcactaccatgagaactgtatgggggaacctgcccccatgattcaattatctcccactgggtccctcccacaacacatgggaattatgggagctacaatgcaagatgaaatttggatggagacacagccaaaccaaatcaccatgtgctatgcatcttcttagtgggggtggggagggaatatccctgcatacttcagccctctggacccctaagcattaccctgatgtcacaggctcctaaacctgcacagagctcactgctcaccctgcaaatggcatatgttttatcaaggcctccaatgaacttgccatctcttcctcc

SEQ ID NO: 467180 - DNA, 522 bp, Homo sapiens
ggggtaccgggcactgtgtgcaatgcaggacaaacaaagcctgggcgggaacaaggtgagggtggaagcagggccctgtttggtcctgggacagtgtgggttctacccgatcgacaatggaaagtcactgaaggtctccattggaggtgacacagtcggatctgcatttgaggaagatggcatcacctgttgtgaagagaaggacccagaaggcggcagcggtggagagactgtctcctgcttagcaagcaaggaaattaactgcaagtcctgtttggttgctgatgacgtgacctttgccaagtcacctagcctttctgcacttcggctctatctgaaaagcgatggggatagaacatctgttctacctacatcagggagtcgcagaggagatgaagaagaaagctttgaaaattggaagtgcctcaaaatatgagatcaatactatgtttctggaaaaatgttacatttaaagtacatatttgtagaccgaatgacactgtacacacttccttagttgac

SEQ ID NO: 467181 - DNA, 595 bp, Homo sapiens
cctgaggggtccggctccacttataggtgataatgaatgttttgcacgtgtgatgtcgggtctcgcccttggcgtctttggggcaccactcttgggcagagaagaaaaagaaggttcctgctgtgccagaaaccttaagaaaaagggaaggaatttcgcagagctgaagatcaagcgcctgagaaagaagtctgcccaaaagatgcttcgaaaggcaaggaggaaacttatctatcaaaaagcaaaccactatcacaaggaatgtaggcagatgtacagaactgaaattcgaatggcgaggctggcaagaaaagctggcaacatctatgtacctgcagaacccaaattggcgtttgtcatcaggatcagagatatcaatggtgggcaagagggctctctggttaaagacgtagtgtggactcctcctgccttgccctccaacagccctcaacccctccttcctcaccctaatggtgtcttgaatgtaacttactagtttgactttccctgaaccagagcaatgaactcatagaatgattttaacgttgagtaattatgtctccaggtgtttgacatttaaaacttgaagctgaaa

SEQ ID NO: 467182 - DNA, 646 bp, Homo sapiens
agcgctgacttctgcagcaccacgtcttgatgcctcacttaacccattctgtattttattttagatttagggggtacacatgcatgtctgttacatgggtatattgcatactggtgaggattgggcttcaagtatatccattacccaagtagtgaacattgcacccaacagggtaatcgttgacttccagcaagacatcctggaggacaatggaggtgaagaggaaatgggacgcaaaggaaacaggcctcgttccccagtccgcccacctgtgtgctgccctgggccagtcatatctcatcttcacaagtcccactcaaggcctgagttcctccgaaagcttttccactattgtgccccggagacttcttccttcgctgaacttctgttgcccttcctgaatggtttagcacctggtcccacagcgtgtgccttcctagaagtgaaagaagagaatgtgcttagtgacccgaaggtgctgaacggcccttatgggcagcaaccggctgtttgggttgaatgtgagatgtctctggattcctgacggtataggtatggtgtgtgaattctttttgtggcataagggaaatatctaatgacagcaaattgcttattttggatcattcttgagcctggttttaacatt

SEQ ID NO: 467183 - DNA, 534 bp, Homo sapiens
ctctcctctgccactcccacagaatgaagccacggaccttcgcagtgagtgttacagctcttaaaggtgatgtggacccaaagagtgagcaacaaagagatttattgtggagagcaaaagaacaaagattccacagcatggaaggggacccaagctggttaccactgctggctgcggtgacaagcttttattcccttatttgtccccatgcacgtcctgctgattggtccattttacacagtgctgctgatcggtccattttacagagcactgattggtccattttacaaacacaaagagccatgcatatggagtcatttacttcaaagatcggaggagaactcaatgaaattgagaaaaaagaacaatacaaaaattcaaaaggagacattacaaatgataccacagaaatacaacagatcatcagagactactagaaacaacaatatgcccacaaactagaaaacatagaggaaatggataaattcctggaaacatacaacttcccaacattaaaccaggaagaaatagaaa

SEQ ID NO: 467184 - DNA, 985 bp, Homo sapiens
catcagtgtgtgcgtgacatccagcatgaagaagctaactcaaagccctgcgtgttgcatcatcttcaatgcccattagacctaaaaggcaggatgatcaccatcattttttagatgaggaaactgaggttcagggagctttaaggacttgtttgggtttgcacaagtttggaaaaagatttgaacacagcaatgatggaagtatgtcagctgtcaaaggttctggcagcagaaggcagctgagaataaagcggcttcacgaaggaggagaagaagaagaaggaggagaaggaggagaaggaggaggaggaggaagaggagaagaagaagaggaagaagaagaagaagaagaggaagaagaggaacaagaaaaaaacatatccttaatttctgcatctgtgaatgatcatagtaagagcatagcaatattgatgccgtttaacccccaaaaaacgataagaaggtccaatacgcatgtgccctgagaaatgtaacatgttatgcacatgtaggtttaatttaaatgtagtcgaagatgtaaaatttgtaccattcttttaccggagaagtaaagtatagatggactggacttgacctctcactgctttactaaatactgtttgactttgggtaagtcacctgacctctctgtgcctcagatcccttattgatacagtgaggaagatgatgatatagacttcatggagttattgtgagaagcaaataaatgtatgcgcttaggatggtgcaaacacagagtaagcactagcaacttgaaacgtaccatctgtaggtataattataagctgtgatttcatattcacttagtgaaattctctatttgcactcaatcaagtaaaactgagtatctcacaccgactacaaagtagaaaattctctgcatctagtgttgacttaatgaccatctaaaaactgacaagtttgctttgattgtaagacagttaatcagatccattttaagctt

SEQ ID NO: 467185 - DNA, 961 bp, Homo sapiens
agaaccactagtccccacttagtcttggagaggaggcaaggatgtgtgtcctctgcggccagagaacagaaccatcccctctcaagttggtgcctctgcgagcggctgcggtcctgcttgtcctgggaatcgcaatgccaattgttctctccatgttttgcaactcaacaccatttcctcacgcctattttccttgtttccgctttgccactgtttgcagacacaggaagaggtcagtgggctcagatgaggacaaggcccctgccggagcacagattcagaatggtgttctagtacaactagagtctgatgctggtgtattgagcggaagcgaatgtggggattctttaccagcctgtattgtgtaccacactttcatacccaagtattttcttagaatgctcaaaagaagaagtagaatccagggtgacttcacaactgcggatacagggcaggaaaagggtagcatttggagtccgggtgaggaaagaaagttcttccatctacagcatatcttcattcttcttgggcgtggtacaggagcttgggaactgctgaacgtaggtacaagctgtaacacaggcaagctggggcatgccagcatgcaagcagggcccacgtggggcatcaccagccagaagtccctggcttgcaaagtgaccaacaagaaaaatcatacatcaaaagctgaggcagctgcagaatgttaaaaggtgcatgtcaaaacgagtttagctgagcatttcttcatttttcttcccatatcaggcctataggaggagtcaaaaaaacaacaaataaaagaatctatatgaattgtgagggaaagacacttcttgaaagtcagaagcatagcactctgaaggaagatccccggctcaccccaaggcttgaggcaacagagctccctgcttttaatgacatatttgcagcagggtctttgtggctatgacccacaacc

SEQ ID NO: 467186 - DNA, 1423 bp, Homo sapiens
ctgctgttcattctaaaggcagtcttttgcccactgaacatactcgatcctaaatgaatttcttgacaatgaactctttggagaggcagatgctgctggccagtgtgttgctggcagggtgttttcacccagacactgctgggtgtgatggagcaagtgctgcagacccacgtgttctgtctcctccttctaagctgcagcagtttcacgccatggccttcctcggtgaatatggtatcatcaacgctggagatctgctaataatttatgaagtaagtgagaagccatcgctgtcatgctctcaatacaagtcccgctgtcggtctgaagctcgccgcagctgctggcgttttcgcctccgccagatttcagatgaactcatgataggatctgacagagtaatgcccagctgtctaagttcagcacatgtgaaaatccaggaaagtaacaaagacagtgtttgtcacatgtagattaaaccacaagcaatagcaagctatagcaaggttaatgtgagatgtgcgaggcagtttcctctgcattgcatgaagcagatgcactgtaaataaattcagtcatctcaaacttttatttcttcatcttcgaaaatgttaattatcaattctagccattactgagtgtttgcatgtgtatgtgtgtgtatgtatgcgtgtgtaggtgtatattctgtgtgggtgtgttttttgtatgtgtgaattgaataatcaaatgattaattgttaattattcattaaataagaaaaactaccagtaaaatacagcctattccaacttttataaaatatgaactagaaatatgtgatatcattgaagaccacattaaagattacatatttttaatgtgtataatgtctattggaacaagtttttcctagacttatagaaatagtgaaggtgattttaaaaattacaaattcttcatagggaaataaaaatcatactgagatctgcttgctagccactgttggtaatgagataattagaggcaacaaatatattaacatattatagctctaatatacaagttaatgaaataacattttgacattatatagaagttaaaactcttaaagtggctttgctatatagcagctgctcaagaaatatttaaattcaaatttaatttttgaatggttagtcagtgtcagacactaggtaacaaatgtttacacccatgatcgcctaataattttggtgtgtttttttggttccaaatttacagatgagagagttgagaaaataagatctaagtaacatttctcgctttgattactaggaatcttagcaactaattaaaaacccaactagtgtcatagttatacattttgtatattgttaattttgttcatctttccttatattttcttacattattcatgttattttttaacctgttgtatat

SEQ ID NO: 467187 - DNA, 508 bp, Homo sapiens
cacctgaaggatcctgtggcattacttacttgtgcagcattgttcttcctctttaggagtgtgctttattgttatgtgtgaatttgattccatcatcatgatgctagctggttattttgcagacttgtttatgtggctgctccataatgtcactggtgaaagggtatcagggactcacttaaagaagcagtctgactgctttttggtagagcagctgtgctgtgttggtgaaatccttcactggatctcttcagcccccagtcagtttggtctctccaaggcccataggctggactggctgagatacccaaacagtcaaggtggtggcctgccctgccccctgggcactctgccccagggagaaattagaactcagtcagctgtagaacatgggtggggatggccagaggccctggttgggaagacccacccagtgaggagaagtggatgtgggccccatttaaaaagcagtctgaccatgccttgacaaaatagccatgctggggaa

SEQ ID NO: 467188 - DNA, 555 bp, Homo sapiens
agcagcaaagagggagtctgcagcttctcccatgcggaagctcaagagctcagatggctctgaagagatatttcatcttgaggcaaggaagctgggcaatcacccacctgctttgactgtcactggaggtggctgtcaccagagagagggtgtaaacttgaacacagtatctcctttcaaggattggccatcaatggccaacattcctggtcccacaatgaatagctcagtgatcacactacccacactgagagcagtacggaaatttgatatacccttttgccataatccttacctctgtcagagctccatagacttgggagatcctcccagggaagagaaacagtttgacagagtgtccaatgatccaacttttctggagcctgtccgtggaagtgacttcagtaccacttctcttgaagtgctgacaggacttagtgcactctagatgcctgggggctgctaagaacaaagaaaggggattgaatgtgcacgaaggttaaaaaggctcctagaatccctagcaaggctgattcgtgagggtcttctcctgta

SEQ ID NO: 467189 - DNA, 522 bp, Homo sapiens
tcttttcttttgtgagatcctatagcctatgactggctttagaaatattaaggcacatgctttgagcagcttttcctatggggacaacctgtgtgcaccaacccaagcctcctcttccaaccaccctctctttgacacatagtcaaactggggtacagtctgggtgtggggcagaacgcaagcccactgagccctatgggagtcagacccatgacccagccctcagtgacataggactccagctagcctcacactctggctacactgtataccaaatgaaaagttattctccggggcatgaattaagtttggagattaacaagttttggaggggacaaaaacatccaaaccatagaaaggaggaaaagttcaggggacctgagaaagccaagaaaaataacacaagtagaaaggagccaaatgcaaacataattatgtatccagtgtcctctgtgttttgggtttggaatgaaactgctgcacaatccactaaaagaatctcatagatccaagtccgtctac

SEQ ID NO: 467190 - DNA, 2121 bp, Homo sapiens
gacagtggaaaatgaggaaaaacctgaattgggtgctgagctctcctaggtcctgggagagccagatatgctgtccaagagccagataatagagtcaaaagccttagacatctacctggtgttctacgatattgaggctaagctggcattcaaaccacaagaggtagtccttcctattcttcctccactcccctgcaccccattccatagacagagaagcctcagcccatggccgtcagcaccacaggcctatagggagtactgtgaggctactgccaatatttccttaaggcccaaagactctttgggaccagttgagaagctagagcaacgaggccactgtaaaatcaagaagcataaactttgcatgccagtgggagtggataatatattcaaagtgtgcgaagaaaaaaacgtcattgaagaatattttattcagcaaaactgtccttcaaatacaaaggagaaattaagactttccaagataatcaaaagtggagagaatttattatcattagacatgctctacaagaaatgctaaaaagagttcctcaaattgaaaggataataagaaagcaacacactcagagtcatatggaaatattagcttctcccaaaaagcacatctcaattcaaactattcacatttcaactgttcaatagccacaactaactagaaaagcatctgagtgactgagttgtcagctgaactaaccagtttatttttaacatagaacagtattttactctagaaactgacttgataggggttgttacaagaataaataatgatatggaaaaagtcagatttagatatgaaatcttttcttgtgtataaaatataatgaaaatttaagtaggtatgtattctcaggcatttcacaaatcgtatttaacagaaagatttaattacttaacattacttaactcaacatactcttatcaagcacctggtgtttgccagtacggtactgaactccatatatgcaaagacgattaagacattgcactatatattcattagtgtttgagaaagatttatccaccatgaaacaagcaaaacagttttatgtttagctctcagtttattaggccattttattttctaagcatttaggtaaacattttctataacatacattgaggagtcatctttagttcctttgaatatattcttaaaatctcaaaccatctgcagtagtatatttaatgtcataaaacaaattatatatattagcccctttggtgtcctagattcttttgacgtttctcttttgaagagagagagtttctaaaaggggaactaacaaatgaaatgaccagtgctaaaatgaccaccccaataaagctacaaaatatctacctttccacttaatggatgtttggacctagacagcaggagtacttttccctgtagatttatccattatgtctcatgcactgctaattcattttcctgatatactagggccacccttcgttctcccattgtcctgtccaagaaagagcttgctttgaattatggggaggaagggtatcaaaatttcatatttagccgaaagatatagatttccttttgcatactcttattctgtgttgtctcccttcctcccttcctgaatcctcaatctgtacccaaacctaaaagtcatgttttgggttacgcttcattctgttttcaggaggacatagggtggcctttttttttgttctcatttatcagcatacatagagccaaggctctggaatgttttgtagttttcagtatataaattatccactagatcacttgttccagaaaacaaagttgttctgagcccaatacaaacgaccccagagatacaacagtcatttcccctttttacagttgttctttgttatgccccagtttactccatggtatagattaaatgcattctgcattttaaaaactccttgaaagcatctatttaatgttctcatttcagtgtgagaaaattgagctcaaacaggaagaaaatgtgacttatgttggccagaacattttctattaaaaagaacagattttcctgagctaacctacatttgagtcttgcattggattttggttggcattttaacatagtgtccccaaggttcaga

SEQ ID NO: 467191 - DNA, 4349 bp, Homo sapiens; identical to SEQ ID NO: 459600

SEQ ID NO: 467192 - DNA, 597 bp, Homo sapiens
ctcctcaagtgccgccaaagtggaagcccaggcagaggaggcaccgagagctagcgagggctgtgaggactgccagcacgctgtcacctctcaataacatgatatcaagaaaaggacaatatacctcttctgtggtggcctctttattcaccaggctcataaacactgctgtctccaaaggaactaagttcatctctctgctctttgaattatatgcattgaaactcgttaccgtggttcacaagctctaccagatttgctgcctctctgactcgacagcagcactcgcccccttggtatccacaccagagccaccccggcaggtctgtccttccaactggctgttctccctgaaggcctctgcacctaaagcagccaccccaggcagtgccatggctgactctacagcatttttccagaatgtgtgttacagagcaacttgcaggacactaaaaccctcatgttcacttttcaactgtgtagctatattttgtaatgcctcttgaatggtctcttcctagtgaaactgctgcaaattgacctaacaaatactcaaatgatagtttcagtgttctaaaatacagagctctctgctcc

SEQ ID NO: 467193 - DNA, 2326 bp, Homo sapiens
gtgggccttttgaggtgaccaggcctggtgagaggggcatccacggctggatgcagcgacgcctctccaccagcaccctgctttgaggacaacttcttggtccacactaatggctttcattcgggttttactgctcccacttcccaccgcagggccgcctgcttgctgctccacagcctccttgtcaaatgttcagatcttgcttgatctgtttttccactttcctccttgcttccctgcagcactgcccaggggtcaaaggttttggtggctgtgacatctggggcccaagccctcttctgttaccagatggtggcattttgggactgaaagctgtgctttgggatgaccatggggacacctgcttgtgtgggggggtggaggcgaatggcttcctggagtgatacatggggcagtacaggggtggggacatggaacctggtgagaagacagccctgacttggcagaaagaggttccaggcatcctgtgcaaagcatcttttctcgggccctgcctgccagagggctgtgctgtgagcaccgggcagcctggtcgcactgggcagtccagggtacaccatgaatcgtggctcctgggagaagacttcagcagtcggcctctctgaggtctactggtctgggtggtggagtgggcgctggggtggctccatcacagaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagaggaacaagtaagattaggactggtgtttctaataatcagatgccaaagttgctgcaccgtcctgtgaaatatctgcactgcgggggagtgaggagcatccagtgattccttgcatagggttagtttagaatcccagtttgttagctctttcaacacatgtgtccataaatagattagggagagcttgttgctttctatcctaaataagggaaagggaactgtaattggattaaatcaaggacccacaatttctgaccctgaaagttgcataaaaaatgacccgaaggcacctgttggttagaatggcagcagctcattcaaggtgtagagattgaagagtcaccccctgaggcaaaggactgacaacaaagggccattctgaggttggcgggggtggaggttagagcagtgaataaaacaagtgaaagtccctgtacttagacagctagtgtggatatgggctcagtaggtctcaggcactgttctgagcacttcacacacatgaacccctttaacccctgcatctactctgacatgggcatttctcatcatccccattttacaaatgggtaaaataaggcacaggaaaattaagtgacttatccaaggacataaaactagcaagtggcaattgagtctttcaaccctgtgagcatgtgtttgccaaattttaaaaggcatacatttcacccaggggatttgggcttgaaagcagattctgattcagtagatccggcatggggcctgccattctgcatttctgaggagctcccgggtgacactgacattgctggcccgtggaccacatgtggggtggtaagggtccacaccatgatgggtatccttggcctcctggaaaccaagctccttgaagatatatgtgtattgttcatctccgtgttgtcttcatcaggaccttcttatccttatctaggcttgattagctgaagccatggaaatccagccaagctttttcaggagagaagtgggcacagtctaagggtgcaaagctcttggaatgcaaagagagtaaatacaacatgccaggccttgtggggcccagagtgccatcaagctttggcctctcatcttccctctgctatgcaggttctaggctccgctccattctgctcacttgttttccaacatggccacccacaaaatccactggctctttcaatctcagggctcacaataaccacatgcactctgtttcttattttaagtgtttgaagggggaatctggcag

SEQ ID NO: 467194 - DNA, 509 bp, Homo sapiens
ggttattatcatattctatgtatttcaacagccttattgatatgcttcatgggaaggtggaacaatggcaggcccagctgctgcttcacactgatgaggtgattccactgatcagcagcaataagatggaatgcacaagtggctggcagcatgtggaaaagggggagaaagaaggagatcgtggtctgcaaaagggcagggctgtggtgcaggtggtacaaggagcagcaagaaacaggaggaccccgatgcaacccatggattcagggcagggtctcagagcagggagaatccctgttggctcttggagcctgggcaggagcagcccagtgggcagactcaagcagacattcctggaagaggaccagggccataccacaagctctaaggcctccatcctgctcaccccagtctccctgcacaagcaccaagcatgggacacaggcacacagacagcatggatgcagggctgggctggaaagacccagacaccctgaatgtctccttca

SEQ ID NO: 467195 - DNA, 1777 bp, Homo sapiens
caaccgctgccagacgggcgggaacaactccccggacaccggtgggccgaggctgttgcgaggggcccacgtcaggcggtggatggtggatgctggacccagcggagcacccccttcccccggccccggccccggccccggccccgcgcctgcacgtccacggcggtgactgcccagcggcggcggcgagaaaagcggcggcctcccgcgccctctgccggctcaccgggaaggagcccggagccggtgcgctgaccccggaggatgcaggcggcgtctgcaagggggtcaacgccttcctccccggcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcgcagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccctgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaaggtcagcttccaccagaccatgaagccagagccagaccctgcgttccgcacctgactttcgtgccacttccttccttgtgtgtgcccgtgtgtctgcatgtcggatgcaacggagcgtgggtgcatgccagcctgtcctgcggccctcctggaaggaggggtgaaatatcacagtgtccacagctggagctcctggagagcaccagggaccccagcctcctgccccgtcaggccacagcatcagggaaggacggcagcccctgtgggaggtgt

SEQ ID NO: 467196 - DNA, 1050 bp, Homo sapiens
cctgtgggcaccgtgacctgaggcctccatggaccgtacatccgctggtcctcaagggaccccaaataaccgacgtggcccgcagacctccaataaccaacacagcttacagaccccaaataaccgaaccaacacggcccgcagaccccaaataaccgacatagcttacagaccccaaataaccgacgcggcccgcagacctcaaataaccgacgcggcccgcagaccccaaataactgacgtggcccgtagaccccaaataaccgacatggcccacagaccccaaataacggacgcggcccgtagaccccaaataaccgacgtagcccgtagactccaaataaccgacacggcccgcagacctcaaataaccgatgcggcccacagacctcaaataaccgacgcggcctgcagaccccaaataaccaacactgcttacagaccccaaataaccgacgcggcccgcagaccccaaataactgacgtggcccgtagaccccaaataaccgacatggcccgcagaccccaaataacggacgcggcccgtagaccccaaataaccgacacggcccgcagaccccaaataactgacgcagcctgcagaccccagataaccgatgcggcccgcagaccccaaataactgacacagcttggtgcacttgatcagaaagggtggccgtactgcaaaattaagatgtcattattcatggctaaatggggaatcagcccccgagcacctatgaaatcacaaaaggtctgcttgtttctggagtgtcttccttttggctggcaaagggagcagaaaatgtggaaagttctgtctacttagaggcccttcctcaaagtgggctggccagcaggattaggagggagatgcccatggcaggcagagatctgtgagaattaaacagcatattttaaaacaaccaatgggccagagaagaaatcacaaggaaaagcagaaatgactatgtggagataaatgaaacaaaaaaacccacgagacagctcagggatgcaggaaaagcagcactcagaggaaaattcat

SEQ ID NO: 467197 - DNA, 1315 bp, Homo sapiens
agtgcagccagacatttggggccactaccggtctctgcatcttgatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagatgaggaggccactgtccagggccatgcagtggtctctgagcggcccctgatgttcctgttggacactcctggcgtgctggctcctcggattgaaagtgtggagacaggcctgaagctggccctgtgtgtgctcacctcggctgctgcttccacaggaacggtgctggaccacctggtcggggaggagaccatggctgactacctgctgtacaccctcaacaaacaccagcgctttggcgtccagttggacaagttcgggagtatggctatacgtctgtgaaagcaacacacaatcaagaaaacgagcgttcccgtcacccccagtccctgctcctctttcgtgaaatcaaggaaacgagcgttcccgtcaccccccatccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaatgagcgttcccgtcacccccagtccctgctcctccttcgtgaaatcaaggaaatgagcgttcccgtcacccccagtccctgtgctccttcgtgatcacaccttcctgcccctccctgagcccaggcagccgtctactgtccctgtaggttgctttgggttttctagaattccacgtagatggaatcacacaggatgtgcattcttgttgatctgtcactcggcacgattgttgtgtgatccccgtgtgtcgtcgtgtgttgtccgtcattcatcctttttgttgccaggcggtttcagtgtccaggtgcgctgcagtctgtcccttcacccgttgatggatatgtgggttgtttgcaggttttggctattgcagataaagctgctgtgaacattcatgtaccgacaggtctttgtgtagatccgggctttcgtttcccttgggttaata

SEQ ID NO: 467198 - DNA, 1050 bp, Homo sapiens
agaaagggagctgcaatttaaagtggtagtgtttgtccgagatgatggtgctcctgttctataattccagaccctatagttatgaaaggacaaagggttttgactcgagtgtgatgtatttaggagttgattcctgtaacagcccgtcggaaaagcgcggtattagggtaggagtgacccgattttccaggtgccgtctgtcacccttttctttgactaggaaagggaactccctgaccccttgcacttcccgagtgaggcaatgcctcgccctgctttggctcatgcacagtgcactgcacccactgtcctgtgcccactgtctggcactcccttgtgagatgaacccggtacctcagatggaaatgcagaaatcacccgtcttctgcgtcactcacgctgggaggtgtagaccagagctgttcctattcggccttcttggctgccaccccaaggttttcttaagaagctaatctactttaacaatatgtataaagaattattaaaggtttataaaaatctcatctcattgtcaaattggttaagattaaatagaattatctataaagtttcattaaaaattgggattgacattaataaaaaactaataaaagggtgaaattcgactttcttttgaacaagattttcaagtcataataaagactaataaaaagtttttactttttcaaatgtttaaatcattttaacaaaacaaatgacttatggtaatctgaaattctgtttcataatatcaattggctttaaacttctaacatattcgacaggcttcccaaaattaaacttgagtttcaagattgtcttccctgacccctaatgtttaaatactacagaaggcccctaaaacaaccccaaaaaagtgaacaggatcacttgacatatttaaatatgtgagactgccaaaatgatatttaatcttcctcaagttatatttcagtaaataatattaatgtatgttccaaaaccatataagatgtctaagattctaatgtctaaatatatactgtcaatcataattaaggttattgtgtt

SEQ ID NO: 467199 - DNA, 1269 bp, Homo sapiens
ggcttcttaagcattcacaagattaaagccacctttgccagaggcctggagatggaagcttaacatgacctctaagaactgctccaagaacagtgtgtacctgaccccgcacatgagtgtctgcacctgccccatcaggaaagctacctcggaaatccttgcactcaagaacatacctccatccatagctacgatggccagaatcgggaagccacagccacacagtgccctggacacaggagcccaggaaccactgcacagcgggtggtgcagtataccgggccatcgttctgccaggtcagtcccgcaaccacaaggaagaggaccaggaaagaggttaggggaaggaggcaccccagccatgcaaaggcagaagatattcttagaccatgggtcccaggagctgcacagtgaaggggtgaccaccagctggtctactgataatccccttgctggggcgaaagtctacacggacagttgtgtcatcagccttttcccgctgcacccattcaatgtagatgacatatttctctctgtaaatctggactactttgccaatttgctgacctttatggtgccctcacacaacctgaatatcatcatcctttcagacgggcatggatcaaacgttgtacttctgtctcagctctttggaaagaggggaagacataactgtcctgtgaatgtgggaaggcgcattgaaatgccttttgcagttactacttcggtcagaagtcacaaagggattgaacttcattttggccactcccacttcagtgatggccacaaagggccccactggttattaatgtcttttttcaactcaaacatttaaactatataacctggcatattgtagaagagaactgtgcagcattaaatattagcatctcacactcgcatgaacagaaatattcagattgcaaaaatataccaatttatgaagattaatattaactcactaatttttcaaagactcgcaattatttgatcaatttcaggagaaactattctatttttgcactatgttcatgcaaattgcctaagactcatcagtttctgttattttcaaatatagagtcactgactgattctattaatattctgcctcagtatttaaaaaaaattctcctataataattggaaaagttaacagaagtgattagatttgtcttagagtgtctcttattttgtgaaccttcatgtgaatcttcagtatctcttattttgtgaatcttcatcataatctgaagtattcccattactttt

SEQ ID NO: 467200 - DNA, 1155 bp, Homo sapiens
cggtggatcccgcactggggctgcaggtggagctgcctgccagtcccgcgctgtgcgcccgcactcctcagcccttgggtggtcgatgggactgggcgccctggagcagggggcggagctcgtcggggaggctccggccgcacaggagcccacggagcgggtgggaggctcaggcatggcgggctgcaggttccgagccctgcccctcgggaaggcagctaaggcccagcgagaaatcgagtgcagcgccgggccggccggctgctcggagtgcggggcccgccaagcccacgcccacccggaaatccagctggcccgcaagcgccacgcgcagccccgtgccgccaaagtgggagcccaggcagagcaggcgccgagagcgagcgagggctacgtattggaaattgatttctgtgttggaaatgggataattaaactggttgtttccatcttcatcattgtcatcataaaacgaggacagccggagatatgggataatgatgccatttaatcatttttacaagatataaaattactggctcctctgggaagatcattaaggaaaacaattgttcacagcaattggagatagagttttaattatttaacacagaaattaaactattagagagaccagtgttggatgaggcaacttactagaaatttatatacaagcgtctgtgaacattttagttttattaacccgcctaattccttcatccaaatccgtctgaaaggcctcttggctgtgccttttttagggttacataaatttcacctatgcaatttttttatgcttgaatatattacagaatgccacttctgttatggaagctaattgataatgtgatttgttatgttgccgggacataattcagaaagttattttaaagcctgtgatgcatggaacggcactcaccgtttaatatttctcacatgtgtggacacagcgtagggtaaaaaatgtggtgctgtgtggatgaaatatttccagaagcttttattcttgttgtttgggtgagcgccagcggctccatagaaggaagcccatatttccagcgcagctctgatttgaatttatttcctggtcattagttagctttttttttttcctaaactgaaataagcatgtgtatatatttgaaaaaagaaaaa

SEQ ID NO: 467201 - DNA, 661 bp, Homo sapiens
gacagcagcagtgctagctttctgcacagacttcgggtcgccaagtctaggctgaaaaatgtatcgccttacacccaaaagaaagccctatctcttctgttttttgaagctcagggaggtagcaaccagatggaacagctgtgccttccactctcccagaaggtttttgtgtggacataagttttcagcacatctggccaaataccaaggaatgagattgcacaaggatcttgtgcaacaagagaggccagagctggaattggacccccttgggatctgctgtgggatggaggctggagagcccatatcgaagaatcaggggggcactttgtttcccaacacgtttcagcatagatgggacagttacctgatggcagcaggagctgagaccgggcctccttggaatctgctgttcactgccagaactgatgtcagcaggcaggtgagcctttccaccaagatcctagtatgtacaattcctcctggacctttggaagatggttttggttgtaggctcaaggccaaacagggcttttctgaggatgagttgaatgtaattcttatctttactcctcaataggtaaagtagttttctcctttagattctttcttgtttttctctttgtttttctgatgtttgaatatgaggtgcttggtgtag

SEQ ID NO: 467202 - DNA, 709 bp, Homo sapiens
gaccacgatcagggctattgtgaaattagctaaattagtccgttctctcgacttttggactctctcctctgaatgccttataggtatagtttggcaatctcgctcacacctgggtgtgaacctgcgtgtacccagcccgggagatatcggggtctgtacaggattggtaccccttatgggttagagagaccttctttccttagctccaaggccagatctacgggtgctgaagttctagaagatattttggaccttgatttatctgtctcagaaacagacgattttatccagcttgtaagtggcgaaaagacagtgtttggatccattccactggctcatccatatgggggccagcagggatgtgaatgggagactggtgtagaaagtgctgaggagccgaagccaacaaattgctttaaacacaagatgaaaatgctctgttccatccacacaaagaatcacctaatactggtgtgaggcatctcacttagctgtggaggagtccttggaattagatctcagaaagacagttctggctttaagacagtaaaaccttttggcaatgggccaattgccttgaaaaaaaaaaaaaaccagagttctactttaaagaccttgcaagtggagaattgtcctacaaagattcttggaaatgttaacagagataactgacatgggtaactgggggccaaccaggaactgtcaacag

SEQ ID NO: 467203 - DNA, 972 bp, Homo sapiens
ttctccttgtgaggtgatattctggtacttcacacggaggaacccaagttctgaattcaaacatgcccggctctgacccgcttcctgccgcagctccttggctgggcctccctgctgccctgtatgcttggggcatcccaggctggctccaggctccagaacccaaccggggtctcccgcccgagcagccctgcgtggcctgcgaggaagacagcttgtttaacccgtgcagcctcatctcccggctgatctggcggttaccatggcaacccccaaggctcctcaggcattctcactgactgaccaggcttggaaaaaccattctggaatggacggagaaactgatgctggtcctgtgcttcctgtacacacagtagaagtgttttacaagtcccgcattgcagaggcacagctgagcaacccagttccagatcaggatgcagacatctttggaggaccgttattcgacttcttacaacaatccaaggccatcaccaggttttcagaaaccaagatggcctgcctgtgggaaataatgtggctgttaaaagctgactgggtcttcaaggaagttgtattagtgcatttggggggtcataacaaagtgccagaaattgagtggcataaaacaacagaaattaatggtcttgcagtcctggagagtagaagcctaatcaaggtgtggaaggggaaattccttcggaagtgtcttgtgggggcttgcagacagccgtcttctccctgtgtcatcacgtgggcctccctctgagtgtctgtgtcttattataaagacaccagtcatatgggatcagggccgaccctggtggtctccttttaccttgattacctctttgaataacttttccaaatacagtcacactctgagggactggggttagcacttcaacgtatgaattttggagggcacaattcaattggtaacagaaatgtaggactgagcaaagcaaagac

SEQ ID NO: 467204 - DNA, 551 bp, Homo sapiens
tcctcactcttcaggaaagaattcaggcctgtcctcggaatgctacaaggttcccacgccacccctaatcccgctcgaagcagccctgagaaacatcgcccattatctctccataccatccccccaaattttcgccataccaacactttaccactatttcgttttatttttcttattaatttaagaagacaggaatgtcaggcctctgagcccaagctaagccatcatatcccctgtgacctgcacatacacatccagatggccgactcagcctgcctgcacccaggtgaaataaacagccttgttgctcacacaaagcctgtttggtggtctcttcacacagttgcgcatgaaaagaatcctaaggaatctacaaataacttaccagaattcagtgaatttagcaagatcacaaagtacatagtcaaaatacaacaatcgtttttctataggctagcatgagacaactcaaaaaataaaatctaagattatgctatttaccatagagacaagtatataaaatacttagaaaaatgtttagtcttgaaata

SEQ ID NO: 467205 - DNA, 1020 bp, Homo sapiens
gaaaactaagtttcaaaatacaaaatgcatgctacagatttcattgctggagaggagcggaagaccttctggtgtgggctgggcagcaattcacttgaaggagaaacagcccgggtgtggagaggcggccatccttggcgggatcctttctaaggagccgagaaatcaacgacctataaatggcaccacccagcccaatggacagatgccccaggctgcagattctgtcagtgctgttctcgaagaggcccaggcacatgctgaaacatggaaggtaaaaccagcaagcagctggcatacattccacccagccgtcccccaggagaattgcttgagctccggagttccagaccaacctgggcaacagaacaagggctcatctctactagaaatcaaaaaattagccagccctcgggaaccaccaggagccaggagcacccccggccccccaaggccccaagtccagcctgccccaccccctccggtgcagaggtcctgtgacaccagtggcagccccgccacaccccccaaggccaagggcacaggcagcgtggtcttccccgccccgcccgactacttcctgccgccacagccaccaatgccgcccctggagtacccagagctcccgctgccgtccccggacttcatggagacccccctggacttcgtgctccctcccctcgctgtcgccaagaggcctcctatgccccaccccccccaacaggcacgaagcatcaatgttcacaagcagcaaatgaataaaagttaaacgttcttcctactgcatttctataaggattattggctgatcagctattgctagtgttagtgcatcatatgtgtgtcccagggaagctaaaagattggacaccccttcaggctaaatggaaatttaaaatgaagcaaatttagttttaaaaccaaaatatttactaactaaaactggcaatgtgttcttaatttttttaagcatatgcttgaaataggatagaagcctctccatagaaactttggaatcaa

SEQ ID NO: 467206 - DNA, 542 bp, Homo sapiens
ctcctcaagcacagccagagtgggcgccgaggccgaggaggcgccgagagtgagcgagggctgccagcatgctgtcacctctcaccagcactttgggaggccgaggcagtgactcaccaacttcagtaagccttaaccaaggttatggcttaattgaggttgcacacagaatctccaaagaggtgcagaccagtcctcacaagatccagaaccaccccaaagacagcccaaggaaaggaaagttttgctacctgcaaataggatacaactcacatctgttcagccaaacaggcttaagacggcaagagctcttgttgccacagatggttaaggatggtgtttgtgcatacagtacctcctgtaacccacaaattacagggggactgccaatcacgggcaccttaatctgcgataccagggaggccctcctgaaagtgtactttcccaggactaaccgggcaacaagggttcatatgagaaaagccccattgtaggggtgggttgcccctacacacctgtgggtgtttctcgtaaggtgggac

SEQ ID NO: 467207 - DNA, 5431 bp, Homo sapiens
gacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtttaatagattgtaatgaaaacacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcccgtaagattacaacctcaaaagcaggttaaagaaaataagacccaaccgccagtagcctatcaatactggccgccagctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccaataacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccataaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttacaattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatggaataagccagttaccacaatacaacaattgtccctcaccacaagcggcagtgcagcagtagatttatgtactatacaagcagtctctctgcttccaggggagcccccacaaaaaatccccacaggggtatatggccccctgcctaaggggactgtaggactaatcttgggaagatcaagtctaaatctaaaaggagttcaaattcatactagtgtggttgattcagactataaaggcgaaattcagttggttattagctcttcaattccttggagtgccagtccaggagacaggattgctcaattattactcctgccatatattaagggtggaaatagtgaactaaaaaaaataggagggcttggaagcactgatccaacaggaaaggctgcatattgggcaagtcaggtctcagagaacagacctgtgtgcaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtactgagattttacattgcttagggccagataatcaagaaagtactgttcagccaatgattacttcaattcctcttaatctgtggggtcgagatttattacaacaatggggtgcagaaatcaccatgcccgctccattatatagccccacgagggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcacattgagccttcgttctcaccttggaattctcctgtgtttgtaattcagaagaaatcaggcaaatggcgtatgttaactgacttaagggctgtaaacgccttaattcaacccatggggcctctccaacccgggttgccctctccggccatgatcccaaaagattggcctttaattataattgatctaaaggactgcttttttaccatccctctggcagagcaggattgcgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtaaaagaatattaaccccagaggcaacaaaagaaattaaattagtggaagaaaaaattcagtcagcgcaaataaatagaataggtcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataacaaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaattaccagatgtgaacctttagaaaatgctctaacagtatttactgatggttccagcaatggaaaagcagcttacacaggaccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggttacccactagacatttgaagttctacaatgaacccatcggagatgcaaagaaaagggcctccacggagatggtaacaccagtcacatggatggataatcctatagaagtatatgttaatgatagtgtatgggtacctggccccatagatgatcgctgccctgccaaacctgaggaagaagggatgatgataaatatttccattggggagagcaccaggatgtttaatgcctgcagtccaaaattggttggtagaagtacctactgtcagtcccatcagtagattcacttatcacatgtcagtaaactttgttaatgattggcaaaaaaa

SEQ ID NO: 467208 - DNA, 924 bp, Homo sapiens
acttctcgccatttggctctggaggtggcctgttcagtgggggcaaggggctctttgatgatgaggacgaggaggagacacggatgtgctgcctccgttccatcactgaaggagccacagaagcctgagcagcccactccaaggaaaagcccctatggtccccctcccactggcctgtttgatgatgatgatggtgatgatgataacgactttttctcgacaccccacagcaaaccttccaaaacaggtgtagaaagtaaggatggaagccaaagcacgagggaaaacgatagcctagttaatctagaaagagtgcaaacggatgcagaatgcatgcaggtctcggtgaagatgacagtgaatgaaggcaaagtccaatccactgctgatatctttggtgatgaagaaggagatctgttcaaagaaaaagccgtagcatcgccagaagccacgagagagcccagtggaggccatgttgccttctgtgttccagccttggaagtcaacggtggtccttttgcttcatttgttggtcaagatggtcacaatggcccatccaggttcatggggaggggccataggctccccttcttgatggatttgttttcttctcaaagtgcgagtaacttaaaaggtgcgtctctgctgcctggcaagctccccacgtcggtttccctgtttgatgatgaagatgaagagaagcctcatgggtaacacaaacagttgattaacctataaatagtatagtatctatttatatatttttgtattcctgacatatctagcatttccttatttttttttgatatttctaggctaagtggtttgtctgcaagatttttcaaattgttgcaaatgccaaaaaaaattttcagcatattactgagaaaacatttgtgtagaagtggacctgtgcagctcaaa

SEQ ID NO: 467209 - DNA, 545 bp, Homo sapiens
ataagagggcctatcacctgaggctcacaatgtgtcccttcttccacttcctgttctctacagagacttatttccttgatgttctcttttgccctgcaatattaggagcttcctcaactcctaacagattgcccaagggagcatcctgtggaatggaaatccgtttccacattatctctgtaatgccaatcctgctgatctcagttcagcagcaaactgtaacccctggacactgctggcaagtcataaaaaacagcagtggctggatttggaccatgggctatgatttgccagcccctgacctacacggctgcctgaaatacagcagtagcaccagggcagagaggaaggacaaagaaaacatttcagaggtggaatcagtaaaacttattgatgagtggcgcattaagagcaaaaggcaatttataaataccatatgttggcctacttaaatacagtaaaaaacagtattcacagtaataaacattcttaagcatttaaaccatctgtgaatacttgacatagtatacagcattatttaagct

SEQ ID NO: 467210 - DNA, 607 bp, Homo sapiens
attgcaggcatgagccactgtgcccagcatggaccagaggtcttaattgtatttttgtacccatataccaacctctcttcatccacctctcccagctgtccttctcagactgtggaaagcatccttctactcactgtttccacagatatttcatggacagcaaataatcacatgaaaagatgttcaaaattattaggttttagggaaatgcaaattgaaacaacaataagctatcactactcatctatcagaatggctaaaattaaaaatcatgacaccaccaaatgctgcaatgtaaaggaatggatgattgatgcatgcaacaacttggatggattgccaggaaattatgctgagcaaaaaacatcaatccaaaaaggttacataaatgtgattctacttttataacattttgttaaataacaaaattttagaagtagaggacagatgactatccactgtgtgaatacttggtgttcctgaaaagggaaccaagaagtggaatcagacaaatttaaagagagtattaaagaaaacttccaaagaccaaagaacacccaagtctttagcctaaaacattcatcatgtccaaagctggttgtacgta

SEQ ID NO: 467211 - DNA, 1082 bp, Homo sapiens
accatccataccagaagtcaaacaatttaaaggacccccatatgagccaataacaacagacaatgtcactgtacatgaccagctgtctcacctgtttggcatgtagcatgcagcatatgagaataagtgtctatggtcacatgaacatagctaagcttgccaaagtctgctatatgtgtaacatccattttgccagatttcatttggagcaaacctcgtgggttacagccttctacaggtgcaacaccagggacacgctgacaagagggataggcttgtacaatagctcaagactggctgcaaggcagatgaaacatacgaaaggcacagagaaggcgaatcgaggcttatcctcctcatgtaatggtatagaaaagaaacaatctttaagatccattgctacaagaggccagtctctaggaattgctgctggggatgccaagccctgctgtaatgcacccatcaacttaatgtgtgcattaatagctctcaaatcacgcagcagtcaccatcatctggacttttttgggataacaaagattggttaattccagggactaactgacttctctatatgtcctgcatccaattgttttttcaccaacagatgaagttgacctagcttctgctgtgttaggggccactgatccacccacacaggtttgtcactgagccattctaaagtataatttgaatattaggtcctttgatactgtcccataaatcttgtttatttttttttttttaccaattttttatctttttttcctctaactgaatgttttcaaataacctatctttgcattcaaagattctttcttttgcttcattaattatgctgttgatgttctctctgtgttgcattctccatttcattcatttcattcttctggtccagaatttctttgttttattattatttcaatatctctgttaaatttattatttgagttatttaatgttttccttatctaattgaattgtttctctgtattttttgaagttaactgagcatcattaaaacaagtactttgaattttttgtcaggcagtatgtagatttccatttctttggtgtcagct

SEQ ID NO: 467212 - DNA, 473 bp, Homo sapiens
tccacagaaagataactgggaaaccttcaccatgagaccagtgatgagagtgaagcccacgacaaagcaggcagtgaccaggtggaagctagtcctcaggctcatgatggtggagaataactgtggtgataaaacagcattcacagaaggaaaaactgctgaggaagaaatacataggtgtctggaggtgatggtcagcccaggtgatggtgattatgagcatgtttgccatgatggaggccaggatccaccaggaccaacgggcagactccagacacgccagacatcattaggagatgaacaaagccatctagagaccaatgtccctctaggatccctggtggctgctaattgggcactgttggaaatagaaatttattatacaagtatcatagctaccctttcattatgtgtgcaaatatatttaaggaatgacaaccacaatatataaagaagggttgtatgacttcaac

SEQ ID NO: 467213 - DNA, 721 bp, Homo sapiens
accatcttcaatgtctctttcagcaatatgaagttaaagccagatattgtgattgctgacctgatctggggttctcgtgatggtgctttatgtgaggtgacatgtgaggtgagggcccatgacagggagtccttagctgtgcgggttcagcttcagctgaggaaagaagtctcctggcaggaagagctgcaggagcagggccatgggcaggagtcctcctgggatgaaggaagtgcaaccagcagtgaggtgcgggcggcctgggaaggaggcacaggccagagcagctggggcttgcagaccgtgagaaggagctggaattttactttaggtgcaacagggatctgccggagcattttagtcagagcaggagcagcatctcattggagtttgcagacatgcaggcaattcagtggagaacactatggctgctccggaattagttctattaagaagatgtttcagtgggaacaggtgaagaacaatggtggtcacctggagatggagccctctgagatatgttttgaaggtagaatggagtggatgtggagtgaagagagaggaatcagagatgactgaagttgtaggcttgaaacactgaggtaaagaagtctcagggagaacagttttgggagggcttgtggaagagaggaatcaaagcacttgtttatttatttattagatatttattgagtgcctctcatgtgcagacacctaaaaa

SEQ ID NO: 467214 - DNA, 1659 bp, Homo sapiens
aagttggacgtgtgccttgttttgtgacttctcccgagggagagaaccgcagctcagccctatccaggatgggggcagattacccagcaccaccgccatactccagatgcgggtcaacgaggaagggaccctgaggcctggcagcaggtgcagtcaacaaccttgaagccgtccaaacgggacccgccatccgtgcctgtctgagttgtaggggctgcctgcatttggcgcacaggcaaaatggccaagcaacctcaaactccccacttcccctctgggcccaggcagcgcggactagagacaggtgccgctgctgcacagaaatctgtggatcaactctatgtctgcaccagggcaggaaccggctcctcagccccatcctggcggctgcacagtgcccagacccctcaacccagtgccctgggcgcgagccaaggaagagcagggcttagagagggagggtgtgttccacacggcgaccctctggccttctgggtccagccctgcagccaccaccgtgggctcagctgcagctggcatttgaaggtggcagcagcggtgccaaccctagaacctggtcggacgccgccactgcgcctaagtcaggctttgggccctgggctgcaggagggcgggaacctgcagcaaagcctcatccctgcagctgtacagggcccagaggtcgcgagcctgagctgccagcattggcaaagttaaccccgaaattcctgagccgaagtattagtgaattgtaaacagatgggaccacacaaagagcttgaaaaggaggtgtcaacaggtttccgtgcagagaagaatttaaagtcatatattaaaatgaaaaacaggaacaaaattgtgtgattcaatgcaaatgagtattaaaatgtggctcatatatagtctaggaatatatagtttaaggtcatttacctcatagagatagaggtgctaaattaagtagtattcatagaagaaacggaacgtttatttaagattagttttgcacaaaagaaagcaccatatttatattgtccagaagaaaattttactcatgaactaattaatataccaatactgcttaaactatttaaaagttataaggtaaccaacattcccaatagtttttagaaaggatatataaaagtgatacaactttacttgtttgatgctgtatagaatattatagataataagaacatattatatgaaagtaaaatttttaaatgttaaaaagcattgtgtcaacccattaaaatattagatcattaggaattccatttatgcctgaaatgcaagtgagagtcatcgaattaggaaattcattaacacaataaattatgttaattgaattaatgagactgtcttgtgttcatgttcatagatggaaaacagataatgccaaaatttcctgaacaattattttaaatcaatttgtatggaattgttgcaaaatatttcttgaaaacatcaaaatagatttgtataaatgaaaattatgacattacatgattaggcagggtcaacattattaagacatcaaaggtactttaattaataagctgattttttggttgcatagtattccatggtgtatatgtacctttgcaaggacatggatgaaggtggagaccagtatccttagtaaaggaatgcatt

SEQ ID NO: 467215 - DNA, 622 bp, Homo sapiens
aaactttcgctgctttctccttcacttccacttcctctcacagagcactgactgctctacactgggcctgtgtcaacggccatgcggaagtagtaacatttctggtagacagaaagtgccagcttgacgtcctgatggcgaaaactggacacctctgatgaagcaaaatgttgacatctgtgctgaagatacatgtggaatgactgcagaacgttatgctgttgcttgtggacttaatcggtgtttacatttaaagactagggcgcccccatcccaggactgggggcctgcccaggaagaaggcccagataccggggcccaagatttctgccccgctgccgacccactcttccacctgctgcctttgtcccggggacacccaccacaccccacgctgaaggggcgatcctcccacagctgtcacctcctcctgcagccccagctcaggcagggcacggcgcctcttcttcgcatcttttatgttcaggtcgatggtcctcgtcttcacatcatcccctgcaagcttccaggcgtggccccgggaggcagctctgtgcatctttctgatatccctatagtggatgacttaagagtctttggtggtagaccagctgagtgaagg

SEQ ID NO: 467216 - DNA, 997 bp, Homo sapiens
tttttctccagccacatccttggcctcttccacagtccttagatttttgaaacatgaatccttcactcctcctggctgcctttttcctgggaattgcctcagctgctctaacacgtgaccacagtttagacgcacaatggaccaagtggaaggcaaagcacaagagattatatgacatgaccaatgaagaattcaggcaggtgatgaatggttttcaacaccagaagcacaggaaggggaaacagttccaggaacgcctgcttcttgagatccccacatctgtggactggagagagaaaggctacatgactcctatgaaggatcagggtcagtgtggctcttgttgggcttttagtgcaactggtgctctggaagggcagatgttctggaaaacaggcaaacttatctcactgaatgagcagaatctggtagactgctctgggcctcaaggcaatgagggctgcaatggtggcttcatggataatcccttccggtatgttcaggagaacggaggcctggactctgaggcatcctatccatatgaaggaaaggttaaaacctgtaggtacaatcccaagtattctgctgctaatgacactggctttgtggacatcccttcacgggagaaggacttggcgaaggcagtggcaactgtggggcccatctctgttgctgttggtgcaagccatgtctccttccagttctataaaaaaggaatttattttgagccacgctgtgaccctgaaggcctggatcatgctatgctggtagttggctacagctatgaaggagcagactcagataacaataaatattggctggtgaagaacagctggggtaaaaactggggcatggatggctacataaagatggccaaagaccggaggaacagctgtggaattgccacagcagccagctaccccactgtgtgagctgatggttggtgatgaggaagaacttgactgaggatggcacatccaaaggaggaatttatctt

SEQ ID NO: 467217 - DNA, 529 bp, Homo sapiens
aataataaagatgaacataaacacctgtgcaattcagtgtttaaagtttgccaaggtatatgtatatatttttcccaacgttgatgctgtgagaagcccaagccatggagaggccccaggcaggtgctctggtcaacagcccaagctaaatgcccagccaacaccagcatctgcaaccagccctgtgcgtgaggctttgcagatgtctagtctcgtcaagccctgcagatgtctagtcccgtcaagccctacagatgtctccagcacagatagagcctacagatgtctccccgcgaaaccacacagccaagtccaggcggaaaatgtgaaagatgtttctaccaagccactgagtttctgggtggtttgttttacagtaatagaggagaaccagaatgtgactggctgctctggttgatattgtctttcccttcctcccggaaaccctccctcattacctccctttccctaacagttccagctccttgaggacccaaagacaaacagccttgccaacgcactagtgcct

SEQ ID NO: 467218 - DNA, 789 bp, Homo sapiens
ttcccttgctcacctggacctgaagtgatgggggaggtattcccaatctggttcactctgcaaatgagggatacaagcttgtttatttctgattggctgatgcaagtcacagtctatttcttaagtccatatgatgaaatgggtacaggtagcagttgtgttgctggtgggctggttcaggttcttgactttgctgcacaaaagaagtcttactttgagagtgagtccaatgtaaaagtaagcaagagaggttactgcaaagtgaatgtacactctgacagccgatcagagtgggctgctgaaaggaatcttcaggcacaagggcctgaatctgacttctcgtggaaagcattgggcagagcttcacagtcccgcctagagctgggctgtaattcaagggacaaagtggaggagcaacaaggaagttgtggggagcaacctttagaacctgggcctggggagggcaggccaaggaagcctgagtttacacgggctcaggtcctggggcagaagccagacacagagcctgggcagccagattcgctccggcctgggttgtggactcacccgaggatttgtgggccttgctccttaccgggagtcgccttctggccttatcttcctcgtggtgaatcctcccgccaataaaatgtgccaacatcacttcctttaatgttctaatagccacttccctgtggtacaaatggattcctggtggttcttgctgccccctcatgtcctgccctaacataatgagggtatgttgcactagttgtattgtgtttcatt

SEQ ID NO: 467219 - DNA, 1866 bp, Homo sapiens
ggacagtgggtgcaggacagtgggtgcagcacaccgagcgtgagccgaagcaggacgaggcatcacctcacccgggaagtgcaaggggtcagggaattccctttactagtcaaagaaaggggtgacagatggcacctggaagatcaggtcactcccaccctaatactgtgcttttccagtggtcttagcaaacggcacaccaggagattatgtcccgtgcatggcccagagggtcctatgcccacggagcctcgctcattgctagcacggcagtctgagatcaaactacaaggcagcagtgaggctgggggaggggcggccgcaatcgctgaggcttgagtaggtaaacaaagcagccaggaagctcaaactgggtggatcccaccacagctcaaggaggcctgcctgtctctgtagactccacctctgggggcacggcatagcgaaacaaaaggcagcagaaacctctgcagacttaagtgtccctgtctgacagctttgaagagaatagtggttctcccagcacacagcttgagatctgagaatggatagactgcctcctcaagtgggtccctgacccccgagtagcctaactgggaggcaccccccagtaggggcagactgacacctcacatggccgggtactcctctgagacaaaacttccagaggaacgatcacgcagcaacatttgctgttcaccagtatctgctgttctgcagactccgctgctgatacccaggcaaacagggtctggagtggacctccagcaaactccaacagacctgcagctgagggtcctgactgttagaagggaaactaacaaacagaaaggacatccacacaaaactccatctgtacatcaccatcatcaaagaccaaagtcacctgacaggtcacaaacatgtcagacaaaagtgaattaaaggctgagttggaacgtaagaagcagcaactggcccaaatcagagaggaaaagaagagaaaagaagaagaaaggaaaaaaaaagaaacagatcagaagaaggaagctgttgctcctgtgcaagaagaatcagatcttgaaaaaagaagaagagaagctgaagcattgctccaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaaaaagatgaagaggaagatgatgatctgactgaagaagaaaagcaacaaatcttgcactctgaggaatttttaagtttctttgaccattctacaagaattgtagaaagagctctttctgagcagattaacatcttctttcactatagtgggagagatttggaagacaaagaaggagagattcaagcaggtgctaaactgtcattaaattgacaattttttgacgaacgttggtcaaagcatcgggttgttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaactgtgctttgggataaccgtagcaataaaagaactccagtgcaaagaactccactgtcagcag

SEQ ID NO: 467220 - DNA, 1577 bp, Homo sapiens
gatcatggcgtgaagtccacgttgacgacgttatcagtacttggggagatgatgaaggccacggaccttaggcactctcccttgaaccccactgaggaacttcttgtcaaagtgggaccacatctctctgagatagttgtgcctgatatgccgggatatgtccttgatggccaagaggatgtggttgaaagcatggtggtgcagcttctcatggagcttgggctcctggtgctcactcctcttcaccttcagccactgcaccagggacttgatggtcaggccccggaaaatgactgtgaagaagacgatgacggtggtgctgacaaacaggttcttctccttgaccttgtttctgtccggaagcacgaccacgatgaaggccatggccccatgcaggcctctataggacatgaccacctggtctatgatctccagctgcatcatccaatagcagtacaggagtcaggactggatgacactatggctcggtacatgaaggtgaaggctaatgagcaggttcatggccgagatgcccagggatatgaagatggtattggtgccactggccagcatcttcatggtgtagtgcatggtggtggccgactgctccgagatgttgactttcatgtacttatgacagcagatgccacagaagatgatggccaggacggccgacagcaacagtacgatgatgaacaggacctcattgacatgaacctcctcaaacacaaccaggatggctgctgggtccacagtggtgatcaggctgcccaacaggaggaagtccagcagccctatctgcaggttgcccatgagcctactaagggaaatgacatagagggacagtatggtggtggctgcattgcacatggtgctgatgacctggtacagcaggatggtgcccagtttgccaaagaagagccagttgggcatgaagatgcagatcacaatcatgtactggtcctggacattggcccattcaaaggcggccacgtgggagccctgactcacatcatgtacactactgtgctcctcctcgacaccccctcacccatagcagccacccagcaccagtgccactgctatcagcagcccccggcagcaacatctctttgccaagataaacgccttctgtttgaaaaggatgattttcaaaagggccagaacctccttcctggttctaaaggaagtttgggccagggccccttgagctttggagaaggcatgaaagcattacactatgtgaaagaagccaaccacaaaaggccacacagtatatgatttcactaagagggaatgtgcagaaaaaggcacatctgtagagtcagaaagcagattggtggttgcctagggctgggggtgggaatggaagattgcctgcaaacaggcaagagaaatgttttcagggtaatagaaatgttctaaaactggcttgtgctgacggtttcccaaatctatagatttactgatctaactgtatatttatcatcctggcaaacactacactttttaccgtctccatagttttaccttttccagaacatctcatgtgaactcagagtgagaactcattcatt

SEQ ID NO: 467221 - DNA, 2530 bp, Homo sapiens
ctctacctgggcagcttcctattggggatgctgctgttttaccgcttctgggcgctctttggcttgtacagcttggctgccttcttgttctggttgatcccgagcttgctcaacttgaaggactccaggtgcttcctcatggacctgtcgaagatttcctgctcctgcttctcgtcctcagttggtgtggctgtagcgatgcatgtactccttccccggcttgcacaggtactgctgcagcgtgtggtgcgtgaccgggtcctcccgataccgaacgtctgccacgttcagggactgaacgtccagacagatggcactgatgctctccctcagaagaaccccactgaggaacttcttgtcaaagtgggaccacatctctctgagatagttgtgcctgatatgccgggatatgtccttgatggccaagaggatgtggttgaaagcatggtggtgcagcttctcatggagcttgggctcctggtgctcactcctcttcaccttcagccactgcaccagggacttgatggtcaggccccggaaaatgactgtgaagaagacgatgacggtggtgctgacaaacaggttcttctccttgaccttgtttctgtccggaagcacgaccacgatgaaggccatggccccatgcaggcctctataggacatgaccacctggtctatgatctccagctgcatcatccaatagcagtacaggagtcaggactggatgacactatggctcggtacatgaagggatatgaagatggtattggtgccactggccagcatcttcatggtgtagtgcatggtggtggccgactgctccgagatgttgactttcatgtacttatgacagcagatgccacagaagatgatggccaggacggccgacagcaacagtacgatgatgaacaggacctcattgacatgaacctcctcaaacacaaccaggatggctgctgggtccacagtggtgatcaggctgcccaacaggaggaagtccagcagccctatctgcaggttgcccatgagcctactaagggaaatgacatagagggacagtatggtggtggctgcattgcacatggtgctgatgacctggtacagcaggatggtgcccagtttgccaaagaagagccagttgggcatgaagctgaccacaaggatgcagatcacaatcatgtactggtcctggacattggcccattcaaaggcggccacgtgggagccctgactcacatcatgtacactactgtgctcctcctcgacaccccctcacccatagcagccacccagcaccagtgccactgctatcagcagcccccggcagcaacatctgtgatgctcccccactcaaccctaggcaaccactaatccattttctatctccaaattggtcttttctggacatttcacataaatagaatcatatgtgatttttttgtgactggcttctttcacttagcataatgttttcaaagttcatcatgttctaggatatatcagtacttcattcctttttattgctgaataatagtcccttgtagcaatatatctcatgttgtttatccatccatcagttgatgagcatttgagtcatttccaattttgggctgttacatataatgctaagatgaacattcaactgcaagtttttgtgtaaacatatgttttcctttctctttgaagtagctttgctaggttatgtggtaactcttatgtttagcaaattgtggcactaccaaacttttctaaatggtatggatcattttatagtcccatcaacaatgaatgaggttgccaatttctccacacccttgccaatacttctttctgtctttttgattaaagctatcctagtgggtgtgaagtagtatctcattgtgattgtgatttccatttctttaaaaactaatggtatggagcatcattttaatgtgattattggccatttgcatacattctttggagaaatgcctattcacatattttgtctatttttaattggattttttattgagttgtatgagtttttttattacatattctagatagaaacactaacggatatataaatggcaaatattttctctcagtttgcgggttgtcttttaactttcttgatggcatcttttgagacacaaaagtttttaattttggtaaagtctaatttggctatttttcttttgtcgtacttcaaaagcttggcctatcccaagtagtaaagattgacatatatttttctaagaattgtatagttttagctcttatatttaggtgtattgtccaatttcaatttagttttgtgtatggtgagagttagggtctaactttattcttttgcatgtggataaacagttgttccagtatcatttgtcagaaaaatcattctttcccaattgaattgtcttggatcctggttaaaaatccattttttgtaaatgtgaaggtttatttccagactctttatgctagtgatctacctatgccagtaccaccctatcttaattactgcagctttgtagtaagttcc

SEQ ID NO: 467222 - DNA, 1352 bp, Homo sapiens
gtgtctgaaatttgcaagtctttctcctgaatggtgaaattgtgcacggggctctacctgggcagcttcctattggggatgctgctgttttaccgcttctgggcgctctttggcttgtacagcttggctgccttcttgttctggttgatcctgagcttgctcaacttgaaggactccaggtgcttcctcatggacctgtggaagatttcccggtcccgcttcttgtcctcagttggtgtggctgtagcgatgcatgtactccttccccggcttgcacaggtactgctgcagcgtgtggttcagctcatggaagacattgaggatcccatatggagacttctgggccagcattctcatgagaaccccactgaggaacttcctgtcaaagtgggaccacatctctctgagatagttgtgcctgatatgccgggatatgtccttgatggccaagaggatgtggttgaaagcatggtggtgcagcttctcatggagcttgggctcctggtgctcactcctcttcaccttcagccactgcaccagggacttgatggtcagcccctggaaaatgactgtgaagaagatgatgacggtggtgctgacaaacaggttcttctccttgaccttgtttctgtccggaagcatgaccaggatgaaggccatggccccatgcaggcctctataggacatgaccacctggaggatgaaggccatgttccacgtccagatgagcaggttcatgaccgagatgcccagggatatgaagattgtattgacaccactggccagcatcttcacggtgtagtgcatggtgttggccgactgctccaagatgttggccttcatgtacttatgacagcagatgccacagaagataatggccaggatggccaacagcaacagcttctcagacatgatgatgaacaggacctcattgacatgaacttcctcaaacccaaccagtatggctgctgggtccacagtggtgatcaggctgccgaacaggaggaagtccagcagccctatctgcaggttgcccatgagcctgctaagagagatgccatagaggaacaggatggtggtggctgcattgcacacagtgctgatgacctggtacagcaggatggtgcccagattgccaaagaagagccggttgggcatgaagtagtcggcatctgcatgatgggggacgtcaacatgaaggaccacggtgatgccttgtgggacaggtagaaccaatcttggccagcctgaccacaaggatgcagatcgcaatcagggcagcaccaagacattcatgaggatccacccccatgacccaaacacctcccactaggcccacttccgatactggc

SEQ ID NO: 467223 - DNA, 598 bp, Homo sapiens
caaattcttatgttacccctatatcttcccattgtgatggtattaggaggtggtgcatttgggagggaagagcctgtcttagtcaacttgggctgcgataacaaaataccattgactgggtggcttaaacaacagaaaagtgtttctcacagctttggaggcaagttcaagaacagtacaaacatggtcaggttttacaaaagatcttcaaaatggagcagtgtgaagaagaggcgagaacgacccccaattgaccaaagcctatgcgccctgcatctctgcaatcagtgcctatgttccgccaccatggttaccaagcccaagagaagggttgaaggggatgttaaaggagataaagccatggtgaaggacaaacctcagagaagatctgaaaggttgtctgctaaacctgctcctccaaagccagagcccaagcctaaaagtgccctgtaaagaagggagagaaggtcaggtctatgtcccgctactgcatgtactgcattacctaggggtgtcagcctgcttccctatctgcaaatgaataaaacagtatccatcctagagtggttgtagacaagcactgggttgtatgtaaagc

SEQ ID NO: 467224 - DNA, 1028 bp, Homo sapiens
aaactgggctcaaggcttcaaccggcagacaaggagattctctcccatgcatggctcggtgggtcccacgcccacagagccttgttcactgctagcacagcagtctgagatcagcctgctaggctgcagccaggcagggggagggggcgtagccattgctgaggcttgagtaggtaaacaaagcagccgggaagctcaagctgggtagagcccaccacagctcaacaaggcctactgcctctacactccacctctgtgggcagggcatagctgaacaaaagccagcagacaacttctgcagacttaaacgtccctgtctgacagctctgaagagagcagtggttctcccagcacagcatttgagctctaagaatggaagactgcctcctcaagagggtctctgacccccgtgtagcctaactggggacacctcccagtaggggccgacagacacctcctataggcggctgcccctctgggatgaagcttccagaggaaggatcaggcagcaatatttgctgttctgcaatatttgctgttctgcagcctccactggtgatacccaggcaaacaggcatcaacatcaacaaaaaggtcatctacaccaaaacctcatctgtaggtcaccaacatcaaagaccaaaggtagacaaaaccacaaagatggggagaaaccagagcagaaaagctgaaaaatacaaaaatcagagtgcctcttctcctacaaaggatcgcagctccttgcccgcaacggaacacagctggatggagaatgactttgacaagttgacagaagtaggcttcagaagaacaaacagtgtagagaagaccttaaatgacttgatggagctgaaaaccatggcacaagaacttcatgatgcatgcacaagcttcaatagccgattcaatcaagtggaagaaagggtatcagtgatttaagatcaaattaatgaaataaagcaagaagacaaggttagagaaaaaaagaataaaatgaaatgaacaaagcctccaagaaatatgggact

SEQ ID NO: 467225 - DNA, 1841 bp, Homo sapiens
cctttccctgagcatactggttacccagtgggtcctaggctattctggaagccatctgactctattttgagaggtgacagcgtgctggcagccctcgcttgctctcggcgcctcctcggccttggcgcccactctggccgtgcttgaggagcccttcagcctgccgctgcactatgggagcccctctctgggctggctgaggtcagagccggctccctctgcttgcagtgaggtgtggagggagagtgggagggaaccggggccagcacaagttctgagtgggcgtgggctcggtggccccgcactctgagtggccggctggtgccaccggccctgggcagtgaggggcttagcacccgggccagcagctgcagagggtgtaccgggtcccctagtggtgccggcccgcgggtgctgtgctcgaattctcgccaggccttagctgtctccccgcggggcagggctcgggacctgcagcctgccatgcccgagccttaccccgcggccgtgggctcctgggcagcccaagcctccctgatgagcactgccccctgctctgcggcacctggtgccatagaccgcccaagggctgaggggtacaggcccatggcgcgggactggcaggcagctctgacagcggcacccgtacaggatccactaggtgaagccagcttcactcctgagccagcgaaaccacgagcccaccagaaggaagaaactctagatgtctccaaacatcagaaggaaaaaactctggacacgctgcctttaagaactgtaacacttaccgcgagggtctatggcttcattcttgaagtcaggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccaggtctgcctgaagctagggacacacaggctaaagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaaggggcaggtccagagcagggcccacaagggggattagagtggcctggcccctccccctctacctcagtagcccccaggcctgagatggctgagaagggaagggtatccttttcccacagttctgggacaaataaa

SEQ ID NO: 467226 - DNA, 1016 bp, Homo sapiens
gaaaaccactttatcacgggcttcactggagccctcaagagaaacttctggctaacattcgttgagagaccaaactctgcagaagtcaaggacggaagatgtgggagtctggagggtgtgtggccaagagacccaggcctgctgacatttcagaccaccccatgctgctcagtcaggataaaaccctgcagcaggcatgtgcatgtttgatgaaaggaaaagaagaaaaagaggtagtcatactagatgatcctttaatgcaaaacccccgggttcagcggggagttttgggtggagcagaacttccttccatcagctgtgaaggttcagatgtgtcagtcctttctcccttcagtccacctgaaagttctattgagaacccttcgtcctctcctccttacaagtctagtcccattctatacccaccactccctgaggaacttagcccagtgaggactactcatagcggagcctcccatcaacctccaaagggaaatctttgtccacttagagaggtggcaaatggggaagaatgcactgtgagagtacatgtccccttttctatgtctgatttggttctatgtaaagagaagtttggtcatttctctgaagatccaggaaaattcatagatgagtttaagaagttaactctgacctatagtttaacttggcaggatcttcttgttgtgttgtctctgtgttgtacagtgaaagacaatcaacacattctggggacagctaggacccatggagatgaggtattggctcacaacccaaaccataatatatatcaggcaggaggtatagcagttccagatcaagatccagagtggaactactgtaaggtacatggatgtgctttggtcaacaataggctgaggcggacatctgggccaaagtaactcagcaagtttagggtgcaggcgcatactccgcttgttatataacctgtttgtgtaagttcatacttgccttggagccactattgtctgtgaaaggtgtaactgccctgttaa

SEQ ID NO: 467227 - DNA, 1055 bp, Homo sapiens
gctggggcagccctggtcaccgagcctagctttcacgggtttattgtcctctggtgccccggggcaggctcgatcgggcaaggagagtcccaagcaggcgttgagcgggatgaatgggcgtgaagaccctcagtctccccttgtatgcaggcagggaggaacagggagggccagactcccagactgtgtgcaaagcggctgccctgccctggtgctcagctcagggtgcagactcctggagggatgacgatgacaaggatgacgatgatgccggtgcacacaggacgcagggaccgcggcggccatcacagcactgcaccttggaggtgggaaacctggcagggcctgcacattccacgacgggggcagtgaagcccagtgactggggaaatcacagtgggaaccgcctggaggacgcgccacaagctgatggcaaggcagacgcttggcctgtgaaccccatgtcctctgtaactgtgctagtgcgggtgcctgtcatccacacaaggctcagcctcataggctccacgccagcagggaccatcaccgcctccatcagggtccacatttcccccacgtcgcggggcctctgctggcacccagccttctatgctcctgccacgagcacggcctccttggaggatgggagccacagacagggccagatgacgaggagagaaggcacctgctacccacctgcttaccgcggggcccacggcgcggtgtgcggcacctgccacgggccgtcccgccctggtcttcgctgtgtcttctccacctgggaaagctccagcttcaaccctggggctcaaagccagaaggctcctgcccctacaccctcctatgagcctcctccgggccctatttagcaaatggttatgcaggtacattcatgcataaagactcggttctctaagtccctgctctagaaagaagtcatcgtgtccccctctcgcagccgccgcgtctgtttgtaagccctgcaggggccactccggaacgaccccccgggccccgccccgcggccacgcggggacgcgatgctaggaggtgtc

SEQ ID NO: 467228 - DNA, 3586 bp, Homo sapiens
gagggtacacatgctgtcggctggcggagcacacacatgcacgcacgcaggcacacatgcacgtcgcatgtgctctgggtggattttggtcactttgagcacggcgtcacggctcattctggggtctgtctctgcaacttcaaggatagctgtgggcacctgggggagggacagagtcaactgctcagcaatagcagagcccagggccaataggaccccctggggctcgcccacactgtgccgagaggcctgcactgggcactggctctggaaaggcaccgtcagggccacaccagctccagaagatgggaagatctgtattgtacggctgggtgcagtggtgtcggtggaagaggactcacccactgccccagggatgcctggctttgccctgaagtctgttgcaggcatgaacttggctgcgctggaagaagtcccttctctaactgcagctgtgctgtgggccctcggggatgggcctgccgggcatcgctgccctcgggagtgcatctcatgggtgcacctggcaggggtggggacagaggcagtgactggggaaatataccaaagaggtaacggatttatctccggtgggggtgattatgggtaattctaatgttcttttcagatttttttacattttcttaataatatgcgggcggcccaggttagcaaattcaaaagatcaaagttagaacaacaaatccattttcagcatacgtgtgctccatgcaaatttgggacagacgtatactaagcaatgatacattgctgatctgaattcatcttagctggggatcccgagttttatctggcagcctgcctccctgctccccaccaccttggctcccaccagctaggagccttgtaatctctggatgccaaacttcagccaatgggccacatccagtggagaagggacctgggggcacccagtcaatgggccacatccagtggagaagggacctgtgggcacccagtcaatgggccacatccagtggagaaggggcctgggggcacgcagccaatgggccacatccagtgaaggggcctgggggcacgcagccaatgggccacatccagtggagaaggggcctgggggcactcagccaatgggccacatcaagtggagaaggggcctgggggcactcagccaatgggccacatccagtggagaaggagcctgggggcacccagtcaatgggccacatccagtggagaaggcgcctgggggcactcagccaatgggccacatccagtggagaaggggcctgggggcacccagtcaatgggccacatccagtggagaaggggcctgagggcacccagccaatgggccacatccagtggagaaggtgcctggaggcacccagtcaatgggccacatccagtggagaaggggcctgagggcacccagccaatgggccacatccagtggagaagggaccttggggcacccagtcaatgggccccatccagtggagaaggggcctgagggcacccagccaatgggccacatccagtggagaaggcacctgggggcacccagccaatgggccacatccagtggagaaggggcctgagggcacgcagggaggctgtggcagtgggcagaggggcgtagcggtgtctggggtaggcaggattctccagggaaacagaaccattgggatgtgtgtacaaacagtgtacatatagggtatatacagtgtacatagaggtcatataccatgtacatattgggtatctacaatgtacatatagcgtatataccatgtacatcatatagggtatatactatgtacatgtagagtatatacagtgtacgtgtaggacatataccacatacatatagggcatatgctgtgtacatatagggtatatcccgtgtacatagaggtcatataccatgtacatattgggtatctacaatgtacatatagggtatataccatgtacatcatatagggtatatactatgtacatgtagagtatatacagtgtacgtgtaggacatatagcacatacatatagggcatatgctgtgtacatatagggtatatcccgtgtacatataggccatatgccatgtgcatataggacatataccgtggacatatagggcatataccatgtacatatagggtatatattgatattgtgtacatatatagaatattcatagtgtgagtgtgcatatagtacacacatatacagcatatatacagtgtgtgcatatagagtatatatagtgtgtgtgtgtaaagttatagtgtgtgtatatagtgtatgcatatggactatactgtgtgtgtatagtgtatatgtagcatgcatacagagtatatatagtgtatgtacacatataatgtgtatatattatagagatagcatatgtatacatagtgtgcatatagtgtacattaatatagagtatgcatatatttgtgtaatatagtgtgcatatagatatatacagtgtatgtatagtgtatatatagtatacatatatagagattatatacagtgtgcatagtgtatatggtctgtgcatattgcatacctatatattctatacacagtgtatgtatgtgtatacatagtgtgtatatgtagtatacatgtagtgtgtgtatatatatataaaatgtaaatatatacatagggagagcgtgcaagagagatttattttaaagaattggcttatgtgtttgtggcagctgctcatctgacacctgagggccgctggagacccagggacactcctgctgcggctcatgtttggaagctgtccggaggcgggacttcctcttcctccaggggccgccgtccggaggcgggacttcctcttcctcggggacaactgtctttttctcttaaggccttggactgcctggatgaggctataatatggtcagtactctgctctacccaaagtctcctgattgaaatattaacctcatccaagaaacaccctcacagcgacgtctacactggtgtttgaccaaatagctggggaccgtggcctggtcgagctgacacaaaagtaaccatcacagctgctgctatggtctgaatgttgatgtcacccccagattcatttgttagaacttaagccccaaggcgatggcatcactggtgggctttgggagatgaggaggatatgaatgggaccagtagcctcataagagttttgagggtcctggttgcccttccccaccctcccgtccctgccactgggtgaggacacagcaagaagccgccgtcctgggagcagagagcagaaagcagccctcaccagacgctgaatctgctggggcctcggtcctggacgtcccagcctccagaactgagcgatgaaattctggttacaaattgccccctctgaggtattttgttttagcagaaggaacagacgaggatgaccaccgaggcccttctcaggctgccgcgggtctccaggatggggacagtcagctggggccaaccgagctgcatgtggtcaagggcccatgcatgtgaccagggcccgcctcccacgtcacccagtgcaccctcagcatgggacacggacctagacactgcc

SEQ ID NO: 467229 - DNA, 464 bp, Homo sapiens
ccagggccactgcctgggggccatgccgagagcctgcctcttacagactacagagctgggggtgggggctgtgagctgccgtgcacagcacttgcaaagggcatctgtgccccacttcactctccacagacccagccgcgggggaggcagaccctgctctgcaggaggccagagcccctggaaaagcctagaagccaccaaggcgcgagcagagtccaccatggcagtgcttgcaggtcactcatggtgccagcagagacctgccctccgagctggggtcctgtgcagcaggtaccttcccaagcaggggggaccctccgaggagcaggcactctctgagcaggcacagctggcgggggcaggggtgtccctggaggcagtggctttcagtccggtcaggacagtcctgggcatgggccccagcagtgctcacagctcccagcaggaaagctgctgaagcagcc

SEQ ID NO: 467230 - DNA, 1032 bp, Homo sapiens
ccggagacacaggaaggttaagaaacagccggggcacaatgcaggctcctattcttaacctcaaggctttctatgtagcacgtcctcacgggaccacagaacgagagggagctgggggtgtggtggaggagtggcaagtgacagggcagaaacagctgctcgaggaggccccgtgttctcctgggggacctgacttggtcaagcttggaggatgtggggcctgcctgtgcgtgccccatgggcagagagggcgggcgcggttcgtgctggactctagatgtgcagctccaagtgagatgtgggtagatgccattgggattttggcggtgcagccctgcacagcccttctagccctctcaggtctttcttttgtccaaactcttatcttctcttgggtccccagggtcaccaacctctttgcagaaaatccctctgcagccactgaccccacacccccagcccccatgccctcactgcacacgttctcagcccccatgtcctcagcttccaatccctaaaccccacgtcctgaaacccacaccctcagcctccacccccaagaccctacaccctctgactgcgcactcccagaacctgcacctgaccccacaccccctgaccccacccccccgaccccacaccccctgaccctacaccccctgaccccacaccccctgaccccacacccctgaccccacatcctctgcatactcccagaacccacacctgaccccacaccccagaccctacatcctctgtgcactcccagaacctgcacctgaccccacccccccgacctcacaccccctgaccctacatcctctgagtgcgcactcccagaacccgcacctgacccccacaccccctgacaccaccccacagcccccatcttcagcctctcctctgctgtagtccccagcccctggctggcttgcttctcagcacagccctggcccagaagcaggaggacactgtcagcccctccttgctggggggagagtggttggggcacacctgtcccctgcccctctg

SEQ ID NO: 467231 - DNA, 633 bp, Homo sapiens
ctcagaagcatcagggtaacaatgggacaagtgtgggctgtggttcgttctaccttggaactttttcacactgataatgaggaggaaggagagtataacaaagtaacagtagaggttacagaccaggtttatttgccacctaaagctaaagcagaaaaggagggagaggttcatccctacccttctgcaccccctcattattattttgaagaaaacgaccctccagatctttcttttctggaggacactggagggaaagcacatttagttgattataacaaggcctgtgatgatatcagagatactttgttggcacaggcgatggcaggactgagagtggataaaggaaatactctatttcctggagcttgttttaactgtgggaagcatggtcatactaaaaagaatgtaaaaaaagaaatcagcaagtcaggccaccagataggtgaaaaaagaaaactgctgatcctgaaatatgtctaaaatgtaaaaaaggaaaactttgggctaatcagtgtcactctaagtttgataaagaagggaacccgattttgggaaactccctgatgggcccatcccaggccctgttctaaaccagggcatttccagctcaggccattccctcacctccat

SEQ ID NO: 467232 - DNA, 5210 bp, Homo sapiens
tggaatcaacccgaatgggttggaatgaaacggaatggaatgatatggaatcaaccggagtgtaattggaatggaatggaatggaatggaatggaatggaatggaatggaatggaatggaatagcatgcaatcaaagttggtggaatggtatggaatggtatggaatggaatggaataaaaaggcctggaatggaatggaatcaacccgagaggaatggaatggaatggaatggaatggaatggaaatgaagcaaaccgagtggaatggaatggtatggaatggaatggaatggaatggaatggaatggaaacaatgcaatgcaatggtatcaacgggaatggaatgcattggaatggaatggaatggaatcaccctgaaatcaacccaagtggaatggaatgcaatggaatggaagggaatcatcacgagtggaatggaatggaaaggaatgcaatggaatggaatggaatggaatggaatcaacacgagtggagtagaatggaatggaatggaatcaaccgtggtggaatggaatggaatggaatgcaatagaatggaatggaatggaatacaatggaatcaacccgcgtggaatagaatggtatggaatgcaatggaacggagtggaacagaacgtggaattgaatggaagggaatgcattggaaaggaatggaaaggattcaacacaaatggaatggaatggaatggaatggaatacaatggaaaggaatggaatgcaatggaatggaatggaatggaatgaaatggaataaacccgaatggaatggaatggaatggaatggaatggaatggaatggaatgaattggaataaacccgaatggaatggaatggaatggaatttaatggtgtggaatggaataaacaccaaatggaatggaatggaatggaatggaatggaaaggaatggattcaactggaatggaatgaaatggaatggaatggagtggaatggaatggaatgcattggaatcaacaagagtgaaatgcaatggaaaggaatggaatggaatggaatggaatggaatggaatagaatggaatcaacccgagtggagtgaaataaattggaatggaatggaatggaatcaacctgagtggaacggaatggaatggaatggaatggaacggaatggaatgcaatggaatcaactggaatggaatggaatggaatggaatggaatggaacggaatcaacctgagtcaaatagaatggaatggaatggaatggaatggaatggaatggaaactactggaatggaatggaaacaacccaagtggaagggaatgcaatggaatggaatggagtggaatggaatggaatggaatggaatcaacacgagtggactgcaacggaatgaaatggaatggaatgcaatggaatggaatggaatggaatggaatggaatggaacggaacggaacggaattgaatggaatggaatcaacagaagtggaaatggaatggtatagaatgcaacgtaatggaacggaatggaatggaataaaatggaatggaatggaatggaaacaacccgagtggaatggaatggaatggaatgcatggaatggaatggaatggaatggaatggaatggaatggaatggaatggaatcaaccccagttgaatggaatggaatggaatgtaacggaatataatggaatggaacggaatcatcccaagtggaatggaatggtacggaatgcaacagaatggaatggaacagaacggaatgaaatggaatggaatagattgaatgcgagtggaatggaatggaatggaatggattggaatggaatggaatggattggagtggaatggaatggaatcaacacgaatgggatggaacggaatggaatggaatggaatggaatggaatggaatggaaaggaatggaatggaaaggaacagaatggaatcaacacgattggaatggaatggaatggaatggaatccacccgagtggaatggaatggaatggaatgcaatggaattgaacggaatataatggaattaaatggaatcatcccgagtggaatgcaatgtggaattgaatggaatggaatggattggaaaagaatggaatggattggaatggattggaatggaaaggaatggattcaacccgagtggaatgtaatggattggaatggaatggaatggaatggaatcaacacgaatggaatggaacggaatggaatggaatggaatggaatgaatggaatggaatggaatcaaccccagtggaatggaatggaatggaatgcaatagaatggaaagtaatggaatggaatggaattcaatggaatcaacccgagtggaaaggaatggtatggaatgcaatggaatggagtggaatagaatggaatcaacgagagttgaatggaatggaatggaatggaacggaatataatggaatggaacggaatcatcccgagtggaatggaatggtgtggaatgcaatagaatggaatggaacagaacggaatgaaatggaatggaatagattgaatgctagtggaattgaatggaatggaatggattggaatggaatggaatggatcggagtggaatggaatggaatcaacacgaatggaatggagcggaatagaatggaatggaatggaatggaatggaatggaatggaaaggaatggaatcaatccgggtggaatggaatggaattggaatggagtggaatggaatggaatgcaatggaatcaacacgaatggaatggaacggaatggaatggaatggaatggaatggaatggaatggaaaggaatggaatgcaacggaatagaatggaatcaacccgaatgggttggaaggaaatggaatggaatgaaatggaatggaatgatatggaatcaaccggattgtaatgtaaatgaatggaatggaatggaatggaatggaatggaatgctatggaatcaacccgagtggaatggaatggaatggaatggagtgcaatggaatggaatggaatggaataaagaagagtggactgcaaaggaatgaaatggaatggaatgcaatggaatggaatggaatggaatggaatggaataaacccgaatggaatggaatggaatggaatggaatggaatggaatagaatggaagggaatggaatggaatggaatgaattggaataaacccgaatggaatggaatggaatggaatttaatggtgaatggaatcaactggaatggaatgaaatggaatggaaaggagtggaatggaatggaatgcattggaatcaacaagagtgaaatgaaatggaaaagaatggaatggaatggaatggagtggaatggaatagaatggaatcaacccgagtggagtgaaataaattggaatggaatggaatggaatcaacctgagtggaacggaatggaatggaatggaatggaacggaatggaatgcaatggaatcaactggaatggaatggaatggaatggaatggaatggaatggaatggaatggaacggaatcaacctgagtcaaatagaatggaatggaatggaatgggatggaatggaatggaaactactggaatggaatggaaacaaccagagtggaatggaatgcaatggaatggaatggagtggaatggaatggaatggaatggaatcaacacgagtggactgcaacggaatgaaatggaatggaatgcaatggaatggaatggaatggaatggaatggaacggaacggaatggaattgaatggaatggaatcaacccaagtggaaaggaatggaatggaatggaattggaatggaatggaatggaatggagtaaccggagaggaatgggatggaatggagtggaatggaatggaatagaatggaatggaatggaatggaatagaatgaaatggaaaggaacggattggaatcaaccccagttgaatggaatggaatggaatggaacggaatataatggaatggaaaggaatcatcctgagtggaatggaatggtatggaatgcaacagaatggaatggaacaaaacggaatgaaatggaatggaatagattgattgcgagtggaatggaatggaatggaatggattggaatggaatggaacggattggattggaatttaatggaatcaacacgaatgggatggaacgtaatggaatggaatggaatggaatggaatggaatggaatggaacggaatggaatcaacccgattggaatggaatggaatggaatggaatccacccgagtggaatggaatggaatggaatgcaatggaattgaacggaatataatggaattaaatggaatcatcccgagtggaatggaatggtatctaatgcaatttaatgaaatggaacagaatggaatggaatggaatagaaagaatagattgaatccaagtggaattgaatggaatggaatggattggaaaggaatggaatggattggaatggattggaatggaaaggaatggattcaacccgagtggaatgaatggaatggaatggaatggaatggaatcaacaccaatggaatggaacggaatggaatggaatggaatggaatggtattgaatgaaatggaaaggaacggaatagaatcaacccaagtggaatggaatggaatggaatggaagggaatcaacacgagtggaatggaatggaatggaatggaatggaatggaatggaatggaatggaatggaatggaatggaatcaacccgagtggagtagaatggaatggaatggaatcaaccccagtggaatggaatgcaatggaatgcaatagaatgcaatggaatggaatggaatggaattcaatggaatcaacccgagtggaacggaatggtatggaatgcaatggaatggagtggaatggaatggaatcaacgcgagttgaatggaatggaatggaatggaatgcaatagaatggaatggaatggaatggaatggaatggaattcaatggaatcaacccgagtggaatggaatggtatggaatgcaatggaatggagtggaacagaacggaatggaatggaatggaattgattgaatccgagtggaattgaatggaagggaatgcattggaaaggaatggaaaggattcaacccaagtggcatgtaatggattggaatggagtggaatggaatggaatcgaatgcaatggaatggaatggaacggaatggaatggaatcaa

SEQ ID NO: 467233 - DNA, 3282 bp, Homo sapiens
tggaatcaacccgagtggagtgaaataaattggaatggaatggaatggaatcaacctgagtggaacggaatggaatggaatggaatggaacggaatggaatgcaatggaatcaactggaatggaatggaatggaatggaacggaacggaatcaacctgagtcaaatagaatggaatggaatggaatggaatggaatggaaactactggaatggaatggaaacaatccgagtggaatggaatgcaatggaatggaatggagtggaatgcaatggaatggaatggaatggaatcaacaagagtggactacaacggaatgaaatggagtggaatgcaatggaatggaatggaatggaatggaatggaacggaatggaatggaattgaatggaatggaatcaacctaagtggaaaggaatggaatggaatggaatggaatggaatggaatggaatggaatggaatggaatagcatgcaatcaagtttggtggaatggtatggaatggaatggaatttaaccgagtggaaaaatgatatggaatcaaaccgagtggaatggtatgcaatggaacataatggaacggaatggaatggaataaaatggaatggaatggaatggaaacaacccgagtggaatggaatggatggaatggaatggaatgcagtggaatggaatggaatggaatggaatccaccccagttgaatggaatggaatggaatggaacggaatataatggaatggaatggaatcatcccgagtgtaatggaatggtatggaatgcatcagaatggaatggtacagaacggaatgaaaaggaatggaatagattgaatgcgagtggaatggaacggaatggaatggattggaatggaatggaacggattggaaatggaaatgaacggaatggaatcaacccgattggaatgaaatggaatggaatggaatccacccgagtggaatggaatggaatggaatgcaatggaagtgaacggaatataatggaattaaatggaatcatcccgagtggaatgggatgtggaattgaatttaatggaatggattggaaaggaatggtatggattggaatggatttgaatggaaagggttggattcaacccgagtggaatgtaatggattggaatggaatggaatggaatggaatggaatggaatggaatcaacacgaatggaatggaacggaatggaatggaatggaatggaatggtattgaatgaaatggaaaggaacggaatagaatcaacccaagtggaatggaatggaatggaatggaatggaatggaagggaatcaacacgagtggaatgcaatggaatggaatggaatggaatggaatggaatcaacccgaaatggaaaggaatggaatggaatggaattcaatggaatcaacccgagtggaaaggaatgatatggaatgcaatggaatggagtggaatggaatggaatcaacgcgagttgaatggaatggaatggaatggaacggaatataatggaatggaacggaatcatcccgagtggaaaggaatggtatggaatgcaattgaatggaatggaacagaacggaatgaaatgcaatggaatagattgaatgctagtggaattgaatggaatggaatggattggaatggaatggaatggattggagtggaatggaatagaatcaacacgaatgggatggaacggaatggaatggaatggaatggaatggaatggaatggaatgaaatggaatggaaaggaacggaatggaatcaacccgagtggaatggaattgaatggaatggaatccacccgagtggaatggaatggaatggaaggcaatggaattgaacggaatataatggaattaaatggaatcatcccgagtggaatggaatgtggaattgaatggaatggaatggattggaaaggaatggaatggattggaatggattggaatggaaaggaatggattcaacccgagtggaatgtaatggattggaatggaatggaatggaatggaatggaatggaatggaacggaatcaacacgaatggaatggaacggaatggaatggaatggaatggaatggaatggaatggaatggaatgaaatggaaaggaacggaatagaatcaacccaagtggaatggaatggaatggaatggaatggaatcaacacgagtggaatggaaaggaaaggaatgcaatggaatgcaatggaatggaatggaatggaaaggaatggaatggaatggaatggaatcaacccgagtggaaatggaatggaattgaatcaaccccagtggaatggaatggaatggaatgcaatagaatggaaaggaatggaatggaatggaattcaatggaatcaacccgagtggaaaggaatgatatggaatgcaatggaatggagtggaatggaatggaatcaacgcgagttgaatggaatggaatggaatggaacggaatataatggaatggaacggaatcatcccgagtggaatggaatggtatggaatgcaatagaatggaatggaacagaacggaatgaaatgcaatggaatagattgaatgctagtggaattgaatggaatggaatggattggaatggaatggaatggattggagtggaatggaatggaatcaacacgaatgggatggaacggaatggaatggaatggaatggaatggaatggaatggaatgaaatggaatggaaaggaacggaatggaatcaacccgagtggaatggaattgaatggaatggaatccacccgagtggaatggaatggaatggaaggcaatggaattgaacggaatataatggaattaaatggaatcatcccgagtggaatggaatggaatggaatggattggaatggattggaatggaaaggaatggattcaacccgagtggaatgtaatggattggaatggaatggaatggaatggaatggaatggaacggaatcaacacgaatggaatggaacggaatggaatggaatggaatggaatggaatggaatggaatgaaatggaaaggaacggaatagaatcaacccaagtggaatggaatggaatggaatggaatggaatcaacacgagtggaatggaaaggaaaggaatgcaatggaatgcaatggaatggaatggaatggaatggaatggaatggaatggaatggaatcaacccgagtgcagtagaattgaatggaatggaataaaccgcagtggaatggaatagaatggaatgcaatagaatggaatggaatggaatggaatggaattc

SEQ ID NO: 467234 - DNA, 706 bp, Homo sapiens
gctgttagagagttttgagcagagctgctgtgaagaacagaccatggtgggagaagggaaaggaaggaggcctttgagaacactgtggaagcaacccaggcaagaggtggagtggaggtttaataggcagaagaaaagagaaagagaaacagctctctctgtggaaacgaaggtctccaagcggaaaggaccagctggtggcaaatgtgccagattttataggcggagcttggatgtgagtcttcagagaagagtcaaggacagtgccatcacttttggcctgagttataagaatggtgagaccatttgctacaatgacaaggaggacagaggagtgggttttggggggaagtggaaaccaccagcaccagtggagatttcaacaaaagcgagcctgagtcctagcttctctgaagtaaagctgcttgaaaccctcatcctccgttcctctgaaacttgacagccacagctcatcaagcagttgaaaatcatttatatgttcagaaatggacaattcagtattgtaaattttgaaaattaacaaactgttaaaggatcactgtgcacttgaagttgtggcagaaagcaagcatttctgcgcttgtaagagcaatatgtatgcgtgtgtgtttcagatattactcatcaaatacaagcatatgtttataactctccatctatatgcaaatagtttgtggtgtggcgc

SEQ ID NO: 467235 - DNA, 637 bp, Homo sapiens
cgtggctgccacttccactcgccctgccacttcctccacagctggacattggcttgcactagcatggtacccattggccattggcttctaaacccttatggaaagagagctgctctcacatttggtgtctgctgatggcagcctcctcgcgtacttgggctgggtgaatatgggaagtactcatgcacacctgggctccacgagtggctgccacatgtcctgctggctgctggtggccttggcagctctcagaagctgcctgagctctcaggaatgggagccccctcatctcccatctccaaagtcaagcccacctgcacttgcaccagctggctcattgcgcccatcttgtcacacccagggaaaggagtggaggctccaaggagcagggagggcgcaagaggaatcttggtacaagatcgtgcttcctaccccagaacaaaggttacccatgccttgggggacagtggagaacagcggtctccagcctttttggcaccagggacagatttcgtggaagacaatgtttccacggaccagtgggggttgaaggctagtttcaggatgaaactgttccatttcagatcaccaggcactagttagattctcatgagtgcacaacctagatctgtcgcat

SEQ ID NO: 467236 - DNA, 727 bp, Homo sapiens
aaaccatcatctacaccattgaaggattatgcctcaactgccagtgccaccagagatccgccctgatgctcgaagctcctgacggtggcagcagatcctggtctctctctttccactcctcacaatgctggctaaatgaagtgactgctgcagctctgtccaagcacccagatccatggggcaggttcaaaggcagggccactccagacctctcaggaagctgtgttcttcctctcaagctcgaagcctcttcctcctggtatcccagtggaatgatggaaatgacacccagagtcctgcagggagtaggccacaatgacccttattctgagaaagacatgactggaggaatccagttctgcccttggaccaacagctatcatgtgagttttccagcctcttcagggtctgatggtctctgcagggcttcaccatttggcatctctgctacgctcactgatagtaacatttacaagaggaaagcaattctccactggaagaatcttgctgattataaacgttagtgtccaaaggattgacagattgaatagctgtcaggtctccagttgaaaatggcagatgacacattctcccccaacttctaactaaatatttataaagacacagaaatgatgaaaatatagaaaaaagatgaagacaatactgacagtcatcccactgtaaatattaggaatttcccttgaatataggtagatggatatggatc

SEQ ID NO: 467237 - DNA, 1321 bp, Homo sapiens
ggtagttgcaacttttctgcatggatgtcctggaatcatagacttttgcatttgaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataagtgtttgctggtgcatgtgctgtgccggggaagaaactgagtgcacatgttgggtgaattgcctgaggtaccccagcattggttcaactctggttgagcatccactctgcacagacactgcgctgagcatgtctggggagggcaggccatatactgtggtccttgcaaaagaccctccatcgggcagcttgctgtttaatatgggaagtgagagagatgcggaaatgccagcagaacaacctggagtgatgtgtcagaaagtgacagtgcatggagcattccaggttaagaggcagtgcatgtggggtaaacctgggtggggacccacagtgaactctggggaagcctcgggtcgtgggaaagaagagaagatgtggagactgtcagacaaaggataatgacctccagttccatccacattgctgcaaaagtgattttattattttttatggctgagtagtagttcctggtgtatatgtaccacattttctttatctggtcaaagataatgcccgtgttgatgggcatttagattggttccgtatctttgctattgtgagtagtactgtgataaacatgagcatgagtgcacatatctttttgatat

SEQ ID NO: 467238 - DNA, 489 bp, Homo sapiens
gagagctgctctttcaaattcttacaaaggttttggacgcgatggatggggagctggaaggtggcaatggagtgggaaggtagtcttcccttggagtcaggccacccagcggctggactcttctctgacaaaccccagccaaactccccgcagtgtctagacatccctcttcttctttctctgacacatcgttccaccgttactggtctgccggtctgccggtctgttcctgtgctcctctcaatgttcagttgcttgtatctgtgcctgctgaggtcttgggtttatatgggcacaggatggggggtgcatggcaggccagagtggtcttggaaaatgcaacatttgggcgtgaaaacaggagtgcctgtttcacttatgtccgtgggcacaggcctgagggtggagccctcaccagggaccccgcccttctctacccagcacttccctgcccccctcccgtatcagtaattttgagtaataagataa

SEQ ID NO: 467239 - DNA, 1026 bp, Homo sapiens
ataagcatccagggaagcagcagctgtcaaccccccctttaatccctgggatgatctttctaaaacacaacacaaggagagctacagcttttgccctgatgggagtaacagacgccaacccagacatgctgctcagccctgttattaatgaggctcacataagttttaagagcaaggccctaactctcttcaattctatgaaagctaacagaggtaaagaagctgcagaagaaaacttggaagctagcagaggctggttcatgaagttttgggaaagaagctttctctataacacaagagagcaagttgaggaagcaagtgctgatgtagaagctgcagcaagttatccagaagatttagctaagattactgatggaggtggctacatccaacagatttttgagatggagggtgaggaaggagaagaattgggcggcttttcaggtagagggaacggcaattataaagtcactggggcctggaagagttaatttaacacttattataacacacttattataataattttatgccatcgaggtatgcctgttcccagactgtttattcttgtaaataatatatcatgttcttataaaatagtctgaagttttgtaggcatggcaaaatctgactcacaattattttggtttgcagtagtgctctgaaaaccaaattcctctcagaagattgaaatttgaaatctgaaactgtgggggtattctcacccattcctaacagattcctaagatgttcaaaagtgtaaatctataaagctgtgtagctagaaattcagagactcagatttattgatattgattctatctcacaaggaaaggtaatgaaaatgtcattggaggtagctggttggtggagatctctccacccttaaccatgatgtctttcagagaatgaaagctggccaagtttgacagcttccattctgcatctcagagaactgtaataagatgacccatgaaatactggcttgatctttcacttgtgggaattcaaatatttgaagtaata

SEQ ID NO: 467240 - DNA, 993 bp, Homo sapiens
cctgaattgcttttgtaaaggatcaatttccacaaagtcacattgggagaatttgactgaataactggacacgaccacccatccatgttgacacatagaactaaccatcacggtgtccctgggagtagtcaggatttggctgatgctccaccctctccacctccacctccaaagggtaggaggacagcctcacgtttacatttctgcctgatcagatgttcatatactttgaacaagaagatgagtgacttcccacctacttctcctgtgtacttcagaccactaagtgcagcaatgactgtgccacagagctgcacccttgacaatgaggacccgagagagaaacagggtcaccctgcagctatgcatcagaaccactgggtgcttgctaaaatgcaggttacttggcccatccacactcctgaatcagaatatctgcatttgagcaagctcttcagggacctacgtgctcagtcttttgtagtcaagttccctggtccatttcctacctcctttgaaagtatcacatacagacatgtaaatcacatgaccttgctggttcttctattaagtggcagctcccagcttacatggtcctcattgctcccaatcccaagcatccactataacaagtcacaggaggactctggttctgctccagccacatggctgtccttggaccaatccctgtggacagggaagggacttctgggttatctcatcactaaggagcaggcaaggcagtgtgaccacctggcaggagaggaaggacattgcccaaaagcaagtgtcttagatagacaaccagcgacctccattgaattgacttgctctgaattgagccctgaatagccccataatacatgtattagtttatgcctttaaaatcactttctcatccctgtagcattggatctttctgcagttctggatcatgcaatgcactggttgttttttcactccatgttacagatgagaaaacagtagttcagc

SEQ ID NO: 467241 - DNA, 898 bp, Homo sapiens
ttatatcccgcgcctggcttagagggtcccacgcacacggagcctcgctcattgctagcacagcagtctgagatcaaactgcaaggtggcagcaaggctgggggaggggcgcccgccattgctgaggcttgagtaggtaaacaaagcagccggaaagctcgaactgggtggagcccacagcagctcaaggaggcctgcttgcctctgcagactccacctctgggggcagggcatagccgaacaaaaggcagcagaaacctctgcagacttaaatgtccctgtctgacagctttgaagagagtagtggttctcccagcatggagtttgagatctgagaacggacagactgcctcctcaagtgggttcctgacccctgagtagcctatctgggaggcacacctcagtaggggcagactgacacctcacacggccaggtactcctctgagatgaaacctccagtggaaagatcagacagcaacatttgctgttcaccaatattcgctgttctgcagcctctactgctgatacacaggcaagcaggatctggagtggacctccagcaaactccaacagacctgcagctgagggtcctgactgttagaaggaaaactaacaaacagaaaggacatccacaccaaaaccccatctgtacatcaccatcatcaaagaccaaagatgtatggctaactagaataaccaatgcagagaagtccttaaaggacctgatggagctgaaaaccatggcacgagaactacgtgatgaatgcacaagcttcagtagccaatttgatcaactggaagaaagggtatcagtgattgaagatcaaatgaatgaaatgaagcgagaagtttagagaaaaaagaataaaaagaaatgaacaaaccctccaagaaata

SEQ ID NO: 467242 - DNA, 553 bp, Homo sapiens
gccagtacctcatcactcaaagttattaagcagctgcttttggaggcattcagggccacatccgagccagggagagggctcctcaggtttgatgagatccggagtatgcatgtttgggaagaatgctcagtgggatgccatggccgtcctgtctccttgtgttgagggcacaggagaaagggtctgtggttccagtgtcaggggccacagcgtcacttcagagatgaggcaactgaggcctgacaagtcaagcaccttgcccaaggtcacgtggctgccactgtttgtggaggccttcagtgccccaggtgctatgctggaccctaacttattactgaacagaatattcacaatggccttggaagaagcttatagggatcctctggggctttgggcacttgactttgaattagaagagagccagggggagagtggcatcactgtcccttgtcatggacttgctgtttctgctggtgtgatgtcaatatcagccattcctttggattcccaactttgggctgcacctgttgccacatttggcatatgaactgtg

SEQ ID NO: 467243 - DNA, 570 bp, Homo sapiens
acccgattggctaacagctgaaaactttcttaaataggatccctggtacattaggatggtactctaatacaaaatggaatctgaaaagggccagaggagaggctcaggtaaacttctagggaagttcttcatcatcatcatcatcatcatcatcatcatcattatcatcatcatcatcaacaagagctccctcttctctccccaacctcctcctgctactcaaaggtgcacactacttagatctaagggtgcagaaaataatgaaatactagtcaacaaccagcatttgccggatgctagctctctgttggatcctgttggtgggcagttggatgagaggaggaaacaagccacatcttgcaatcacacagacacctctgctgcagcaactctggggtgggaaccatggcattttgaaggctgcattcccttgcctgggaagcccttgatatggggagccttgggccctcctaggtgcttagcattggctcaagagcagttgatagtggtcctagaaaagataccaatatgcatctacctaggaaatttgcagcatgagttaaattaagt

SEQ ID NO: 467244 - DNA, 508 bp, Homo sapiens
ccaggtggtgccaatgctacgggtcagcagcccacccttggagggaagaaatgaatggaatcttaaagaggtcaagtgtctgcagaatgctccacagctctttaataacagaattgagatgcaaaactgggcatttcatgcttctgtccctcttttccccctcagcagtaaccatggagatatgcatagtacaatgcattgcagaatcatgagctggaagcagcctggattcctgagtgactgtgtggaggagagatgtaccacagagtcattcaacccagatggcatgagaccttacccggagctcatcgacacctcagacccattttcaagtgctccagacctgattaaacccaaagggcagtttgccacgtgcttcctctcccaccttaattatttagattgtgtagcatttgcgtaaaatctaatccagatgtttctgattcatttaagtttaaatcaccagaaaatgctcttaagttgctatttgatgttgaagaggttcttc

SEQ ID NO: 467245 - DNA, 796 bp, Homo sapiens
gtctgaatttcagctgttctccccttctttgctgcatgccttgtgaagtatgtctttagcagcactgtgaaaacgatgagtacagtaaattggtaccagaagcagggtgctacagaaaagatacctgaaaatgtggaagtgactttggaactgggaacaggcagagaagagggccaccatcctccaccccagaatgggagatccactgacagcttgcactgtgcacctggaaaagctgcagacacccaatgccagcctgtgaaagcagccaggaggaaggctatgccctgcaaagtgacaggggcagagccacccaagaccataggaacccacctcttgcatcagtgtgacctggatggcaggaccttaccacagaccaacattgctgggcctgaccccatttgcctctgtgtgcaagggagccagtcactgcctgacccagccatgctgcatcatgtggccccatccctggctgaggctgatcaacccagagaggtggcccacatgacccaaggttgtgtaagtctgcactgcccatcttgggaggagacgttcttgctgactttaaagaagcaagcagccctgttgggaaggcccatgggacaagtagctgagggcggccaacagccagcaagaactgaggttctctgtccagcagcctgcaaggaaccagttccttctaacaagcacacaagctgggaaggagacccttccccagccaaacctcagaagagaccagtcacagatgacactttgactgcagctttgtgagaccctacagcacatggcatggtta

SEQ ID NO: 467246 - DNA, 870 bp, Homo sapiens
ttgctccaaccctgatttttcatgcagtggcagtcgccatgtggcatttgtccccacttcccctcctgcagcagctccacttactcacatctgggtccttacagcctcatgaggtgcctgttgtggccactcccatcatcagagccccaggggccacctgtatgacctcagtgctctccaagtcttctgaacaagctgatgtcttcaaaggagatactcagtggataaaaaacatgagatctctgccatttagtcttggagataaccacatgcctatgcaagaaatgatagaaatttcatctatcagatttaagactgttttccgtctatttggaatttccattaagccatatattgaaggtctctcttctccacccactgactgggcctacacaggcagccagtggccctggactgcctacaacacagctgtaatgcagcagcaggcccctcctgttgtagattcagcccagagaagccctctggcagcttgttggccagacatcctttggtagaaatgtggcacttcaatttatcctttcaaatgggaaatggaaatgcagttatgcaagtttttagattattttttgaccaggaaaaaaagcagggaagttcctcaaggaggcattgccaaccaatctatcatcggatatggatggctcccctgaaatgaccttcaaagtcactgctagacctttgaccttgagcctttcctctgtctccttttgtggccacatgtgacacccacataaaataatactacaaaatatgagaatactaacattacatactttgtggggttattgtgagaattaaataaactaacacatgtaaaagatgtttacatcaatgcctggtgtatagtaaatc

SEQ ID NO: 467247 - DNA, 531 bp, Homo sapiens
ctgacagctgaaatgtataaggggtttggacagcaagatagataactcggacgatgactgctccactccagccacagaccacaggaacgaacactgtggccaacacccacggtcaagactttcactattgtacagcagtaatgagaaataagttccctctagagtgtcaacagaggccaaatggaaaacctgaacgtctacctcccctagcagtaatgaggcagtgcctcccccttccccatcagggtgaggtcacagcttccacccacaagtggacctctaccaccctcattgccgggaaggtgctttgcactcagagcctggctggcctctacaaaggcctggtgctactctccttagagatattcccttctccagcatctacttcccaccatttgccaactttaaccacccagggttcaatgagcttactggaaaggcatcctctactcattctttcaggtcaggctgtgcagcaggttccatagtttgcagtcacggtgacacttctggacattctgaaaacttgag

SEQ ID NO: 467248 - DNA, 912 bp, Homo sapiens
aggggcccagacttgggagctcctgaaccagggctgtgactcactctttggggccctgtggttcatggtatctccaaccttcagggcatcactgtgttcccttgggccagccatggaagcagtggccggaccccatgctctctcatacaccccttgccattccacacctgacttgcccttggcagagagtaaggccctaactctcttcaattatgtgaaaactgagagaagtaaggaagctatagaggaaaagtttgaagctagcagagattggttcacaaggtgtaaggaaagaagccatctccgtaatataaaagtacaaggcaaagcaaaaggtgctgttgaagaagctacagtaagttacccagaagatctggctgagatccctgaggaaggtggctacactcgacaacatattttcaatgtagatgaaacagccttcttttggaagaagatgccatctaggtttttcatagctagagaagagaaatcaatggtggcttcaaagcttcaaatgacaagctaactgtcttgttaagagataatgcagctggtaactttaagttgaaaccaatgctcatttgccattctgaaaatcctagggcccttagaaattatgttaaatctacttttcctgtgttctataaatagaacaagaaaacatgatgacagcacatctgtttacagcatgatttattggatattttaagctctctgttgaggcctactgcccagaaaaaaagattcccttcaaaatatgactgctcatgtacaacgtatctggtcacccaagcactctgacagaaatgtataaagagattaatgttgttttcatgactgttaatacaacatccattctgcagcccatggatcgaggagtaatttgaatatttgagtcttattattcaataa

SEQ ID NO: 467249 - DNA, 839 bp, Homo sapiens
ctgctttaggctggccatcatgtctctgtgtggcagccgccgccgccctaatacttttagaggccctcaaaatcacaaactatgctcaactcactctctacagcctaatcgccacacaccagcaaaggcaggctatgctatagtatcttccacaactatcattgaggctaccactctacccacctccactacctctcagcaagccgaattcattgccttaactcgagccctcactcttgcaaaggaattacgtgtcaatatttatactgattctaaatatgacttccatatcctgcaccaccatgctgttatatgggctgaaagaggtttcctcactatgaaagggtcctccatcattaatgcttctttaataaaagctcttctcaaggccgctttacttccaaaggaagctgaagtcatacactgcaagagccaccaaaaggcatcagatcccatcactcagggcaatgcttatgctgataaggtagctaaagaagcagctagcattccaacttctgtccctcacagccagtttttctccttctcattggtcactcccacctactctcccactgaaacttccacctatcaatctcttcccacacaaggcaaatggttcttggaccaagaaaaatatctccttccagcctcacaggcccactctattctattgtcatttcataacctcttccacgtaggttacaagccgctagccggcctcttagaacctctcatttcctttcccatcatggaaatctatccttaaggaaatcacttctcagtgttccatctgctattctactactcctcagggattgttcaggccccttcccttccct

SEQ ID NO: 467250 - DNA, 1921 bp, Homo sapiens
cggcgtgtcccttccgtccggcccgcgccggcggcggggaggcggcgcgcggcccgcagcccgcccatggaggctttcccctgggcgccccgctcgccccgccgcggccgcgcccccccgcccatggcgctcgtgcccagcgcccgctacgtgagcgccccgggcccggcgcacccgcagcccttcagctcctggaacgactacctggggctcgccacgctcatcaccaaagcggtggacggcgagccgcgcttcggctgcgcccgcggtgggaacggcggcggcggctccccgccctcctcctcctcgtcgtcctgctgctccccccacacgggggccgggcctggggcgctggggccggcgctggggccgcccgactacgacgaggacgacgacgacgacagcgacgagccggggtcccggggccgctacctggggagcgcgctggaattgcgcgcgctggagctgtgcgcgggccccgccgaggccgggctgctggaggagcgcttcgccgagctgagcccgttcgcgggtcgtgccgccgccgtgctgctgggctgcgcgcccgccgccgccgccgccgccaccaccaccagcgaggcgacgccgcgcgaggagcgggccccggcgtgggcggccgagccccggctgcacgcggcctccggggcggcggccgcccggctgctgaagcccgagctgcaggtgtgcgtgttctgccggaacaacaaggaggcgatggcgctctacaccacccatatcctcaagggccccgacgggcgagtgctgtgtcccgtgctgcgccgctacacgtgtcccctgtgcggcgccagcggcgacaacgcgcacaccatcaagtactgcccgctctccaaaggtcgccgccgcccctcgcaccgctaggtctgcgcaccatctcgcccccgccgtggggaggcgtgcggctcagcggtcggctcgacatgggacgtcgtcctggtggtttttgaaaagcagccgaccgtgtggagtacttccgtgctgaacgattgggactagacgctgaaatccccatttgtcttcagtttctagtttgcacatccagaacggcgaaggctgggtgtgtattccactaactgaaatatggcaacttagaggcgctgtttatttactgtatacgtcgacctattttagatgcgcatcagtatgaaattgtctcaatcttggatgtttcattttatgaatggaggcactttactaggtctagaatatttttttaaaagcctctgaactgagcttaaaactggcgattttatgaaatgtcggcaaaatgactattttattgtttgaagcgagttaatattctcagttgtctttaaaaatcagttactctaattccaggtgaagcaagccgctggtagcatcacccttatgagaagtgaaggttttgtaaactttccagtattaatttgggcgggtattccccgcttgtggcttgtttctgtcctagctggaggtgtaaaatgcacaatgtgtagcaggtagaatacagctccttatcgttctatgtaccaggtattttattactgaactagcaactagccttttccacctttaaaagttgtgccaagtcataatcatattgtgtataacttggaaatggtgctgtttaaaaaaattgtgtatttatacagtaacagtatgaattcattaatctcacctgtaactttcctacttggcattttctctacacactcaccctcttccagttctttaaaaacgtttatgatattaagatcaaagggaggaagggaagacagcagtattaattcaccctagattactcaatttcagggttcctagtggaggaaagcccattccagctgttgcctgtcaaacaaatagaagatggatctctagctctgagctattcgtgtattaactc

SEQ ID NO: 467251 - DNA, 1120 bp, Homo sapiens
cattggctggctcctggagctgtggcctctatcctgcaaggtggctggtgtttgttgacaatgcaaactgagccacctgcggctcccaccctggacaggactggggtctgtgcaaaaggacattagaccactgctgggtgccccaaacaattggttgcaaggtgctctttataaatctaccggaattcaaagctcagttcattcatcggttaaatgggtggttgtaccagatcgtggctacgaaacttcccagccctgaccgtccagaggactccaaaaatgctggaagggactggagaatgtgccaactcaggggctttccagccttgttttgcagagtggaataatgaggcccacctccccctgcctgaaccaccatcgtcacacaggccatccctctacagtggcacttggaaggcttcacgaatgacaaacgctccacctgcgggtgtggctggccacgatgatgggaaacgcgttagtaatgggccaccatggctgacccccgacctcatcgaccgccgcccctctccccagccaggttctgctgtccaggcagctgcagaggagtttaaagggcagccatggtccctggtcagccagcctgccattaataacgtttgcatctgtgacaatgacaaacctgcagtacttgaggagagtttattaaggtcagtctataaataagaattaaaaattttaaaaaatcggttgacacagatgaacagacagatgaagaaagtgattaggtgaaacaataaatataaaagtggataaggagctcccagagctggcctggaaatcagagcccagcccagtcttcctccgacctcgcctgaagtttagatttcatgaagacactcagaacttgtaggttttgtgaatctaggccctggctaatattttgtcatttaatgcctgttctctcagctaataaaaagaattgcagccatttctctatgtcaagcccataactgagagctggtaaaatttaaatgtctcatctgtcctccagcttgcatgcagatgcccttccccgggagcttggctccaggcctgtgggctagtgacagtcccccggcttgcccagctggctcttgctgtctcgggatggactgcc

SEQ ID NO: 467252 - DNA, 593 bp, Homo sapiens
ttgctcactcatccattcactcattcatgcgtcactctctcattcattcattcactcactcattcatcaactcattcactcactcattcacccgttcctacatctctcagttttcagggcctttccaggccagtgttcctggggtctccacgtttatcatcagattgggtgcaacaaatgggaacgtcgaggcgaacacccatgatctgggctgctcagactctcagatagcaaggccgaagttcatgatattctgctgcgtgattggctgtcacaatggcaatgatgcattacacaatgggagctcaggggaggaaactgagatcggagaaagcataaagtgcctggaaccagcaggtgtcagagccccacctggatccctggcctgccattctgcatgagcttcctgtgctgctgtaacagaagaccaggaatgtggtggcttaaaacaggattattctctcaccattaccaaggccagaagtttgaaatgagtatcaaatcaaggtgtgggtaaggccttgttccctcggagactctggggagaagtcttccttgccgctcccagcttctcgtagctgctggctttcctc

SEQ ID NO: 467253 - DNA, 784 bp, Homo sapiens
ttatttttcaatttacagtaatggagcacctgcccggcactgggtttgggttgggagccagaccccagcccctccctgatgggcttgtagagcccagggctctatctctgtggcctgtgttcctgcttcctaacgactctacccccaagcacataaagtcaaattgcagggcatggagaatcttcctcactgtttcctcccagggaaagctgacgtctctgctcccctcttcctttgacctgactgcctttctacccttctcttggcaagtggctgcccatcccccagtgcccgacccaaacttggcctcctctgtgaagcttttcatagcagcctcagcagaaggaaccatggcctggtcctccaggccctctgtttgccccatgattacggggcttgccttgctgcccccagcacttaattttgtgtctgtctgtctcatttgtttacaaggtcttcaagagcagctgctttgtagccttctgggctttgtaacctttcttacctttgtgactttctgggctgagtgtttcctggaggtgacttgctgagaaatatcagcccactcattgtctgaaagctcaccactagaaatggatccctgaggataagctttgacgccttcatagaatagaacctgatagtcgtaccttagcgtcatcttgtccagcttctcaactagtgaggaaatccctgacccatggcatctggcctctgcctaaacacttccagggatgaggatctcattaccttccaagacagcccgtccgctgaggagttccaa

SEQ ID NO: 467254 - DNA, 673 bp, Homo sapiens
agctctgtctccccagtagccctccataggtcttgttggtgcccagtatgaaatctgtttctgccactcatgaaatcacagaaatctttggacagatgttatttggccccatgcctgctgtgcacaggtaaaatagaacttgaggaccaaggtaatgaagatcctcctcactcaggtctgggcacaaacaccacaacctctgggaagcctttcctgattctaggcaaatgccctcaatggattggaggatgcccacccacattgaggagggtcatctcctttaccgagtcctccagtgcaaatgcagatctcacccagaaacaatgtttagccaagtatctgggaaccccatattcagtcaagttaacacataaacttaaccgtaacagcaaagggaagaaaggtccaatcccagcagagggtcaagtcaagctggaaaaactaagcaaaggccttgaatgccaggttaggcgattcgacttgactctttaggggactcaccaaagggttttatgcaggaaagtaatgtaacatacaggtctttgtttagaaaaggtagagttttccttttggcctgttcatttaggatgttgtaaaaatgggagaaatcagaggagggaagaccaattaggaattgtccaggctagaggtgattttcaaaaacccttcttct

SEQ ID NO: 467255 - DNA, 836 bp, Homo sapiens
gcccagtcccatcgaccacccaagggctgaggagtggggcgcatggcacgggactggcaggcagctccacctgcagcccctttgcgggatccactgggtgaagccagctgcgctcctgagtctggtggggacctcaaggtttgtaaacacaccaatcagcaccctgtgtctagctcagggtttgtgaatgcaccaatcgacactctgtatctagctactctggtggggacttggagaacctttgtgtccacactctgtatctacctaatctggtggggaggtggagaacctttcttcactcctgaagccagcgagaccacgagcccaccaggaggaacgaacaactccagacgcgccgccttaagagctgtaacactcgccgcgaaggtctgcagcttcactcctgagccggcgagaccacgaacccaccagaaggaagaaactccgaacacatctgaacatcagaaggaacaaactccggacacgccgcctttaagaactgtgacactcaccgagagggtccgcggcttcattcttgaacagccagaaccacatgacacgcagagcagtccggagtctgcgactaaccaggtagatgacaccaatgggcttcagtggcacctaaagatctaggagttataggagcctggtgctttcccacaaagtgtcccatttaatcttcctaatcacccctcaggctaggcctcattaccttccacagttcacagatgaggagaccaaggctcagagaaggcctcggtaagaagtgcctttcaccttccaccatgattgtgaggtctccccagccatgtggaactgtgagtccattaaacctc

SEQ ID NO: 467256 - DNA, 873 bp, Homo sapiens
gaggagacaatggatcgtttcctctctgtaattttctgcatggaggtctccctgttgtcccctggccacatcctcctgacctcggaggccaccctgtaccctcgccacgctgcgcctgctccttacttgcacaatgagctgctgttctgggggcttttcctagaggagcacctgatcaagtggaaagaattccggctggtggaaactgcccttggggccccctatctgagcaggatcctaagggctttcgtgggctgccagagctggctctcagaacagcctcaatgttcagacagcacaagggtggttaagagcatctctggcctctaccaactagatgccagtagcacacccctagctgcagtcttgacaaccaaaaatgtccccagacattaccaaatgtcctctggggagcaaaatacctcctgtttgaaaattattggtctagacatctgtattttgtttgcttggggctaaaaacatagtacctttttaaaacatgaacaccaaacaatttgttttactctaatagccctgataattctgtagcagcattctcgttgtaaataaaaaataaaaatgaaaattcaaaattcagacttgaagactagaaaaaagaccatatgtgtgtgtgcatgtgtatgttttgacaaaacctagaacttttccaatggaaatctcaggaaagggcatggactgggagtcggaagacctggatccagtcctaggctgctgcttcttgctggccagtgtcttggtgagtcaagtcccttgagcagtgagattttttgtcattaatgtgaggaagatgttatagtgattcatctctgagggtcctggaaggactgacattcttaataattgaacagaagc

SEQ ID NO: 467257 - DNA, 633 bp, Homo sapiens
ggaatggtgagtggatgtgcagatggatgggtaaagatggatggatggatggatgggttggtgggtggatgggtggatatgtggaaggagagagaagcatatgaaggacgaaggaatagagaagacacaggctttgaactcatgaaccgggttttcattgttgggttccttacttcccagcttggtattgccggcttggtattgccagctgtgatatactggataaagaaaatgtggcacatgtacaccacggaatactatgcagccataaagaatgagttcatgtcctttacaggaacatggatgaagctggaaaccatcattctcagcaaactaacacaggaacagaaaaccaaatgccacatgttctcactcataattctggatgctgggaagttggaagatgaaggtcccagcagactcggtgtcagtcgagggcctgttcctcatagatggaagttggaagatgaaggtcccagcagacttgttgtcggtcgagggcctgttcctcatagatggaaccttctacctgtcttcacatggtgcaagggatggacaagcctccttgcgcctctttataagggcactgatcccactgatgaagcttctgccctcataacctgatcacctcct

SEQ ID NO: 467258 - DNA, 2714 bp, Homo sapiens
cattggcttggggccatgactcagagccatctcgggacaccagccctgacacctgagtcagtctgactctgtggctgtgggactgcccctgtagccatccccaaacccttaggaagtctggagggtgattgggctgttctgacacttgggaccagctctccagcctgccacctaagtcccaggcatggctggaggcccaaggctcctgcacgtgcttcttctctttggtatcacaagagcaaggggtgtcaaacctgatgatgccaccttgacaaccatattgacttggtccaagcacacagactgtttgaggagtgtaatagaatgcagaaatatgcccagaaacgttgactttaagggcacattgtccactgttgacattgctgtcactctctactggcgagtccctatcactgatcctgtactgctgctgacacgaaggtttaatggacccgttgggattggaagaccaagtggtttgattcagtcatttgtgagtttgtccctgctcctggagcctctcactggagacatggaaggcagccctgtggagcagaaagagccctggactgctccttggaacctggcctctcctctctgtgtcactgacttactctgggggtgaccttgacctggtcccttccctcggcccatttgcgaaacagggaagcctagttaaaagatcactcaggtttaggggtgccagacctagcaaataaaaacacaggatgccaagtccaatctgaatttccaatgaacaatgaataattgaatattattcagatgaacaatgaatactttttctagcataaattatgctccttgcaacatcagagacacactttaaatattattatttatccaaaattcaaatttaactgagcatactatatttcactctcctcatgttgcttttacctcaagtagtttctgaatccatactttgagatacatatttttggttttgctatccagtggcttttggtagccacaagcaagggataagtgtgaaatgtctagataattctgaaaatgtatcttccctgacttgtactcaagcccaaacccatgtctttggaaacattgcttggtgaccgtgtcttcagtgcatggtacctggtagatgctccatgagtactggctgaatgaatgaatggatggcacatttcaacctttgtatgaccttcgtgtaatacatgcttccatttaacagagctaccaggtcttcctgacacatgccccatcctttccagagcactctgccttcgttcaagatagttcctgccctacgagccaactttcgtcagacaggggcagcattgcacagtgggtagaatcatgagcactggagccaaatggcttgaggttgattcctgcttctaccattgtgtccttttggagaatttcttttaactctctgtgcttctgttttctcatctatgaaaaggggtaaacaataaaacctactaaggcagttgtgagatgagataatgcatagatgtcattattatttagaattataaaggttcttatgagattccatctgcaaatcctaatcccaaccattatacaagggccacctcctccatgaagcctcaatggtgatcctctgccctactccacaggtaaaaacaatctctccccttagtgctttggatacaaatgaactgtggctatttctctgctgtcctacagattgcacgttatttgtgggaaggatcacctgggtgtttactcattgtctggtgcatagaggaggcccaaggcatctgtgttgattgagtgaagtaataaatcaattaaaacacacatttgctataggaaagaattcccagacaagttagagtatggcatcatgatcctaggaggtgtttttatctgatgctctcaccaactagctgagagatttgtgcaaggaaagagggagacccccaatagaatcagactgcagatggtacctctggggtctgtcatgaagggacacagcttggtaggggtgaaagtaggggatcgagtccaatagatgcaggtgaaaacccagttctattcttttacagctgaagacctccagaaccttccttttaggaatagatgggggagggcttgggtgtggaagagagatgaacaactacaagggcttagcacaaagggtgctgatatggtttggctgtgtccccacccaaatctcatcttgaaatgtaactctcacaattcccacgtgctgtgggaagaacctggtggaaagtgattgaataatgggggtgggtctttcctgcgctgttctcatgatagtgaatgagtctcacaagatctgatggttttaaaaatgggagattccctgcacaagctctctttgcctgctgccatctgtgtaatacgcgacctgctcctccttgacttctgccatgattatgaggcctccctagccatgtggaactgttaagtccattaaacatctttttcttctcaatctcgggtatgtctttatcagcagtgtgaaaacagactaatccaggtgctctacaaatgtttaagtgtctagcatcagcaaggcctctgtgacgctgggcctgggggagctccacaaaaggctcctgttcatgtctgaccacagaatagaaggtgggcctgcagctgagagtcctgattccattaggcaaggacgtcattatccctaaggttaaggaaaacatgaagtcctggcccatgtcctg

SEQ ID NO: 467259 - DNA, 578 bp, Homo sapiens
gcagtgaatcttcctagtgctaggagaccattttcacaacctaatcaatgatcccattattgacttggtgttcccagaggacaggtttaaaactttatcgagcactgtatgtgggggcaattatagggataatggaaaatcatcgacaaatggaggcttctgcattgcaaattaacatctgctccaaaggcacagatctctgcatgattgatgctggaaaggccaagctttcacaggataccctcaattttactcaggcccacaaagcccttggggttgtgcctcgattttactctcgattttactcaggcccacaaagccagtggggctggctgcctcagtggccgcagttcctcaccgatttcagtgcccacgcttactgctctgtgacagaagtttcccacattgaagaggtggagcctgtttcctacctgagaatctggactggcctcaggacttgctttgaccaatagccagtggcaggtgtgagggtgtactcgttctgagcctagctctcaagaggatgttcatagtctgcctgctctctcttgcaccactggtgtgctgcagtagccttc

SEQ ID NO: 467260 - DNA, 843 bp, Homo sapiens
agtgcatcgtcatcaatgcttagagtttttgattcaccttgtttttcagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaaggggtttatgaaaagtgcaaagcaggcattgagaatgatggtggccttgagaggtggacatgccgaccaactggaggacgtgaagatgaacatcaatattgctatatacacaatgataatggaatccaatagtaacactttatgttggctgaggacttaatcatggcatgtgttagccttgattattacctttaatcttctcatcagtcttctgaggatagttgttttattattctgatacgttctttacattttgtgttccagttatgatatagaatgtatataggttataggtgtgcatagaatatgcatatgtacagaattatgtataaatagaacatatagttagtattatgttgtgttgtgtattgacagtgatatatctcaatacctgggaataaaatggaaaattatattaaaacaagggtacctatcaaatgcaagctttacagtatagaaatgtggtcacatttatt

SEQ ID NO: 467261 - DNA, 1718 bp, Homo sapiens
gagggcagcaactgcatctttgaagctccctggattcatcctgtggtcacttccccagtgccagaatgcataattggcatagacatacttagaagctggcagaacccccacattggctccctggctggtaggaagacagatggatcttggggaatgacagtggattatcataagcttaaccaagtggtgactccaattgcagctgctgtaccagatgtggtttcattccttgagcaaattaacacatctcctggcaactggtatgcagccattgacttggcaaatgcctttttctccattcctgtccataaggcccaccagaagcaatttgtcttcagctggcaaggccagcaatatacctttactgtcctacatcaggggtatattaactctccggctttgtatcataatcttatttggagagatcttgatcgcttttcacttccacaagatatcacattgatccattacattgatgacatgacactgattggatccagtgagcaagacgtagcaaacacactggacttattgtcaaaaactgtgaagatatttgtatcctatgtgagtgttcaccaacaggtgacctcagcagaggaggattttaataatcaagtggataggatgacccattctgtggacatcactcagcatctttccccagccacccctgtaatcgcccaatgggcccgtgaacaaagtagccatgggggcagggatggaggttacgcatgggctcagcaacatgtactcccactcaccaaggctgacctggctatggccactgctgagtacccaatttgccagcagcagagaccaacactaagccctcaatatggcaccattcctcagggtgatcagccagctaccaggcagcaggttgattatattggacctctttcatcatggaaagggcagaggttcgtcctcactggagtacatgcttattgtggatatgggtttgcctatcctgcacgcaatgcttctgccaagactaccatctgtggactcacggaatgccttatccactgtcacggtattctgcacagcattgcctctgaccaaggcactcactttacagctaaagaagtgtggcagtgggctcctgctcatggaattcactggtcttaccatgttccccatcatcctgaagcagttggattgatagaatggtggaatggccttttgaagtcacagttacaacgccaactcagtgacaatactttgcagggctggggcaaagttctccagaaggccatgtatgctctgaatcagcctccaatatatggtactgtttctcccatagccaggattcacaggtccaggaatcaaggggtggaagtggaagtggcaccactcaccatcacccctagtgatccactagcaaaattttcgcttcctgttcccacgacattacgttctgctggcctagaggtcttagctccagagggaggaatgctgccaccaggagacacaacaattccattaaactggaagttaaaattgccacctagatgccacctacctttaagtcaacaggctaagaagggagttacagtgttggctggggtgattgacccagactatcaagatgaaatcagtctaccattccacaaaggaaataagggagagtatgcatggactacgggagatccattaggttgcctcttaactgtgtattactgtgccctgtgattagggtcaatgggaagctacaa

SEQ ID NO: 467262 - DNA, 1364 bp, Homo sapiens
ttgtcaggggaagtggcactcagacgactccgtttgcaggatcttgagtgggaaggcttgggaatgagttcacggtgcctcccctgagtcgttcggtccagaacggaccccaaaaacctggaccctggagaagggaagcgcctaaagctgaatgtcagcggctgccgggccaccagtttgtgtgttaatagagctgctgcccggcctctcctgggctttggctgggagcccgaggccagaggagcaattctgctcggcagcggaggtggcccggcagagggaggagaagcaggagcttggcttgggctgctgctgtcttccactgagacctggcagccaccttgtcggtcatgactgggccacctggctctgctctcttggctggagatctgagcagggtgaggaggaggacccagagcccactgtgcctccttggcctgaagacgagcgccctggaggttctacctggcatccaagtcactcagtgcagctctgttcttggtggccccctgctcaatgccacccatgctcgcagcatgctccttgggctctgcacctgcggtaataaccccgcagtagggggaagctgggaggagcccaagtgctttgcaactctgctaccagttgtctgtttggccttgggccagatgctgcccaccctggcctgtttcaccatctgtgaagacccttctctgtgggacttctggaaagcctctctgagcctcatttacttcctcctgaaagttggagcattggcgacgcataatacccagactaacatgaaggcaggtacacttgaatacctccaggaactctaccagtccaagtccagcccagagaggggcaccaaaagggacaaggcaggcccagggcacgactggaaaatcttgaaagactttatcaaacaccctgctgaaacccagaaattctggatgtatagcaatcttctgatttatgtgtccagtgaccttaacaaaaatggggactgagtgggtttggcatgacttcctcctggtgcccacatgccctttggtcgttgttcttgaactaccagcttagtgatcagttctacagttttactcagaactagcataaaattaacttgcctgacatttctggaatctatctttctcttttttggaaaactgggacattcattgacctccttttgccccttttgttttccatgttttttcaagcattgttgtttcaggttctgcaaacatgtctgctagttcttcccaaagcttcaaagatagcttattcatactaagaagcaaacttgtttaaagcagctagctgtctggcaaacaaaaagaaaaaaaaacattgtgtttggctccacaaacaactttaaacacatt

SEQ ID NO: 467263 - DNA, 1267 bp, Homo sapiens
atttggttttctgttcccacattagtttgctaaggacaatggcctccagctccacccatgctcctgaaaaggacatgatcccattcttttttatggctgcatagtattccatggtgtatgtgtaccacgttttctttacacagtctaccattgatggacgtttaggttgattccatgtctttgctattgtgaatactgcagcaataaacatgcacgtacatgtgtttttatgacagactgatttattttcctttggatatatacccagtattgctggctaaaatggtatgtctgtttttaggtctttgacaaattgccacactgttttccacaatggttgaactaatttacattcccacgaagagtgtaaaagcattcctctttctccataacctcaccagcatctgttattttttgactttttaataacagccattctgactggtatgagacagtatctcattgtggttttggtttgcattctgtaatgatcagtgatgttgaacttttgatgatcccaacatccagatgaaaatgcaaaaaattgacaccttgatttgagccttgtgaggttaccttccaaggtatttaaaattcctaggtattttattattttcatatgcttcgtggctgcatacatgtttcctttagaaaagtgtatgttcatgtcctttacccactttttaatgcggttgcttgttttcatgtaaatatttttctctgtccctttattttgagcctatggctgtcattacatgtgagatggatgtcttgaagacagcatgccaatgggtcttggttctttatccagcttaccactctgtgccttttaactgggggcatttagcccatttacattcaaagttaatattgatatatgtggatttgatcctggtgctagcaggtgctggggtgcctgacaccatgtgcgcattcgccacagtggtggaggcaatgcagctggcagggaaggggggcccctgctggctggtgaccatcacactggtggttgtgttgacatggggagaagagcactggcagatgcagctcagagccttcccgacccttctgttcccatctctgctcttgcttgaagctgctgagaaagcactgctggcctctcggagggctctcctcattccatgaagatgaggagctgctccactgctccagggatggcgcagctagagctacttggggccttgattgaggcatgtggttcccttggaaacagactggcttgtcacctggggtcagcagcacttaa

SEQ ID NO: 467264 - DNA, 1446 bp, Homo sapiens
ccaggacccttgaacctcctctcactccagtagttggttcctgggagagctgatcccctctgagcaggggcctgtcttgctcaggcacatggaaatggttccagagacaggaagggtctttgcaattcgagcttcttctgaaaagggaggacacaggggtgaggcaggaaagcagcagccctgggctctcagagccaggtgttgacagacccctgcttggctcaggcagctgggatctcactcctgctgcatccatggctagtccaatggcacatggcctgtcccaggcttattccttgacccctctggttccctcacatgccaggtcactcccctgacatacaaagtcactccctgcattcactatcctccccaacatgccaaagctactcctttgttactcctctcagcttctattgtctgtcttctggcatgcactgctacatccctagtatcaagttaacttgcctagcattcattgtgaccccctggcaccgactgttatttctggaatgcctggggacagccctggcatgagccggcacttgctctggtgcaggaagaattcccttcttgcacatgcacagacatttgggcttctctgatgccacagcatgggaccccagcaggagcctacatggcatgggcatgtgcagtctggacgcacgtggggtagtccaccgccctggggaacccttggtcaatgcgggacaggagccgatgcatgaatgcatcccccatgggtcgcggtgtggacaactccaagaggcattcaatgtcctgcacagagatacctgggatcaccttccacatcaactgcctgcacacagttccttccttcaggccctgctttggaggctgcaggtggctgacagttatcttctactgtgagcccatgatgctgcatgacgaaatgttttgccaccttttttggtgtattgctgtccatgatgctgaagcatcctttggttcagggctcagaattgtgttcattcacttatttccataccaccgctgtggcttttatcagaccttcatctctgaatcaaggtaccagcttctcacagatctctctgctgccacattaaacctgccaatcccccacaccacttggaggttccccattgtactcaagtgtctagaccaagctcattaacatggcctcaggttgaccagccctggtccatccctcccctatgcctctgcaaatgccctacccaccttcactccctccactcctctgtctggcaaagtgccccgtcttccacacccagtccaacggccccctttcctggagactttcctgaccctctgggctcccacaggtccacagccccacaccacacagctcctctctcctccctcagctacagcagcctcacctttctatcccagactctctgcaccaggcccagcaaacgatacatgctcaagaatttgctgaac

SEQ ID NO: 467265 - DNA, 2588 bp, Homo sapiens
tgcaacactgtgggtttcactgtggatctctttcacatcacagcaggggtgcacacatcaacaggacttagcactggtgacgctaaccttgatcgctgggctaagccctctccgtcagtgtgggaaaatctgagtgagccagagaagggtgagattccccctgcagagcaggcagtactgagcaaatccaggatccaggaactccagttctaatcctggctcttgcctgctttcctgtgtgaccctggggaagtggttttccctctctgagactctccttccccatgtcctctgttcccaacaccctgttcactgtgggacccagggaagcagggacctgggcatttccccagatctaggagccctccttccccaaaaccctccccaccaccacttggctcttgggtttcagcacctggctttagcccagtctatcagccgcaacctcaggctttggagccagagactccccaggcagacaaaggggcggctgcgaggcgggggcctctggggtgccagtccagctgtgaccaggctcccccaggtacaagtcagagggagtggactgaaactgcctgtgaaaaccagaaaatggtattgagtgaggggtacccatggagagattggcagagagatggatggcagcccagatgggcatcggcatcagaagaccccttctggcagctgcccagaggaggtgcttatgggtgcgggtgcacaagacgagggacatcttcagcgcacatcagaatcccccagaggactcagtggaacccagactatgggccctgtccccagagtttcagagtcagtggggcctgagaagttatgtttccaacaagtttccagggcttgctgaggctgctggtgggggaccccactccgagaaccactgccctagactaagtgtcaaagacttgggttctcatcccattccacttccagctgccttggggccccttgctccccctctctgcacctcagtttctccattgggccatgggagccgcacgtgctgcccactgccatgctgccctggaggctcagggagctgctctgctgcctaccaccagaaaggcttttccagggtcccgctggtgtgcatcctggcccgctcgacaggcagacctcagggaacgggtctgcacctgtgctgtaagggaggctgggaaaccgaggagccggaattttctatagcagcagatagacacggaatagcctccaaatacaaaaggagggctcagatctggggcaggaaaaacatcctagtggtcactcctattcactgcagcccacctttggcaagcatccacatgcagaaagctaccatcatcatcatcatcaccattattatcatcaccatcattatcatcaccataatcatcatcaccatcatcatcaccatcattatcatcttcatcatcaccatcttcatcattattatcatcttcatcagcaccatcatccccactctcatcaccaccaccaccaccatcactatcatcaccatcattatcatctttatcaccattaccatcattatcaccaccaccatcatcattattatcatcttcatcaccaccaccatcattgccatcaccatcatcatcattgttatcatcgctaccaccattgatgcctttgcttattctggcccttcctcctggattgcccttcattcctttctgctccatgtatagagaaggttaagtgagcatagatcctactcactgtccatggcccagctcaaattactcatcctccatggcccagtttaaatgcagcctccatgatgtccacagttaaggaatgcaggaagcctaccacttccccctgtctgctgtgtgtgcgtgcgtgtgtgtgtgtgtctttatattcttctctcttgtaccaaactaccaaacttcccagttcaccagcccctgctcatgtaacactgtctttccttcccttcatctcctcccagctcctttaagcagctttctttccctgggttcattgctatatcccagtcctgtctccctggaccctattaactgcctcaccctctatgtcccttccctacctgtgcaccataattcctcttctgtcttagatgatggcacagttcataggccatacatctgggtttgagtctggattctgtcgctttctgggcatatcttcttggatgagttgcccccctttgggcccctgagttgtctctgcatccacagaatatgtaggtgcttgaatggatttctcagcccctttctcactcaagcattctgagtttcagcctaggtaggtaaagggtttgtgccatactcacgtggctctcctcctttcctaaataatagatgttgcatggtggtttgaggactcctttaatttggttctgcatggatcaggtctcctctctacccggaaaggtagtggcagtctctcctctgctctggggtggtgggctgggctggggtgtaaggcagactgcatgtgaggcaccctcggcacccctctcagctgagaggctcagagctcttggcccaagagcctgaggggagggatatttacggtttaataactggcctattgattctcatttatat

SEQ ID NO: 467266 - DNA, 756 bp, Homo sapiens
attaccatcttccccaatccagtgggatccttcaggaatgttaccgggccttgtggcagggctgaccctgctggctgctctctacctcctgcagattgtgccctcaacactctgactcccatgggatgttaacaattgttctggaggatggattggaagtggtggagacccgaagcagagagaccagccaggaaatcacagagagcatgagaggtggtggcggggagagtgtagtgggagaggaaagaggagaagcagtaggaaggcagaatgaatggcagtggagactgctgcgatgtggggacgaggagaaaattgatgcgctcacctgcctcggagcagaaagagagagagtggggaagagggagagggggagccagagagactggcaaacacagagcctgcagattaatgaaaaccaacagcatttgctcacaattggagatgaagtgtgccctcgaggtgtttggagctgtacgtgtggccgtgtatccatggctctgtgtgagtttgtgtgtgcggccgcgtgggagtttgtgacgtgcatgtgtgtggggaccagacagcagctgtggctcctacaatctttctgagcaaatctagtggaccctgtcccttcaagaccttcctctcccaagcagaattttctggttcctctccacccctccccacatgcctccaccccattctttcaggcccctcatgtccatcatgagcagcttctcttcacatccctgccttccaccctctgcctca

SEQ ID NO: 467267 - DNA, 1234 bp, Homo sapiens
ttcctgccaagagttgcacacaaacgcaggcagccctgagcactcacactggctgtggtggcctgaagccacacccacaaggacacacaggggaacacaggcacacagggctcttcccagcaagggtgcctgcaataggggcagcagctcccatccttcccagagctggaagtcaaggagcctcagaacccactcttctgggagcaaagaactggggacaaagtagagagatggagcattgttgtgagtttgagtgggggacagagggggcctttcaggctgctgtctgatttccttccttttgagctcagtcccaggactggagccatttccacagcctcgagctgacatcttgtggccatctccaatgattgcaggcttcacaaggagacactcagtcccctgcagagaagcatagccctgcccaacccagaaagtcgttggcagaacactgcttcccatccctgatgccctgtcctatgcccagctgccaggaaaggcacaggggctgacttgttcctccagcgcggacagctgcctgcactgacatctctgagagggcctttgattaaagagacaagtgactttgcccattctattgatcagaataaattactaggaactaatttatgggcctccccacagccgatgacatggtggattgtgcgctattggtcagtaaattggattgtcaggctagattattggttcgtatacagttatctctcatagcaatatcaggcagcccaggcaatttggccagtgatgcatggggcagtagatcctcgcgcactcttccgtgcttctgccaagccagcaataacaaaaacttattttttgccagggaaacggatatgagtcaggcagcccatcgggaattaggggggctttaccacgccgctgcgatttgtaccactcggctgtttccccgagctctaaagacctgccaggaggtgacaaaggcgagacaatttcgagttcacagtcctgtgtcctcgaagcataacagcatgctatcgaaggggactttcaggggctgtgggttgcaaagtcagcggtcttttcccccaagctcactgggcagtggggagatggggtgaggagaagagccacagagagctgaggcactgctgtgaatttctagaagagatgggcccacagctctgccctcactgggcatggccagaaggggtgagaaggggggtgttggagtgccaacctggccccagggatg

SEQ ID NO: 467268 - DNA, 621 bp, Homo sapiens
ctatagcactatgagatcatgttctcttaaagcaaatgtctcttggggccaaagaggagaaaatagtgaatgcttttggttcccagtgcagtattacagagagcaggataagcagccatccatctgtggacctctgtcttatgccttctccatctctgaaacactgagttttctagtgctttctaggctgggctattgcaatctggaatctacagcagctgctgctcatatcatcattttccagccctcctttaaaaaacgcattaaaaaaaatcttgatggactacagtattgtggaaaagcaacagacctggaccagcgagctcagactccctctccccgactggtcaatgagaaaccctgggtttatgtgccttacccccaaaagagttataaagtttacctcttgttcttgcaacaaactattctgggtctagacttgaattatgctggggaaggaatctgtgttccacatgttgggccagttaaaggttattctgtagaaatctcaaccaacaagtcaaaagatgagtttcctgctcttaatagataatttttattggttttgcaataaacgtatgaaatagaaacaatagcaataaaccagctcaacaagaaatc

SEQ ID NO: 467269 - DNA, 588 bp, Homo sapiens
tgcccacatgctacctctaggctccccattcatctagaataggctgctggtttatttgctggggtctatgccagtatggcgtctcctctctctcaacacaaatttgaaatcaaccctcagtctatcctcaatggagttgtccctgaactaagcctacaggaagcctctgagctgccttttttctctggtttctcacagttatcactggaagaatcacaaaggagctctgttttggagcttggagaggcactctccatcctttcccagccctctctggacctgggagatgaacacaaatggactgcatcaaaggctctcttgtcctctggcttctgtttgtgtttaaccaaaaggagatatcagaagattaaagagcaggaggatgctgtggctgcaccatcatcccaccttatcttttcatttatttatttatttattttttttgtaactccatcctgttactgccttagtcctctgaaaacctccagctagttttcatacgaatgcgtttgaagtcttctccattttgcacttgtgtagaatttttttaaaaattcaagaacaaaactttttattaactgaaagcct

SEQ ID NO: 467270 - DNA, 947 bp, Homo sapiens
aagatagtcatgtttactttcatcattataggagctccgacctccgggcagtgcagggatactcgacggcgcgcgatgtcccggcggctccgcgagcctggcgcgctgagagccccagcagtccgagtcctcgagctcgggcgtcttcgcgccgccgccccgctcagttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgagcccggagcccgaacccccgtcgccccccgcgcactgagtccccgacgcctccgccccgctgccctgcccgtggagctcttggggagccgcagtgtggggaccggagttcgcaaaagcatccattcttttcagcgggtctttgggggtcaggccgagagggtgaagcttccagatggttgtgggaggtgcgcgttgtccctgtttccatcttcattgcacacaggcaagtgtcaggttgaaagtcgaggccctaggaattgcctggagtcattttacgtgaatgggactctaccctaatgagacccattttatccaagtgccattttgcatgccaccctgcctttgatcaccttcgacttcctcacagcaaagcaattccagtggtttagacgtgatttctcgtcttgctttagtgaaaggggaatgatatgcttgaatcttttccaagaaattccaagtgaggaaacagtttgaatgacccacttgagttccttaaaactttatgaatttatgtt

SEQ ID NO: 467271 - DNA, 1485 bp, Homo sapiens
ctggcacagacttctcagattatcaatgagtctgttgttcctctatacccagctatacctaacccttctactctgctttcccaaataccagaggaagcagagtggtttacagtcctggaccttaaggatacctttttctgcatccttgtacatcctgactctcaattcttgtttgcctttgaagatccttcaaacccaatgtctcaactcacctggactgttttaccccaagggttcaggaatagcccccatctatttggccaggcacccaagactattagcccaagacttgagccagttctcatacctggacactgttgtccttcggtacatggatgatttacttttagccgcccattcagaaaccttgtgtcatcaagccacccaggtgctcttaaatttccttgctacctgtggctacaaggtttccaaaccaaaagctcagctctgctcacagcaggttaaatacttagggctaaaattatccaaaggcaccaggaccctcagtgaggaatgtatccaggctatattggcttatccttatcccaaaaccctgaagcaactaagagcgttccttggcataacaggaactgccgaatatggattcccagtaagatggacacctgaagcagaagtggctttccaggccctaaagaaagccctaacccaagccccagtgttaagcttgccaatggggcaagacttttctttatatgtcacagaaaaaacaggaatagctctaggagtcctcacacagggaagagatcttactgtgtggatatcttacgatgtgaatggcttactcactgctaaaggagacttgtgcctgtcagacaactgtttacttaaatatcaggctctattacttgaagggccagtgctgcgactgcgcacttgtgcaactcttaacccagccacatttcttccagacaaagaagaaaagatagaacataactgtcaacaagtaattgctcaaacctatgccgctcagggggaccttttagaggttcccttgactgatcccaacctcaacttgtatactaatggaagttcctttgtagaaaaaggacttcgaaaagcggggtatgcagttgtcagtgataatggagtacttgaaagtaatcccctcactccaggaactagtgctcagctggaatcttttgccaaagaaaccagctctccaaaatcaaacctagaaaaggaaaatttggagtacaaagtggaaaatgagaggctgcttcagatcatttcagagcttgaagaagaaatccagatcaatctaaaagaaaattcaggattagcaaaaatgtccgtcgctagtattgatgaaaagctttcagccctcagccacacttggatcttgaacttacttcttaatccctatctgaccggccatctgaacagcaggaagaaggctgcgaatgtcaagggcagttgtgaaggtcacagtcctgctaggccttgtgtccactatgcctgctagtg

SEQ ID NO: 467272 - DNA, 548 bp, Homo sapiens
cagttaagtgctgcctcagctttctaaatctgcactgtgccatggtggcccttggccacatggacattttggtactgagcagaaagaatctagaaccctggattcctgttccatttttggaactaggtcccctggggccagtgcctgtctcctccttcctgtttctcccaggcgtactgtgtggactgaatgagataatgaatgaatcaaataccagctgtatctgtgtcggtcttccagctgctgccacagtagactctgttctcatgaatttcattctgggagggaggcagacccggagtcagagagcacagtacagagaactttccagacggctggtcttttatcagttgactacccagcccccagcccccagccccgccacagcagccccctgcccagcttatggtggcgtatttggctttcagctgattaccactagtatgtctttgttacggtaaactgactgtgtttattataataaaaaataaaacacagcttgacttgcgttctaaatgtgcttgaaaagaatatgatactgtttggaa

SEQ ID NO: 467273 - DNA, 1902 bp, Homo sapiens
ctgcctagttggtcccagtgttgcaagatcagccaaggggagagaagcctctttgtccccatggcccaagtctccacccagcaccacagctttgaggccacattctgcgaccatgagtgtatcatctgctggggcccagaaagctaaaatgccaaagaaggctttaaaggaagaccaagctgtgaatcttaaagccaggtacagttccactgtgactcttctcagggctgaggtggtgctagtcgtcaaagtctggaaggccatggtaggagtaaccctggtagcttttggatgcattcggcaggaacaccaaattgccagtgatcagaactggaacaacctagtctgtccccactttgctgatgtagcccaacagcaggagggagcctatgataatagaaagaaactctacactgctccttacttcaacaaagtaaacacctgtgtcctcaccacacaggtaaagaaagaaggaattagaagtggcttcacggtccctgttgcccatccagtgcctgtcacctctcttcccaattggcaaatattctgaattgaatgcttatcattcccttggggaaagttttcaataacattcaatttgtcataaaaattgggctattccaattttcaatttcttccaatcagtttgataatttgtgttgtcttttatgtttgggaattttctcatttcattgaattgtctaatttattgatataaagttattcataatatcctcatattatatatataaatgacagtcatgtgtcacttgatgacagggatagattctgagaaatgtgtcattaggcgatttcatcattgtgtgagcatcttagagtgtgcttacaaacctagatggcatagcctaccacacacctaggctatatggtatagcctattgctcctaggctacaaacctgcacagcatgagactataactgaatactgtaagcaattataacacaatggattagaacagattgcattggcagcccggtctttcataaagaggggggtggggaatagagttgggccttcattttctcacaaaaggcacaatgtgaagcgcatctgtgaacattgcataatttgttatgttctacacagaggtgggtttttgttgtacacataccaaagctatttggtgccgtttcaccaatgatctctattcaggtccagaaaagaaattggcctcagaagagtgaaaggaaagtaaatttttctttaaaaattagatacagattatcacttcaaaatgcaggagggaattttacaagtgccggtgtactgattagctttccaatggacatccagccctttattaaacacatgctagctgtggtcaactgtgaccgatgtggtttattactctccagaagggctgaactgaaatcacccatctaatttaattgagaaatgttggatgaacttgaactgtttcatggacatgaatgaccagagaatttatttgatgagacgttaaaggctgaatacggtaactatctctttgatggtttagtacagtcgattcattagttcattagcatgcctttcatatttttcattactacctgagcaacctaaatgaaaaaggcaaaaaataaaagtttttgtacagcgtcattctaaaaaattagcaaccttccctttattggtaaatatttgtgatcatttttaatgtagttaactcttttcaaagtgacatcagctttccagtaaaggaagttcacagtaattaaattgtgtggacattaataagtccactgggatttttcatgtgatagtccctaaattattttcaaaatgttgtcttctgacttcattcattaagacaaaaaaaaaaaaaaagcctttaggaagttggcatgttattcaccaaacaagctcctttgcattttctc

SEQ ID NO: 467274 - DNA, 546 bp, Homo sapiens
cctgactgtttctcactttgttttcatcgtctgatctaaacattatggtggagaagtttcaggcaagagcaaaatttatcaaagacaagacaacactaagcgcatttggctgtcggcacaccctccctgccagcctggcaaatggaaaacaaatacataggaggaaaatggggttggctctggagaagggccggctcacacgtgcagtgtgggtggaggaagtggtgaagggtaacacctaccttatcatggcctggagcaaattcgcatgcagagcagtgactggagcctatcacttgctgcgagaccgtccactgggacgaactgtcgtgggactctgcggagtgaaagcatgccgaaggaatgtaagccattcctgtttacgaattcttgctttccatatcacaatgtggcgcaaagcaccagagaaggcacactacttcattttctccatctgagaaaatagaaatggaccagaaagatcctgtttgacgtccaaattatattttatttcaacttgaataataggcatagaatgagtcctag

SEQ ID NO: 467275 - DNA, 490 bp, Homo sapiens
acccccgagaggccccgagctcaaatactatgctgggagaactactgctgtcttcagagctgtcagacagggatgtttaagtctgcggaagttgtctgctgccttttgttcagctatgccttggccacggagaaaagaagagagaagattcaaattagctcagttagaaatgaaaatggaggcattacaactgacatcgcagatatgcaaaagttaagtttacactactatgaacacctctatgcacataaactagacaatctagaggaaatgaatacattcctggaaacatacaatcatcctagcttgaatcaggaagaaatagaagtcctgaacagaccaataacaaataatgagattgaatcagcaaaaaaacaaaaaaacgccaacaaaaaaaaggccagtgccccatgtattcacagccaaattcttccagacattaaagaatcggtatcaatcctactgaaattattccaaaggaattgagaaa

SEQ ID NO: 467276 - DNA, 787 bp, Homo sapiens
ggcagacctttcaggaaatattaagttagactgaaaattcagaggtcctcatcaaggggatcatactaaaacaaaactgtgatcatagctatcacactgcatagggtatggaccccttccttgtttccccatggcatcagaatgaagtgaaggcagcttgctgtgcacaaaagacctttccctggtcagcttcttcccagtgtcccagcaccacccctgccccactgcacaactgcagcacaacccacccccagtgccatcccacaggaacccttcacctcccagccaccctgcccactcatctctggactcgttgttctccttcaacgctcattctttttctttctttcttttttttttttttgtttttgtttttgaaatggagtctcactctattgcccgagctagagtgcagtggggagctctgggctcactgcaacctctgcctcccaggttcaagcgattctcctgcctcagcctcccgagttgctggggttacaggtgcaccccaccttgcctggctaatttttgtatttttaatagagacaggataaaaataggaaaaaaaaatatacttcaagaaatgttttgcggccttctggaaagtaaaggaaaataactaggggccgaaaagaactagaagtcatgatttcataagcacttgagccagcatgtaacctgagggcatctgcagatgcctgatggcccagtatctgagagtcaagtagagtaaagggtcagaaggaggctgcccacaaaagccaggatcttccactgacaatgacat

SEQ ID NO: 467277 - DNA, 668 bp, Homo sapiens
gtcaacctcaggatcaaaaggaggagggcagtcctgcccagatgctttcctacagggggtttcaccttctttcaacttgtactggtggctcacattgcaattcatttttcccaaatcgttcttttcctgtctgccctccctctccccaccccgaatcagggtttggaaaccctgctatccaggagccaactggaagcatgactcagagctgctttccttactcttctgacctaacactcctttttcccttttgggtgacagtcagacaggagaccaaatctagactgtcagggcagtttctccataaagagatgtgtgtcttcggcaacacagaatgtggaacagtcacatgtaggttatttgatgagtggaagactggagtcaggttcctgtgtgtacagacccttcaccatgaggaaagaaacaggaataaaaactaactgaaataaacctgagaaagtaggtgtgaatgaaatgaaaccaaaagtacaagcattggaaggagttccagttcatgtaccaacagaaaggctgaattgcaggggagggggactggaatggaaagttcaagcagcagcctccatattgcttatctagtgtcccagtaggacatcccatgggttgagttatttttcagctgtacaacctggtacaacttagattgctgt

SEQ ID NO: 467278 - DNA, 1109 bp, Homo sapiens
gatgtggagagcaaggaagatgcttccagaagaggagccagtcaatgaagaggtgccctatgacttgattcctgaatcatctggcaaaatcagccagccatgtggtgatgagggcagaaagttccaggcacagaaagggagaggaaaagcccaggagttgagttgtgtttggttcaccccccacagcacaaactacagagaaggggcctgggacagagagaggaccacagggaaaacactccaagcatggagctctggaggcccaagtggagctgctttccactttgtgtatactagatacactatagcaacaagaatgattcctcgaatgctgagagaatggactctggccttggggaccgtgatcccaccttggacccctgcagctccgagaacccccagctccacccttgcctcacacacatacgctctttgtgaatgaggagaataagacccagaaaacagaagcccaagagcaaaacattttttgaattcttattttttaaattttattaattgataagtaatagttgtatacatttatggggtatggtgggatgttttgatatatgtatacattgtggaatgattaaattaagataattaacatattcatcacctcacatgcttatcattttttttaacttaaaaaaaaaatcttatgtagatggctatggcctgtaggggaatgggtgaaaatgggaaaacagaaagggtattcgacacacaaacccacaaaggacctcacatttagacttcaactttatctttgaaggaggttattcacaagattgctgagatgctttacagacctaggggaaagttaaagttaatcacacagcccgaaaattctactacgtgtttcactatggaaaaatactgtccacaacccctattttagcaattctgtgattatcttatgcatagcacattgataccacattttttaaaagagttaatttgttcagtgtaactgttttaaaaataacacaatttttatagcactgttttaatatttcttctcctttttttatgtataccaagagcctcaagataatggagaagcccaggccccttccatcctctctgaagctttgcacatttgtacc

SEQ ID NO: 467279 - DNA, 875 bp, Homo sapiens
cactgaagacttataggactatagtgacgattataggactattatgatggtacataaagcattcaaccgggtagacacatttgtacccaataaaagctatctgtcaatggagttatgttcccaggaggattatgactccctctgctgtgtcaggcaggttatcaggaaagtgggagaaaaccagcagtcacaagcctcacccagctcctatggaaaagaagtctcctatgagactatccaaaaggccagtctcactcccacggtgtcctgcttaacagcaccgattctgtttccaggcagtgggaaagcagggctaagaacttgtcccaggctacctgcctctcagctgcgaaagcaagcagggcttttgtatctcccctgctgtggagtctgcaaaccggatttatgccctttcccaagttctggccaggagactttgcatttggttggaattgttacaaagttcagctggagctttccttctccctgtggtcttttcccagtacctctggcagctctccccaaaggacctctgtgagacaagtctgaaatagcttcccaggggacgcacagagcccacagatcttttttccgctgcttcctctacccctgtatttcactcgactctctaaattgactcagctctagtcattatttttgattagctcatcttttagtttttctagtcaagatataagtactttacataccacaattatagttttataatattctgtgtttttctgtttacttactattaccagtgagttttacacctttataaaatttcttattgcttattaacatcattttctttcaaaatgaagaaaactccctttagaatttcttgtagaacaggtctagtgttaatgaaa

SEQ ID NO: 467280 - DNA, 695 bp, Homo sapiens
cgcttttgcaggatttcatgttatagaactgccagaatagtgctgacaagctttgttcgggggttcacgtgcatgtttgttacatgggtaaattgcacgtggctgaagtttgctgtatggataatccagtcatccagatgaggagactgaggctctgcgaaatgaccatgccagtaagggcagagccaggattcctagccagaaatgtacaagccaggattcccagccagatcctacagactcattctgttccacccaaggcttccatgaaggaccttggagagagatgtgaatcttcttgggcctttacatccagtcctgagatcaccagatgccaatctgcaatcctggttaaggagagagcatctaatagttcactgaccatccctattagaagaaggaaacttgctatgttctctgctacagacacactgtacagccactcacatcttttctgttgccaagagattttcaccactgctcagtgtgtgcagcatcatgaatctgaaagaaaacaagcgagaggactggcactgatcaccagaggcagaggaagggctgtgctgaggcgccggggcagggccgacctgggcaggtgccagggatgagccaaactaaatctttcctttatcctgatgcttcccctcccaggagcctttggtctgcattactaaatcctctgtaaactgctgtga

SEQ ID NO: 467281 - DNA, 1020 bp, Homo sapiens
ttcccttttctccacatcctcgcccgcatttgttactgcctgacttttgagtataagccattttaactgggagacttctgttctcttcccttatattcccccaaacaaataatctctctctctctctctctctctctctctctctctctgttctgagctgcctggagctatggagctatggatggtatgacagaagctgtcctgtggccaccatcactgagactatactggctgttgaaatcagtggcagagaactgggcttacgatatgacggtctggcccaagatagcattttcactttttaatatcttccacatgaggcttcatcgtttctatctgggccctcagcagtatggatgttgcccactcacattggatgagggcagatcttcaaatgtcagcctcttccagaaataccctcacagatatacccagaaacaatgctttatcatctctgggtaccccttaatccagtcaagtagacatctaaaaattaaccatcacagatggaatgtttcatttatcaactcatctgaaaagctcattgaaaatatttttaatgttgtaaagtataaatggaaatatttatagaaagccttcatcagtgtttctccaaattaaatggcagtagagaatagataaggaatactactttcatcacttctggacagtaccaaataacatgacattcttaaaataagttcatctagaagtcattcaatagcttcttgtaacaaaattttggttgaacaaaagttttttatatgagctaaatattagataatgttaaaaattactgtttgatagatatggatatgatattgtgactatgcagaaaaatatcatttttgaggctacatgtagaaaaatttaggaatgtcatgacatcattttattaatttactttaaaatagttcagcaataatgtatatgccaatacaaattgaaataaaaataattcagctgagaaatgaagcatctatttttaaaagttaatatttgttgtgatggctaatttta

SEQ ID NO: 467282 - DNA, 666 bp, Homo sapiens
gcggggagggtccaggtcacaggaacaccaaattgaacaactatgaagaaaatcaacttcataagaacctatgatcagacacaaatgaacattcataagctcaagactattcaggaaaacatgacctcacaaaacaaactaaatgaggcattagtgaccaatcctggagagacagagatatgtgacctttcagatagagaattaaaaagagctgttttgagaaaactcaatgaaattaaagatagcgcagaaaagaaattcaaacttctatcagatatatttaacaaagatattgaaatttttttaaatcaagcagaaattctagagctgaaaaatgcaattgacatactgaagaatgcaccagactctctttacagtacagttgatcaagcagaagaaatagttaatgagcttgaagacaggctatttgaaaattcagtcagagaagacaaaagaataagaaagaataaagcacatccacgagatgtagaaaatagccccaaaatggcaaatctaagagttattggctttaaagaggaggtagagagagagaaagattgggatggaaagtttatttaaatggataagaacagagaattttccaaacctacagaaagatatcaatatccaagtacaagaaggtaataaaatgccaagcagatttaa

SEQ ID NO: 467283 - DNA, 764 bp, Homo sapiens
agtcttttctttagggaagagaggagttcactcaagtcccgcagtcttttttgttttttataatgatattaggagtaccaatcagctgttttgcagaaggtgccaaaaagctttctttaaatgaagactactacatttctgtattttgtggacagggttggcagtttgagataacttacaagattcctgtttcaagaatactttcttctgtcaatataatggaacacaactcctttactggatcttttttaaatgttggaggaagactgtctgcttattttgaggaccagtctgaaaatatttggcaaaagacaagttatgatctaggaccaatgattggaaagatgagcacccactcttctagaggaataattgacattataaccactgtagcctacgtcctttgcaagaataagtatgctcagaccttacattggcttaaaggatgcttgggtaaatttaatcatgaagatgagctagagatagatttaaaaaatgaactgcaaatcattgaagttaacccacagaagtctattatacagcataggtgcagacacagctttgatcaattcggttttctcttcatgcttgctccagttctagggccttcactgcctcttgggtggttctggttgcaatcagacaatcttcaaggtccactctgggaaataaagtgatacttagctcctaggaagtacccagtttaccttcagaactgtcttaattttaaactatgtaaaagtctccaacctcacctcacctct

SEQ ID NO: 467284 - DNA, 477 bp, Homo sapiens
tggcgaaattatgggagtgaatccactatacctggaaatttggggaagggaagtcatccccctgggttgcacaaaaggcattcagattggaaaagaagtaaaactggctttgttcacatttggtgtgattgtctgcaatgaaaattttaaggaatctaccgaaagtgaaaaaaaaagtgaaaaattgaaccaaattaacctgcttgcaacgctgaggtcaaggagagcggatcccaaggacagcagggatctctatatattgtgcactagggagagagcaccctatgtggaaatgtggggcttgaaaattcagggaccatgttgggcaagaagaggcttacgagtccaaacaggagcagatgatgaagaatcagataaacattaacgcctcaacctacttaagcaactaagattcaattaaacccagttcatacctctttgctctgagtgcttttagaggtgaagacttcatatgag

SEQ ID NO: 467285 - DNA, 4397 bp, Homo sapiens
tcttaaagctccaaaatgatctcctttgactccatgtctcacatccaggtcatgctgatgcaagaggtggacttccatagtcttgggcacctctgccctcgtggctttgcaggttatagcctccctcctggctgctttcacaggctgatgttgtctgcaacttttccctgggcatggtgcaagctgttgatggatctaccattcttgggtctgaaggaccgtggccctcttctcacagctccactagacagtgccccactggggattctgtgtgggggctccaaccccacatttcttttctgcactgccctagcaaaggttctccgggaaagaaggaccttccgggcccataaggcgggaggcaaggagggcccctgggcagccccgcgcttgcgcgccaatcacggccgttatggatttcgatacgttaccaaacggtctcctacaaaggcagaaaccgtttaaatatttcagaaggattgattttcattttgcaaatataatactggttcattttctttctcttcctccatccattctactattgaacataaaacgtgtcaatagtattgtagttcagcatgtatctcaggatattaaaagggcagtgtgactcagctagaaaaggatgaactttccccaaagataaagtgacctatgcgactctgttgggtacaagtgacacagaaagtcatctcaaactagctgaaacacaaaagcgcaggaaggcggaagggaaggcggagaccggcaagagaggggagaaggcccggggaagacgctcgggaccaagatgcggggcccgggtgcgagcagctgaacctctcggcccccaggcgtggtgacctgggtggcgacgctcgtggaggccgaggagcttctggaccggcgcttcgggggaccaagtggagaggctgctggagttgtcgcctgagtcctcccttagttcttcgcgccggcctcgcccacggctccgggtcccagccgccactgcagtctccgcagcaccgagcggggctccaccgactcgcgacctccagcctccgcctcaagggcagggagcgcggctgggtctctggaaagccatttttaaatcactgcctctgctgcccccatgtgaggtcggagtgtcctcccccgtctttgctttcaggttctttcaggttcctttgggcaaacccgcagctaagagtccagcttgtgaacttgaacctgaacttgctgaagaagctcccggcggccccctgctgtctgcggcctttgtttgagggagaggctggggtcacccggttgggccgcatttccggggccgtcacctgtcgggctgccaggccgcgcgtaccttgtcccatcgggggctctgctctgccccctgcgctgatgacgcgggtggaagggaggtatcaggggcactctggggagctgtacctggcgggcaccccccagctgctctccgtggggtacgacaccgagacctggttgggctgcaaggagaccgactgggattcccgggctggtggccggggagacgaaggcggggggtgagaggcaggaacccaggaggccccaggcccagcgctgtggggctgctgttgtcgttctgcgtggaggtctggccaaactggcttttgccccgagtgaggaattcctgctcttttttggttttggtaagaggtcgctattcacagagggggcggggttcgtcccctccaggcgagtacggggctggcgggcgcagtgctgcctttctgctctgtctcttgatcccgcttaggatctttgtggctcctctgagtcttcttagagaggccgtgaaagatgggaaaggcaggttgctgaaacgctgctgctcggggctggcagagaccctggtatagggaaggcgcaccactgtgggtcagatcagctgacagtgggggttttaggtgatggggtaaccttacagttcggatctcttagaacccagaagcaggtaggcgatcgctgcttcatcacacttcacagggagtcctggatctttcctgtccgtaacccatggacgccatgattcagtatggcggaggtccggggcttaagttcctgttcatgcttcctaatcattcatggatccatcacaatgtgctctgaagggcctctcttgctgggattgagaaggatacattttttgagcaggtttttatactcaatggacatgtagaagggaatatattctactcagttcccctcctgcagctccttgaaattctgtccatcaaaagcagggatctgctgaccagaggtgactgccacagaaggtatccagtttgtaaaagctgaatttgttgctgaagccagaatttgcaatcttgatgtttgtgttaacatccaagagcgtgttttctgcctttaaatctctgtggacaatacgtttctggtgacagcttgcacagcagacacttttggtagaatttgcttcagtcctttttttttctttcctgctgccatgagcaggtattcacaaacttctcctcctggctagtgtgcttcatgacaaagcaaagagattcctcaatatcgatcacagcaaatgtttcactatgttggggtgatccgagccttcatggttcctactttgtggatggtgtctggaggagatctgctgagtctcatcaatgaacttcacagctgctgctttcccagttaagaggtcccaggccaaccttaccttagccaggttgcccttgacgatggtctcaaggatcctagctgccagtaagggtcccttctcagcagagatggctgagaggccctgtggcatgtgagacttactgctgggcttggagtcaaggtgtcccaggtcagcttaatttcgggaaaaactggtaagacgcttggttcaaatcacttgaaaagaaaatcacttgcatagttcacctgaagaatggatctctataatggaattaaagcacaatgctggacaaaaagtaagaaaaagcaacaaactgaaaggaaaaattgagtaaaaagaataaagaactagaactggcaacctcagccaagccagggaattacatacatcttggaattccaaagcaatgcttccttatgagggcataggaagaaataaatctaataacaaggctgggattaattcacgtggttttctcacattttggtctcaagaactttttactctaaaactaattattgaggaccccaaagagctttttatgtgggttatagttatcagtatttactttattggaaattaaaacctgtaggatgtttcagtggtcttttctagtttgaagggtttaataatttttggcttttaaagagcccataatcaattaaaatattttattttcctttaaattgtaaatgattggtgtcataatgatgctacaacttaactggcattacaatactatacaaatacgttctattgtataagtcacaataaggtacattattaactctataacatttaggggaagatagctgttatcatattatttaaagttttgcctagtttctttgtagtagacttatcttttccaggagccagagaacccgctatatcagtttcagtatctttaaatgtagagattgcagctgtgtgttgagaaagcacgtttcacttagcatgggatggggacttcgaggtactggatatgtcactggcacctcaggggaggaaaccaagatgcccctatatgattttaaacatggtttattaaagcgtgatacagaaaagtgcacaaattgtccacctacagcttggtgactgttcacaaattgaactcatctaactagcctccagaataagaaacaggcctttacacacccccaccagcctcccaatccccttttcagtcaccttctctgcagtgataaccactattctatattctgacagcatagtttcacttgttttttaacttcacataaatgggatcagacagtattgaatcctttgtgtctgcttccttcactcaatattttcctgagatttttctatattgtttattctaaatgcccattgtacgactgtaacacaatttgtttatccattttactgttcttgggcatttgggtagttctcactgtggatgctaagaagagtgttgctataaacattcaggtcttttggtaagcatatacctggctttctgttggctatttatacctagaaatagagttgctggcttataaggtatgcatatttttagttttagtagacattgcagtttgtaccaattcacccacccaccaatgtgaatatctaatattgcctgcctgtctgtacgtgtgtactggtatagcattgtggttttaatttgcattttccagtgcctaatgaaataaagcaccttttaatatgcttattggacatattttttttctgtgttgtgcct

SEQ ID NO: 467286 - DNA, 711 bp, Homo sapiens
gttacttattggtctgttcagattttggatttcttcctgattcaatcttgggcctgctgtaacctctccctggttactgcctatgttcgctcaagaccccagcattctacagtcatcaagtggcaaagccagccaggcctgcgtccttcccatgaaggcggtgagggctcctaaaccctggatgggcccagaagtattgtctgggaatcagggactcgagtcaaaaaccttagaaatttacaagaaagaagcagatcctggcaaagtcagttttaatgaagagaagatggaggaaaaagcagtgcctgagcgggcaccgaaggcactcgagggccctgtgctctttggcaagtattggcattcacgggaagaaaggaggaagtggagcagccaccactgtccatgggatgacaagtgtgaggacaaaagccagtgtaacaaagaagggcagaatggacaggcacgtgattctgccttggaaggtcataaagacaaaaggttggccttccctggagcaaaacatagaaatatgtcccctggggccgtgtcatatgccagtcctgtaagcagcatgggggacagtgatggtctacttagcaacatcaacctattcatagtttcttgagcacgctatggcatttcatgattctgagcctttgatcattctgtacggtccctgtagatccactttcttctttcatctttgtttaa

SEQ ID NO: 467287 - DNA, 1470 bp, Homo sapiens
gttttgatacgcaaattccctcgctggagtcaatgtggtgtaggagatagagggtaactggactttatgatgacattcagtgttgtggaaaaaccagtggcagacaggaacatatatttttgtgaatcatgtcagactctgttgtcaaacttgttactatcacatgtatcccgccaggtggttccagggactgtgggacaagtccccttatctgtgcagtctgtgctgaccattagctggagcccttccagactacaatttttcccagtgggcactgagagagaggtgtttcatgtcatatctgactgtgcagctgctgagataggggtgtcctgttctgagcttcaggccagggcaatctacatattcccatctcaggctcaggtcagggagccctggccatatctacacatagagcccagcagtacctcttgggcagcaggcattcaacctctccctagtgaggatggacctgtgtagcgggagaagagattttggaatgggactcatttcctctcagctctctctctccagttctgtatcagatgggaagcttctaggaggccaattgtgttttcagatacaaatatcttctgtaaggcactagccctgactcaactctaaaagggatagaaacataagcaaatactgaaatgaacattaggagagctgcttacactgagagtagtatgactttggaattttcatgcataaaattattgctagtaacagcgtgtcagagaaacagagtgagtgtttgtcatgtggtcactgaatttggcagcagtcctggttctgtgaggctctggctcaactgattaggtattcaggatctggcccagtgtgtccttggataaatacagccatgaaccacacaggacagagcaacaataaggaaacagccaacacattgtgtaagagagagagagagagagtgtgtgtgtgtctgtgtctacaaataggaaaaaaacaatggaaactagagagggaaactcatttctaatgggcaggatgcctacttgtagaaatgaaacttaagcattggagaaataaaacttaaccactatcaacattccagaaccagctctgtgttcgacgaactagcagagtgaacttgatttcacttaaacactgagtttcctcatcaggtatagaaaaaggttggccttgaacagtggtttacaaccttgggctgcaaggttgtaaaattccttggaagtcttttaaaaatgcagatgcctgagccaatctccagcccaatcaatcagaatctctggaagtgaagcccaggcatgagtattatcactatttcatgaactttttgaagtttcttgataaagataactccaacataccggttttcagaacttagctcaatggcttggttcccagggtggagagagaccgcttcttggctgctcactgccatcccctccccagctgcctgaaatgaaagggcacagagatgac

SEQ ID NO: 467288 - DNA, 569 bp, Homo sapiens
tttggcgtttaccgacacctgtcttccaattcttataataaatatgctacagatgaacagcacattgaacaaatcattacaggccgctcctagaccttcagctgatagacaatggagagttctaggagggtgcgtggctagaggcagaggacagggcagccaaggcaatgggaagacactcatcgtgggtaggactagtagttacttactaaggagtgtggaagtacatttgattcttgttattcataatgagaaagctcttgtggtagtggcagaaaacaaagacaaagagcaggaaagacatccccgggaatttgtggttgcagactggctttcatatggatctgcatcttgggttcatacaacccatacctgccgggggacattgagcaatgaacttgacttgaggttttcaccagctgcaaacaccagagctgtctgccagaagcaaaggcttataagaaagcattaatcaggaaagatgagactcgtgtaggaggatagggcaggttgctttgtcctgtgagtcatcttgaccatgttgtgttagaacagcctgaagatatttc

SEQ ID NO: 467289 - DNA, 586 bp, Homo sapiens
tctcctctggaaacagcctccatgacatactcagaaataatcatttatttacctgttctttatttcactcgtgtccatgtgaagagaccaccaaacaggctttgtgtgagcaataaagcttttaatcagctgggtgcaggcgggctgagtccgaaaagagagtcagcaaagggagatggggtggggctgttttataagatttgggagggtcagcatagtcctgccagcaaagattatttattcactttaagagttaagagtggcagtttggggatagcaccaggagatatcagctgtgatgacttggagaaacagtctgctaagccgagaagatctgggaaagagtcagtcagagagccttgggccagagttccaggggctctggaagtggctgccagctttatttcatgttgggagcagattgggtaatacaataaaatgcatattgagaataagacggctttctgacctttcagggtctagggcggtaaagcatctcagggttgctgccaaacgagccatgaactgggctgggtttttcatatttgattaaaaacagcctaaacactaactgattttgggagac

SEQ ID NO: 467290 - DNA, 603 bp, Homo sapiens
gcaacaggacattggaaaaagaagctctctttaaaaaggaggactttgatgagcagggctctgtctgaggaaaagtgatttgtagtaggaggaatgctttgtatgaagaacattgctttgcaggagaagcagggctttgaggagcagaacttcacaggaagaatagggcttgctgaaggagcaggactgtatgacagcaaagtcgtgaaggaggaaaaggcctttggaggagaggcttttgtagtggaggtgcttcctgaggagcagttgggctttgaagagggagcaggttctgtagggatgagcattattctctatttgattgctagtggcaaatcctggcactgcaaagtccacggcaagggttggggtgccaagtggggttgtacatggcttccagcaaaatactacctgcatgttccccagccacacgaagagcagagtgactcccaagcttctcatgcctggcctgagtgcaagacccctctttccctttccaaaccagtgaaaagataagtgctgagcctgtgtggacaacacacttctaagacctaaagcaactgtgacctctttttgcaaatgtagggtatggcagacattagc

SEQ ID NO: 467291 - DNA, 2999 bp, Homo sapiens
agccgtggccctttgggaagcccagacctgggagttccctgagtcagggctgtgactccctctttaggtccctgtggttctggcatctctaagcttccaggcatcgctgtgttccctggtgccagccgtggaaggtgcttgcagtgcacctggtccagctgcagccttgcagagagctggtgtcagcacctggagctgcccatcccactgcagcagccggcatgtctaactgcactgtggccagacccagtgctcgctcacacacctcttgctgccccatgcctggctcacccctggcaggcatgggatccaggctggtagcataagccaagcgcaaccttccaggccaagtgtgtggaacgaacccagagccagagaaacacaattctacaggtatcatgggaaatatgtgctttattccctataaaaacgtattagttattgtgatggttaatattgagtgtcaccttcattggattgaaggatgcaagtggactggaaaacgagacctaccctcaatcagctgccagcaaggactcaataaaagcagggagaagaacatggaaagactagactggtttaatcttgtggcctacatatttctcccatgctggatgcttcctgccctcgaacatcaaactccaacttcttcagctgtgagactccgactggagtccttgctcctcagcttgcagatggcctacctgcaagtgggacctcaccttatgatcgtagaaagagctgaaattgtggaaaatcagacacaagctcttatcatgtgcgtggctgacctgcaatgaaaggtgcacacacacccttgccaggtgtctgctgttaaggcttaaagagtctgtcctaacagtcttaaggtctgtgttgatgttaatggtaataagacatgtccaactctcccttcccatcatagcctgaactcgttttacaggttaactttaggatacccttggcaaagaggaaatgccattcagatggttggggagcttagaattttattttttgtttacagtaggtgtttaaataaagagaatggataaaatcacttaggaaaggtatttagaaagaagacaatactaacactaattcttaaaatcaagagtacatacatacatacatgtgtatcaaccctcaatgcgcaaaatatattaccatctataaacactcaggcatactcataagttttcctttaggcctattcgtgagaatcactgaattatttagttgcttcttaagtatgcttttctttcttttaaattagggatcttcaaagaaattggtctgatatggtttgactcttgtccccacccaaatctcatctgaaattgtaatccccacatgtcaagggagggacctagtgggcggtgatttgatcatggacgtggttcccccatgctgttctcatgatagtgagtgacttctcacgaaatctgatggtttaaaggttgtatgatccccctgccccctcatgacaccatgtaggatgcaccttgcttctcctttgccttccactgtgattgtaaatttcctgaggcctacccagccatgcagaactgtgagtcaattaaaactcttttctttctaagtgacagtctcaggtagttcttaatagcagtgtgaaacaaactaatacagaaaattggtattgagagaagtgggacatttctataaagatacctgaaaatgtggaagtgacattggaactgggtaacaggcagacattgggtaacaggacatgacattggaactggataattggatcagtttgaaggcctcagaagaagacaggaagatgtgaaggtttggaatttcctagagacttgttgaatggctttgaccaaaatgctagtgatatggacaatgaacatctaggctgaggtggtcttagatgaagatgaggaacatattgggaactggtctaaaggtcacacttgctatgctttagcaaagacaatggtggcattgtgcccctctcctagagatctgtgaaactttgaacttgagagagatgatttagggtgtttggcagaagaaatttctaagcagcaaagcattcaagatgtgacttggctttttctgaaagcatacagtcatatgcattcacacagagatgatctgaaattgtaacttatgtttaaaagagaagcagagcataaaagtttggaaaatttgcagcctgaccatgtgatagaaaagaaaaacccattttctggggagaaattcaagctggctgcagcttaatttgcctaagttaagagaagccaaatattaatcaccaagacaatggggaaaatgtctccagggcatgtcagagatcttcacagcagccccttccatcacaggcctggaggcctaagaggaaaaaatggttgtgtgggccaggtccaggaccccactgctctgtgcagccttgagaattggtgccctgcatctcagccactccagttccagctgtggctaaaaggggccaaggtgcagcttgggccatagcttgagagggtgccagccccaagctttaatggcttacacgtggtgttgggcctgcaggtgtgtagaaggcaagaactgagctttagaagcatctgcttagatttcagaggatgtatggaaacaagtgaatgcctaggcagaagtctgctgcaggggtggagccctcatggagaacctctactaaggcaatgcagaaatgaaatgtggtgttggagcccccacacagagcccccacaggggcactgcctagttgagctgtgagaagagggtcaccatcctccagactgcagaatggtagttccattgacagcttgcaccgtgcacctggaaaagccacaggcactcagcaccagcccatgaaagcagctgcaggggctgtgccctgcagagccacaggggcagagctgcccaaatcatatgcaaatttctaaacctggcttgagtttcttcccagaaaatggatttttctcaaggccttgagagcccaccttttgcat

SEQ ID NO: 467292 - DNA, 3109 bp, Homo sapiens
gccagggctgtgactccctctttggggccctatggttcctgaagtctccaagcttcgtggtgccactgcattccttagttccagctgtggaagctgctggcagtgcacttggtccagccacagcctcatagacagccagcacccgcgctggcacctggagctgcctgccccactgcagcatacttgactgtggggtgtcctggcctcctcctttgtagctctcaggtgtcacatgtgggtcctgccctaccatcccctctccctgtctagaaatgaggcctgctgagcttggagccgccccactccctgctctcaagccgtctgctcctgggttagcctgtggctggcctggcctgattctacaccgacgtgggtgtttctccactgctggggcagcggtcggccatcctggggcctgggtcagctctcagctgtggccattgtgcctgtgcttcccccaggtcctggtggtgactccaaccctgccctcagatatcccaagagcaggctgactgtcttccccattcccacctttccagtagctgctgcaagaagggacagaccctgctgcagagaacttgccacggcgtttcatgctgcggctgttggggccaggctgcacgctccattctggggaagagtgaggattcctgatcatcggtcttaacaggggactgtccagtgggtacctggataggctgccaggagtagggtggagtggggttagagtagtgcctgctgccctccccgcagcaaccctagtctcccttccttcaccctcttgacgcctctctaagtctgacttgcccgtgtaccatgggtcagagcccgccacttcccaggcctcccagtgcttccctgggcagattctgggatcattcagtggtgactgccctgctagggtgtcagctgtcagatcccttcacaaccccccaactcaactctgccctgaagcactcacggtgggctcccaactgtcactgtctccagggccaagggccaaacttcacctgcctcaccaacaacaatctcaggatcgattgccactggtctgccccagagctgggccagggctccagccccgggctcctcttcattaggatggcagcagctacaccacgacagtgtaacagccccgtggtgctgacacttgccctttctagcaagcaggctcctggtggcacacataagtgcatcttgtggggcagtgagtgcactgtcgtgcttccacccaaggcggtgctcctgccgtccgacaatttcatcatcactttccaccactgcacgtttgggagggagcaggtcagcctggtggagctgcagtacctgccctggagacacgtgaagctggacccgctctctgacttgcagagcatcctgacctggagcatcagtcctgccttggagctgatgaccacacttctcagctatgagctgggcttcaagaggcaggagagcaagtctggtgctcaaggagacactgggtggggtggcagccacagaacttctgctgatgtcaaagacaaggttcctggaggtgctggctccctctgcgggctgaggacccggctgacttggatgggggcccacggggcaggtgtgctgctgagccaggactgtgctggcaccccacgaggagccttggagccctgcatccaggaggccactgcactgctcacttgtggcccagtgggtccttggaaatctgtggtcctggaggaggagcaagagggcactgggaccagcctctggggcaacctgagctcagatgatgtgctgccagcagggtgtaaggagtggagggcacagccgcttgcctatctgccacaggaggactgggcccccatgtgccccaccaggccagctcccccagactcagagggcagcagtaacagcagtgactactgagcctcgagctgctacgggggatgccacccctcatccctcccaggaaacacacagagccctgggcccatcccagccctggcctgtggccttttctgtgaccatcagggcttggagacccagcaaggagatgcctgggtgctggctggtcactgccagaggtccgggctgcatgaggacctccagggcacgttgctcccttccgtcctcagcaaggcttggtcctggacgttctaagtccctgacttgccatatgcatcatgtccattttgggaaaatggacttaagtctctggaacccttgtctgggactgaacctcctgagaatgggccctagtagtggttggaggtcctctctggatggaggctcaggggcagcttcagggaggaaggatccctctgctcagtgcctgtggggagaacctctaccctcagcatcctgcccacaggtttctcctgctgtcccttttctttatccctggcctctctgagaagaaggttatggtctctcagctgttccgccctcatccccttaaagggccagccagggcccagtggacacaggaaactgagagttgaggctggagctcccagacagtcagtgctggaagtgaccatccagcagtgatggtggcctgtgaagggtcctgcttctgtcctcagcctctcatggggtgggcttggggaggagctgtggtctggagagagcggcagatggagcacaacatgcctgcatttgtttcctagggctgccgtaacaaagtgccacaaaatgggtagcttagaatcacagaaatttgttgtctcacagttccaaagaccagaagttggaaataaagatgttggcagtgttcccgactacatgttctgaggctcccacgaaacagaagttgatacaaggccaagtttgttttttaaatattttctctcagtctgtggcttgttttttgattctcttaactggatatttcacagagtagtcattttaaattttaataaagtccacattatcattttttatcttatgaactggcttttggtattgtatctaaagactcatcaccaatccaaagtcatatggattttcttcaataacttttacaattttatatttgaaaatttaagtctacagtctatcttgaattattttttaggggtgagctatgaagtttgtacctacgttcatttttttccctatggtttcc

SEQ ID NO: 467293 - DNA, 1370 bp, Homo sapiens
ccgtggtgaagacaaaggtttcgttcgaccctgcgtgtgatttgctgatttcggttggagaccttgttgaccgcggcgcggaaaacgtcgagtgcctggagctgattactatgccttggttccgggctgtgcgaggtaaccatgagcagatgatgattgatgggctatcggagtatggaaacgttaaccactggctggaaaacggcggcgtgtggttcttcagtcttgattatgaaaaagaggtgctggctaaggctctggttcataaatcggccagcctgccattcgtcatcgagctggttaccgctgaacgtaaaatcgttatctgccacgctgactacccgcataacgaatatgcgttcgacaagccggtcccgaaagacatggtcatctggaatcgtgaacgggttagcgacgctcaggacggcattgtctcgccgatagctggtgctgatctgtttatcttcggccacacccctgcgcgccagcccctgaagtatgccaaccagatgtacatcgatactggtgccgtgttctgcggaaacctcacgctgtgcaaagtatgcggtgaatacttcgtgccgaaattccacgacatccggatccggtggtgcagcccggagcatggcgcaatcctcgcaatggaagaacgcaagaaggacaacgtgaaagccgcggctaagcgcatcaaggagcaaaaagaggctgaaaaggacgggcgcaaacgccgcaaggagcggctggcagagctcaggccagacggatactacaaggctcaggctcagaaagctttcaacgcctttatccgtgcgcgcgacgccgatttgccatgcatcagctgcggcgagaccaatccgcctgatctgcatggtggccagtgggattgcggccatttcaagacagtaggtgcttaccctgaactgcgctttgaagaacgcaacgcccataagcagtgcaaatcctgtaatgccggagctggcaagtacaccgccaaagaggcgaccgtggcgcagcaatacgaagctgggttggtcgctcgttacggtcagggatacgtcaactggctcaatggtccccacgaaatgaccaactaccgccgtgaagacttcatccggatccgggatgagtaccgcgacaagctcaaagcactgaaacagcgggaggcagcatgaaaccaatgatattcgatctcaagctacctcattgggcttttctgcttgagtgtccgttctgtggcggcggcgcagaacttttttctgatggtgatggtgtctacgccggttgttcaacaaagcaatgcttgattaagccgataactgacacctatccaacaaagcgcgatgcaattcgcgcctggaatcggagtcttc

SEQ ID NO: 467294 - DNA, 4672 bp, Homo sapiens
tgagggacaggcaggggatctttcctgtccccgtgtcctcatcacatgcacaggttacagtcactgacacgacgcccatcccaggctgcagggcccactagcgaccgcatcccttatcgaggcaaccgaaggaaacccagggccccagaaacagcgaggagaccctcacccagccgggatacagccaccgtgaaagccatctcactcagcgagaaaccgagcaaagggcgcattccttaccttcctggtgagcggcacctcgatgggcacggggaccacctcggccagcaggcagccgtagaaagccgccatgaaggcagccggatcattgttggggaacaccagtgccacctgtgggacaggccagagcgggtcagcattaacgtggggtcctggcttcctaagacgccacggaagagcttggttctaggtgagagggcacgcttcagtgagaaccagatcctatgtaaaatgcatttcagtaagctgtgttttaataagcatcacacacccggccttgaattcatatagaagacaaacgtgaacagtcgtctatgatactgtcaccagagtacaactgcctttattttctgcatactaccttccatacccacacgtttccacatagatgaagttatatcctactgtttctcactaagctttgtaaatacttccttgtatttctatacagtcttcataactgtcctgggacagcatgtgcaggactcagctcagatcccatggcagtgtttggctctgggatctcaggcacaattgtggcctctctgagccttagtgttcttctctgaaaagtgagaataatgatagagctgatgtcttaatgcggtggtcaagagtgttaatagacaaccctatttctggattcccactaagccctgtgaactctgcttctattttaacacaggttacttgtacatgtggggtagcattagcgttactcttccttctggacaagtttggtacattttcatcagcacatgaatcctgtgattttacacgtgtggtagcattagcattactcttccttatggacaagtttggtacgtgttcatcagcacatgaatcctgtgattttacatgtggggtagcattagcattactcttccttatggacaagtttggtatgtgttcatcagcacatgaatcctgtgattttacacgtgtggtagcattagcattactcttctttatggacaagtttggtaatcctgtgattttacacgtgtggtagcattagcattactcttccttatgaacaagtttggtatgtgttcctcaccacatgaatcctgtgattttacacgtgtggcagcattagcattactcttccttatggacaagtttggtacattttcatcagtacatgaatcctatgattttacacgtgtggcagcattagcattactcttccttatggacaagtttggtatgtgttcatcagcacatgaatcctgtgattttacacgtgtggtagcattagcattactcttccttatggacaagtttggtatgtgttcatcagcacatgaatcctgtgattttacacgtgtggtagcattagcattactcttccttatggacaagtttggtatgtgttcatcagcacatgaatcctgtgattttacatgtgtggtagcattagcattactcttccttatggacaagtttggtacattttcatcagcccatgaatcctatgattttacatgtggggtagcattagcattactcttccttacggacaagtttggtatgtgttcatcagcacatgaatcctatgattttacatgtgtggtagcattagcattactcttccttatggacaagtttcgtacattttcatcagcacatgaatcctgtgattttacatgtgtggtagcattagcgttactattccttatggacaagtttcgtatgtgttcatcagcacatgaatcctgtgattttacatgtgtggtagcattagcattactcttccttatggacaagtttggtacattttcatcagcacatgaatcctattttacatgtgtggtagcattagcattactcttccttatggacaagtttggtacattttcatcagcacatgaatcctatgattttacatgtgtggtagcattagcattactcttccttatggacaagtttggtatgtgttcctcagcacatgaatcctgtgattttacacgtgtggcagcattagcattactcttccttatggacaagtttggtacattttcatcagcacatgaatcctatgattttacacgtgtggcagcattagcattactcttccttatggacaagtttggtacattttcatcagcacatgaatcctgtgattttacacgtgtggtagcattagcgttactcttccttatggacaagtttggtatgtgttcctcagcacataaatcctgtgattttacatgtgtggtagcattagcattactcttccttatggacaagtttggtatgtgttcatcagcacatgaatcctgtgattttacacgtgtggtagcattagcattactcttccttctggacaagtttggtacattttcatcagcccatgaatcctgtgattctacatgtgtggtagtattagcattactcttccttatggacaagtttggtacattttcatcagcacatgaatcctgtgattttacacgtgtggtagcattagcattactcttccttatggacaagtttggtatgtgttcatcagcacatgaatcatgtgattttacatgtgtggtagcattagcattactcttccttatggacaagtttggtacgttttcatcagcacatgaatcctgtgattttacacgtgtggtagcattagcattactcttccttatggacaagtttggtatgtgttcatcagcacatgaatcctgtgattttacacgtgtggtagcattagcattactcttccttatggacaagtttggtatgtgttcctcagcacatgaatcctgtgattttacatgtgtggtagcattagcattactcttccttatggacaagtttggtacattttcatcagcacatgaatcctatgattttacatgagtggtagcattagcattactcttccttatggacaagtttggtatgtgttcatcagcacatgaatcctatgattttacatgtgtggtagcattagcattactcttccttatggacaagtttggtatgtgttcctcagcacatgaatcctgtgattttacatgtgtggtagcattagcattactcttccttatggacaagtttggtatgtgttcatcagcacatgaatcctgtgattttacatgtgtggtagcattagcattactcttccttatggacaagtttggtacattttcatcagcacatgaatcctgtgattttacatgtgtggtagcattagcattactcttccttatggacaagtttggtacattttcatcagcacatgaatcctgtgattttacacatgtggtagcattagcattactcttccttatggacaagtttggtatgtgttcctcagcacatgaatcctgtgattttacatgtgtggtagcattagcattactcttccttatggacaagtttggtacattttcatcagcacatgaatcctatgattttacatgagtggtagcattagcattactcttccttatggacaagtttggtatgtgttcagcacatgaatcctatgattttacatgtgtggtagcattagcattactcttccttatggacaagtttggtatgtgttcctcagcacatgaatcctgtgattttacatgtgtggtagcattagcattactcttccttatggacaagtttggtatgtgttcatcagcacatgaatcctgtgattttacatgtgtggtagcattagcattactcttccttatggacaagtttggtacgttttcatcagcacatgaatcctgtgattttacacgtgtggtagcattagcattactcttccttatggacaagtttggtatgtgttcatcagcacatgaatcctgtgattttacatgtgtggtagcattagcattactcttccttatggacaagtttggtatgtgttcatcagcacatgaatcctgtgattttacacgtgtggtagcattagcattactcttccttatggacaagtttggtacattttcatcagcccatgaatcctgtgattctacatgtgtggtagtattagcattactcttccttatggacaagtttggtacgttttcatcagcacatgaatcctgtgattttacacgtgtggtggcattagcattactcttccttatggacaagtttggtatgtgttcctcagcacatgaatcctgtgattttacacgtgtggtggcattagcattactcttccttatggacaagtttggtatgtgttcctcagcacatgaatcctatgattttacatgtgtggtagcattagcattactcttccttatggacaagtttggtacattttcatcagcacatgaatcctatgattttacatgtgtggtagcattagcattactcttccttatggacaagtttggtatgtgttcatcagcacgtgaatcctatgatttagcacatgtgcatcatttttgcattacttcattctgga

SEQ ID NO: 467295 - DNA, 613 bp, Homo sapiens
tgctgtgaagagccagactggggcagatgctgtcactatgagctccggcagctggatggtgacagaggactcacctcttctgatccaccggcccagggctgctgaccacagaggagagaatatgaatgtgcacacgcacaagaaagacggcctacagaggaagaccaccattgtgaaagtcagttgtcgaacaggggtattagccatttctgcttggttttctgcccctgtttctgatgccctttttattcttggagccatggtggagcaggggccacagaatagaagtacatcagtaaacttgagacttagcagcagaatggagggagtgaagatagagacaaagacaaacagcttaacaggagcctttcacccgatcaggtccttgtgtgtgtgtctcagtgcatgtgtgagtgtgctgtgcatacatgcatgtgtgttttgcaagtgtgtgaatagtgtctgcacatgtgaatatgagtttgtacatgtgcgagcttgcctgtgtcatgtgttgcatgggtgagtgtgatgtgggtacaagtataagtgcatatatgcatgagagtatgagtttgtgcaagtgtgttgtgtatatatgctgttgtgtgtt

SEQ ID NO: 467296 - DNA, 894 bp, Homo sapiens
ttgcccggctgcttagagcgagttccggtttctccacacgctcagggccgcccctggatccggtttctccacacgctcagggccgcccctgggttccggcttctccacacgctcagggccgcccctgggttccggcttctccacacgctcagggccgcgcctgggttccggcttctccacacgctcagggccgcgcctgggttccggcttctccacacgctcagggccgcgcctgggttccggcttctccacacgctcagggccgcgcctgggttccagcttctccacacgctcagggccgtgcctggtttccggtttctccacacacgcagggctgctcctgtcacacttcatggtggaaagtgacggaaaccaagttggaccatttcagcaagcgaagattgaagtaggagagaggtgcctgaggaactggagggttgggtggaggtgcagcccagtgacagggagggtctggaagcaaagcccagaagatcctcaggagtccccttgtcaccttgcttctctgccctgtgcacacttctgtgcagatggatcagctctctgtgctcattccacctgggagaatgctgcagccccacggtcattagacctcctctgtcagacggctgcccatcacaagctaatgggcctgaggcatgggcttggtcacccagaggcaggaggctgtgccctccatgaggccagcagtgtcgcatctcaaaagccaagaagagagcacacaccctctcctctctggcatgggctgagcagagcgatgcctccagagagggcatgtggaagggacggggaaaacctgcaaacgtgacccagctaagtgcgaggtcaccatcagtgatgagcaggggggctttgatatgacgccatgggaagggc

SEQ ID NO: 467297 - DNA, 590 bp, Homo sapiens
tctggaagcaggaggcacagggctgccttgaggaaatgggaactcgggaagatggtgaaacagtcgcagaagccaccgagagagaaggctggtaggaaacaccgacaggtgctgtcgccaggaagtctgtatggggaacgattagtgggcggcagacggaggacgtggagaggccggaggagacttgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttc

SEQ ID NO: 467298 - DNA, 582 bp, Homo sapiens
gcagcaaatgcggcagttaggaaatgactccttgtgctaagcaacctctccacagaagcagtgtgactgcttctgtccaggtggacagaccattccttgtgcgaggggccgtggagaatgcagaacacaacttcacagtagcaaatcctatactcacccacctgcgctggaacacacacacaccggcgctggaatgcacgcatgcacggcccaaaggaggccccacgggagcagttctcctggttacctggtttgtacttgaccggtcacgatcttgggcaaaagatgcagcttttggttgtcaaatggataaagacaatttggggtggaacagtcaagtactcgtacttcctgacacgcaaaggttccctacgatacagctgatagaaagcatttgcacacaggactcacgctgtttgtccccaaattaccaataatctgtacacttgcagcaaaatgtgaacaaatatatttagatatatttaaaagaattaaaaaaaacatttcacaaaacatttgttgccataggaattatttttagcaataaatgcccacatcaaaatttaaacatttttcaaagta

SEQ ID NO: 467299 - DNA, 1000 bp, Homo sapiens
tgttctgctcggacctgttcctgagagctggaggttggtcaagaagcatgaaatcattcaaatggttctatgaactcaggtcaatgaaggagaaaacagtggagaaaactagtcctggtcctgtccctattagttatgtcctgaaatttgatgatttttctcctttggctgcaagctacaaaattcttaactccttgcaatgtaggatctttggctatgaaatgaaaaatagtagatccactgacagcttgcaccatgtgtctggaaaagccacagacactcagtgccaacccatgaaagcagccgggagggaggctgtactctgcaaagccacaagggcagagctgcacaaggccatgggaacccacctcttgcatcagcatgacctggatgtgagacatggagtcaagggagatcattttggagctttaagatttgactgccccgccggattttggacttgcgtgggcccttaagagtaacttaggaatctacttatcagggattgcaaactcaaatgcctaccagaatcaaattattaatttccaaacagcctagctattaggcaacatttgattgaaaacattgcacgtgtaaaaggaaaaagaattgctatcacaacaattcaattatttggtagatacatttataaaagacagctgcatttgaaaaagttgacaatagatggtcagattaaagaggacacatgaatggatctttctagaaagatacattcatttatacacagaaggtaaccaacaatggaatgtttcttatgaaaaccgcattttcaaaatatgtagaattttaaaatatactgtgtaaaaatggctttgtcaactgtgaatgcagttcagtgttcatggcttgtgttggcgattaagtttggaggctgaggagaaaagcaactaaagcatctccgacattgtttggtgaaatgtattaactttggtgacctcctcaaggcagaccaatctcatcctcagtaggtaactatacc

SEQ ID NO: 467300 - DNA, 714 bp, Homo sapiens
cccatacacctcacgggccaagcagtcacgttataagggagggaggcccagtaaaacatgggggggtccctgccgtaccctcctttgtttctgatggtccagcctcttctggtctgtggcttctgagagctttgcttgtgccgcgttctgcatgttggcgatattcgaatgcttcttcgccagctgcactatgatgcatgtcttgctactctcttcaggttcccttggtcaatgggaaaacactgtccatccttttcctccctaaagcttaaccatctaatcagccctctctcccaccctgtaattgcatgctgctccagccagtctcttgccttcagcgttcttgagatggatggaaaccaggcaaagatgccagcaaatgcctgtggatgctctttggctctcctaagaacacttgttgttctctatggtctggaagcagcaccagggcctgtgatgtcagggctctgtaaacatccagccaggaaaaagggaacccacacagaatcccacgggcatctgagcctggagcagtctcagctgggagccactttgagagcccagataccagggatctacagacacagctgcagctgctccaaggaggaagaggcaagactgggcgctcccatgcaccctcgggaaggtgcttgccactctgctataagctgctgtggagactgagacacgagtgaactgccctcccccatgctg

SEQ ID NO: 467301 - DNA, 693 bp, Homo sapiens
gcctcacagatatgaataccagacttggatgaggcactgggctttttactggtccaacaacttgattctactatgcactaaaatcaaagaggaaaggaaaaattcacttgaatgtataaccaatatcccaaatgcactgcagtttaccagtgggctaaaaactgaaagattaaaggaaaataaaatttttcttgtgcagctgaagaaaaatatatttcttacaaagcactcaaaagaaatgtatttcagaaatgattttcagcatctgctttgtgcaaagcaccatgctaggtgctatgtaggacaggagatgaaagcaacacagttctctccctcgcacaatctaacaatccaattggaaaggaaaattccactagcccaagatagaatgcagaatggaatacttcaggtgggacagccaggtttaggtggctataggatacaaatcaataggaaacagaataaaatagatgaaaatcctgtgtagaatatgttatatgggggtataactgtagtgtatattgtgtatgcctgattggcttcatttctgagtgctttcatgataccaaggctctgtacaagttccttggttgcagataggtttaacagtggttatctcagatgttgcttgttgtagcaatctaattttgtttggtggtgtagttcagactgcaggccagtaggtgacatata

SEQ ID NO: 467302 - DNA, 569 bp, Homo sapiens
tgcttcagagctagggtcagagatggggatgccaccttctctaggaacctcgcgagtgcctggagtcaagttccaattcaaggttttctacattgcttcacaaattagtacagcatttgtgataactgcagatggcagaggaggaacatctgcaatacttaacaattcatatttcttttatatttgtatatataacttaaaagtgcaaggtgaagcaggaagtgctgatgcagaggctgtaacaagttatccagaagatctggctaagataactgatgaatgtggctacactaaacaacacattttcaatgtagacgaaacagtcctatattggaagaagatacctaggacttttataactggagaaaagaaaaatcgccacagccacgccaatcttcagcaacatcaccctgatcagtcagcagccattaacgtggaggcaacacctttcaccaataagaagattatgactcgctgaaggctcaagtgatcattagcattttttagcagtaaagtattactaattaaggtatttgcatttttataaataatgatattgcacacttagt

SEQ ID NO: 467303 - DNA, 550 bp, Homo sapiens
agatcctccagaccagccctttggccagatgagtgattcagatgagagcaagaacaaatccaaatagcacatttacccacagaatcccaaaggcaccaactcccaggatgggggaaaaaaaggatgttctgacctcctgctgcaccagcaactgtgctgtgcaggactccttgaatattccagagcaaatgcaggatccatgtagcctcgctcccctcaatttctcaacagcacttcccctcactaggctctctgatggtgttgctcagtgtcccagtgaaagactgaagagccttgggcagtggacagtggacagtgagggtggctgcctctcagaggggcgccagtggcattctcaagggccacactctcacctgctcacttatggagtgtggggctcccgagttctccataggagagcttgctctttctgtgcgtatttcttgctttaggtcatctgatgaaaacttgcctctctccttatttagaagagcctgttagggctcaaactcatgacaataaatattaatcaaaatttccaaaccaaagg

SEQ ID NO: 467304 - DNA, 543 bp, Homo sapiens
aagttaaggcactagttcctgtggcctggagttgagtggtgagtgatgagcagaccacctagcacacagggaggtttgcaacaggtaagcaggaagtgggactgtgaatataatgacatttttctgcccttctggatccaaatagtgtgtaacttggcataccatgtctgttcaaatgacagcaactcgctgtcctttaagaacaaatacatcttctcagctgactccaaagccacatatgtttgtgtgagcaaaaaacaggcccagttggcaaataaaaatcacaaagaaatcacggtatacaatgactcaaaatcacaaaagtcagaaaaagaaccaaacagaaatctaaaactgaagatttcaattaatgaaatgaaaaatacaatcaagagcttcaacaatggactagatcaaacagaagaaagaatttccgaacctgaagacagattttctgaaataacccagtcagacaaaaaaagaaaaaaaaaagaataaaaaataataaagaaaatgtacgtgacatacaggataccatgaatc

SEQ ID NO: 467305 - DNA, 1684 bp, Homo sapiens
ccgagcagaaaaatcttcccagttatgttgggagtgttttaccccaacatacaagtgggctgtacaggaagcatagtggcatctgcttctggggaagcctcagggagcttccaaacatggcataaggcaaaaagaaagcaggcacatcatataacgaaaataggaaaagagagagaggagaaaggtgccacacgctttgaaatgaccagatttcatgagaactcactattgcaaggacagcatcaaggggatggtgctaactattcgattgagcagagaaagacttcataccgtgatgcttatctgacagtctgggacaacccagaggaaattcccattagtggaattggctttggcaaggatggtctggctctggatgacaaggtgctcacttactattgcagtgtgaatgaatacaaagatgaacaaccattgtacatgtatggaagatttgatggagagagtacatctttgcggggaacagaattgccctttggtgcccttatcctgctacttgttttgaatgggggacttgttgttacgtagcttattacaaaagaaaatagcaatatattttctaggcgaaaagaaacattttgcaaaataagaaaaaacaaatagttaatttagagttagattatacttaaaaaggcagtgaaacagataaaagaaatacaaatggccaataaacaattcaaaaaaccttatttaacttcactagtaatcaaagaaatgcagattcaaactgttatcggcagcaaatgtatagggcatttcagtccaaaagcaattaggagaggcacagcagggtggatctccacacctgggaggattataggggccctgaacaggtgttggaaaacagagttacaaatatggaaagggagaaaactagaatacattctggtgttgaattagaattacagtatcaatgtgaacttgtgttttcaatgtacgtacatagaaatcgaaagacgtttacattatggctcaaaaacttcttacaaaagcatatgtaccctgactgagcgattctaatgggaatttatgttatgtaattaaaattatatgcaaagatgttgccatactaatacttattggaatgtcacttctatttgcaaaatcccaaattaatgacaataatgtattgtttacataataaacacaagtattaaaaatgatggtgtggaaatatgtatatttataaaaagatgttcatggcccaatactaaatggaaaaagtaggtcataatatgaacccattttttgttaaaatacatatttatacaaacaagtaaatgtatagaaaagaatctgaaaaaacatctccaaaatataattgtggttaacttggcattaagactatagtgatttttaagtttttctcattctttttgtttacctgtatttttaaaattatgcatgaagaatgtagtacttaggcaattaaagttttttaaagctctattaactcatatgtatcagatattgaatgtcatgacttggtaggttttaaataatttttgtcatgttattggtgtacattttcccttagagtcaacagaacccaatgttatattagttttcctttcacattctcttgctcaacttagaaagcctgtaactttcttaaagaaaagcattcagcttgtctcaaggcatttccataagttgatttaatcac

SEQ ID NO: 467306 - DNA, 499 bp, Homo sapiens
aggagatatacctaatgctaaatgacgagttaacggtgtctggtgagagctgctctctgcttccaagatgccgctgtaatgctgcatcctttagagaagagatgaagactcaacattatcaaaagacatactattcaggtgaaaaagggaataaatctgaagtgacagaattcacatataattcagacatacattctagcttactgaagggaaacatgtcaggtaaagctttcatctttctcccatgctggatacttcccgcccttgaacatcagactccagattctttggcctttggactcttggacttaacaccagtggtttgccagggactctcaggcctgcggccacagactgaaagctgcactagttttgaggctttggtgaactgtgcaaaatgtccatcttccagagcagaaaaaaggaaaggaaacacaaaggatagtgtaaagtttcaggggcaatatgtgtgaaattgctgattgaaattgctgattgc

SEQ ID NO: 467307 - DNA, 569 bp, Homo sapiens
tagagctgcccaagaccgtgggagcctaccccttccatcagcataccctggatagtgaggccctatgcaggtggacagactacttcaaaacccactggaaaacttggccctgggacataacaggaacaaaaagcatgtggtaccaggttggccgcagagggatagagcaacaagcaggctcttggagtccctgattccagaacttgcctcttggacagcatttctggacctgcctggggccagacgggagttcactggtctgaaggaagcacgggtacaaacaagctcagacagtgaagactgcaataaatacctaattctgcaatgcccagacacaaacaaacatctgaaagtattaagacaatccaggaaaataggccctcaccaagtgaatgaaataagacaccaggggccaatcctggagaaacagatatatgaccttccagacaaagaattcaaaatagctgttttgaggaaactcaaagaaattcaaggttcagaaatcaaagatgaataaacctcaaaagctaaaaggaggatgtcaaatgttcccagtataaaaaaatgat

SEQ ID NO: 467308 - DNA, 553 bp, Homo sapiens
tgaccaagctggtcttggcacgtccttgtggcagtatttaaagaaaaggcgttgttatcatgacggatgacagctccatgcgtgttactgcccctggaggcctctcagtgggagaagatgtggaggtggaagacagtgatattgttgattctgacccttatcattctgaagccaaaattcagcaaagaaacaacaacaacaaaagaaaacttcaggccaatatatttgatgaaccgaggtgcagaaacctcagcaaaatactagcaaaccaaatccaacagcatatcaaaagcctaatccactatgatcaagtaggctttattcctaggatggaaggctggttcagcatacacaaatcaataattgtgatttatcacataaacagtactaaaaacaaaaactacctgaacatcttaatacatttagaaaagcattttgataaaattcaacattcttttatgtaaaaaccctttacaaactaggcattgaaggaacatatctcaaaataataaagagctgtctgtgacaaacccacagccaacattatagtgaa

SEQ ID NO: 467309 - DNA, 689 bp, Homo sapiens
gtttatagctggtgaaggacctggtcagaggtaattgaataatgggagcaattcccccatgctgttctcatgatagtgagtgggttctcatgagatctgatggttttataagaggccttttcccctttgcttgccacttctctgtcctaccatcatgtaataatgccagagatatcacaaaagtatccagaaatattgtccacttaatttctctgacagtgactgtgttttctctgtgtttctattatccacctaatgggtgtgttcagtccgttgatgggtcacagtcaaatgatcacaaccaaggaagatttaacaaggaaattttattacttgcaacaagtaaggagaacatgggggataatttccaaagcaatgcctctccaaacagcaataaaaacagagcttttattgggctgcttggctgcatcattgtatgtagaggtggagtaaaggcagcacaggtgcagtaatcaataatgcttctgtacatccatgtacagaaaaaggcaaagaagcttctccctggaaaacaacattacctttggaaaggatttattgaaaatcatgaagttatattatttagaaaataaaagtttgtattaaaaaattatacaaccaaaatatcaatagttacatacatttgctttgacatgttgttcttaatggttgcttcacatgaaataatt

SEQ ID NO: 467310 - DNA, 1178 bp, Homo sapiens
ctaagtaaaacatccctgtgggctggatgtggcagattggcagggcagcataaacccagatggagaaagtggtatatgtgtggtgtgctcagtgggctgagagaccgactgatgatggagaatatcagagaattaaaagctgacagtttgtcaaccaaaactgagctcttctgtggcagccatgagaatgtctcagttcagctgcaaggattgcgactgaataagggcccagctgctggatctgaaatccatggctccaggggcgccattcccttaggctgctcccagccaatgacagtgcagcagggattctggggacacctggtggcagaacagagtaagtgcaagcaggggaactgccagacacttataaaaccatcagatctcatgagaactcactcactatcacaagaacagcaggcgggaaaccacccccatgatccaattacctcacctggtcctgcccttgacacgtggggattatggggattacaactcaagatgagatttgggtggggacataaagcctaaccatatcattatccctctgaattgttgggtacattcttcaatgaccaggggctttgggacatggagaagaatactcctagctatttgtactttgtttaatgctcagattattaagcctcatatatctaatatttgaaagctaaattttcttgaacatttaagaattaaatttaattaattacatttccccaaacaattttaaactgtaattacaaatatatttattagtatggttgatttctaagacatttcaaacacttcagatggtaaataaaacatacaaatgataataaaatgtattattatacctaaattatttttgagacatcagaataacaggctaaatttattatgtttgtagttgtttttataccttttttgggttatagttatttttattttaataatatcttgagttttcataacaatttttttgatacattcccaggattgcagtaatcttaccagactcaaaagaaaaatactccaaggttgtaagatgtggcttatcaaagattattcattagagcacaggacttgagggcttcttaggtgagtcaaatttgatccctggtcatgggggctgaacttcttgtttacagtaaagctccacttatcatctcagtaaaacttttcagatcattttt

SEQ ID NO: 467311 - DNA, 951 bp, Homo sapiens
cctttcctggtgttcaccctgtagcagtttcaggtgaggaagaagatttacatgcagcagttcattaagatcaatggcaaggtctgaactgatataacctaccctgctggattcatggatgtcatcagcattgacaagatgggagagaatttctgtctgatctatgacaccaagagttgctttgatgtacatcttattacacctgaagtggccaagtacaagttgtgcagagtgagaaaaatctttgtgggcacaaaaggaatccctcatctggtgactcatgatgctcacaccatccactaccttgatcccctcatcaaggtgaatgacaccattcagattgatttggagactggcaagattactgatttcatcaagtttgatgctggtaagctatgtatggtgactggaggtgctaacctggaaagaattggtgtgatcaccaacagagagaggcaccctggatcattcgacgtggttcatgtgaaagatgccaatggcaacagctttgccgctcgactttccaacatttttgttattggcaagggcaacaaaccatggatttctcttccccgaggaaagggtatccgcctcaccattgctgaagagagagacaaaagactggcggccaaacagagcagtgggtgaaattgtccctgggtgacatgttagatctttgtacataattaaaaataacatggcatgattaatagccaaaaaaaaaaaagacataggtgatcttcagcctgacagctaagtcctcctgcatctatgttcagaatgcttcagttatgtacttgtttaattaaatagaataggaatggcttttctcagttaggcaatgataaaactttctactattaggaaagtagagtatagtaacatcacgtatttaaatggaaaaatcagtataagctttggctttaaaaaagatgtatattttctagctct

SEQ ID NO: 467312 - DNA, 988 bp, Homo sapiens
aaaaaaaattccttgaggattcatgatgagaaggaagaagcagcagaagaagcaaaagaggaagaggaagaagaggaagaggaggaagaagaggaggaagaagaaggaggaggaggaggagaagaaggagaagaaggagaaggagaagaaggagaaggagaaggagaaggaggagaaggagaagaagaagaagaagaagaagaagaagaagaagaagaagaagaagaagaagaagaagaagaagaagaagaaggaagaagaagaagcagaagaagaagaagaagaagaagaagaagaagaagaagaagaagaagaagaagaagaagaagaagaagaaaaccgaaagaagaagaagaagaaggagaaggagaaggagaaggagaaggagaaggagaaggagaaggagaagaagaaggaagaagaagaagaagaagaagaagaagaagaagaagaagaagaagaagaagaagaagaagaagaagaagaagaagaagaaggagaaagtatccaatgtgggttgcatctgagactctgggagaaatctagaccgaccagtggggtcattctaacaatggtggacaatgattttccttcaaacagtagtaggacagcctttagcaaagacactgtgaggctgcaagaagcaatgaggtgggtgcgagggaggaactgttgagtctctaactcctgctctgcctggcatggaagcagatgtgcatgtgtaggaggatgcttggtatttaataagttgggtatttaataacttttttaaaaaggtaaaacatcatcataatgagactccgacctggagtctggtaaattctgatagttctcccaagccccaaacccctgaagtcttcccagccactgccatatgccattggcttgttaacagttgcagcctcttctcagtcacaagtttttgtttgtttttgctttttcacttttgctaacatttaaaaacttttaaaataaaaatttccaaaca

SEQ ID NO: 467313 - DNA, 936 bp, Homo sapiens
ttccaagatctgcaggacactgttcctgagaacgctcgctcccaggaacttctagtgtgcaaatttccatcatctcagcgtctgttttctggaaactcaaccatcatgttgtaacacgatgatagggagagacactgaccttcagcgcctcggctccagcgccatggcgccctccaggaagttcttcgttgtggggaactggaagatgaacgggcgaaagcagagtctgcgggagctcgtccgcactctgaacgcggccaaggtgccggccgacaccgaggtggtttgtactccgcctactgcctatatcgacttcgcccggcagaagctagatcccaagattgctgtggctgcgcagaactgctacaaagtgactaatggggcttttactggggagatcagccctggcatgatcaaagactgcagagccacgtgggtggtcctggggcactcagagagaaggcatgtctttggggagtcagatgagctgattgggcagaaagtggcccatgctctggcagaggcactcggagtaatcgcctgcactggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggaccaggaagtacacgacaagctccgaggatggcttaagtccaacgtctctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctaccct

SEQ ID NO: 467314 - DNA, 605 bp, Homo sapiens
gtgccgcctctcccataaggggtttgagcacacacagtggagccacacctctgttgcacatcctgtgttgggggagtcaggaactttcctgtttcaacaggtcctctgagttcccttggtcaatgggaaaacactgtccatccttttcctccctaaagcttaaccatctaatcagccctctctcccaccctgtaattgcatgctgctccagccagtctcttgccttcagcgttcttgagatggatggaaaccaggcaaagatgccagcaaatgcctgtggatgctctttggctctcctaagaacacttgttgttctctatggtctggaagcagcaccagggcctgtgatgtcagggctctgtaaacatccagccaggaaaaagggaacccacacagaatcccacgggcatctgagcctggagcagtctcagctgggagccactttgagagcccagataccagggatctacagacacagctgcagctgctccaaggaggaagaggcaagactgggcgctcccatgcaccctcgggaaggtgcttgccactctgctataagctgctgtggagactgagacacgagtgaactgccctcccccatgctg

SEQ ID NO: 467315 - DNA, 512 bp, Homo sapiens
ggacattcaggttacgtaaaaatgatacaaggctcagtcctcagaggaacgtttcatgtcaggccactaacttttggtgtggtttatgatacaaccggagctaacagatccaaacacaacagtggtgaaggctgggctttcagtgaacccatcaccaaaacagtgaacaccgtacccaacagaggcttccctcacccggtcctcattaagtctgtgcagtccagctcctgggatattgttgaatctgccttaggtaaacatttcctgcaatgttctgaaagaacagaaagctgccattccacagaacttacagaacaggctctgcagctgttacttgccagcttgctggtcaatattttccagctgccagcaagaactgacatggctctgcaagcaacagagagggaaggaaaatatgagagaaccatttcagtaccaatagggtctcagcaactgattggatatgggcagcaaggaaagccaggagtggattgattttgaggtattgaacc

SEQ ID NO: 467316 - DNA, 573 bp, Homo sapiens
caagtatttttttttttttgcctctgaccttctagttgaagcaaaattagttatcatcaagtgaatttatgatcgtggctgccaagccaccatttgccgggtccattacaatatcccccctaagcatttcaaatccatcaatagataacgaagacattgtagaaccctgttatgacaccaggttggatgaagttctcatcttcaaatttctccccatagatggacttgccaccagtgccattatggcgtgtgaagtcacgaccctgatacataaaccctggaataattctgtgaaagcaggaacccttataactaaatcctttctctccagtgctcagagcacgaaaattttctgctgtctttgggaacttgtctgcaaacagctaaaaggagacgcggcccaagggctcgccgtcgatggcaatgtcgaagaacacgggttgcccctgccgtcctgtgaagccttgcaggcccatgttcccttccacaagcttcaccctccatattagggaactctgtggtttcctttactcacccttcacatttctgttcaattgctttccttggtaactt

SEQ ID NO: 467317 - DNA, 1912 bp, Homo sapiens
agtctctcctcctgccgcccaagatgccgaaaggaaagaaggccaaagggaagaaggtggctccggcccctgctgtcgtgaagaagcaggaggccaagaaagtggtgaatcccccgtttgagaaaaagcctaagaattttgtcattggacgggacatccagcccaaaagagacctcacccgctttgtgaaatggccccgctacatcaggttgcagaggcagagagccatcctctgtaagcagctgaaagtgccttctgcgattaaccagttcacccaggccctgggccaccaaacatctactcacaagtacagaccagagacaaagcaagagaagaagcagaggctgttggccctggctgagaagaaagctgctggcaaaggggacgtccccactaagaaaccatctgtctttcaagcaggagttaataccgtcaccaccttggtggagaacaagaaagcccagccgatggtgattgcacaagacatggatcccattgaggtggttgtcttcttgcctgccctgtgtcgtaaaatgggggtcccttactccattatcaaggggaaggcaagactgggccatctagtccacaggaagacctgcaccactgtcgccttcacacaggttaactcggaaggcaaaggcgctttggctaagctggtggaaactatcaggaccaattacaacgacagatacgatgagatccgccatcactggggcggcaatgtcctgggtcccaagtctgtggttcgcatcgccaagctcaaaaaggcaaaggctaaagaatttgccattaaactgggttaaatatacactgttgagttttctgtacataaaaataattaaaataatacaaattttccttcaagaaaattactgtaataaaacattgtgagactagcagaaggataaataaacagattaagggaacagaacgaacagacatcagaaacaaatcagcacatctagtcacctaaatatgatagagctacacttttaaactgtgaataaaggattgattattcaataaatgttaaacatttaaagaactgattttgatcagtaactgaggttacccccaagactctgcggtgctgggggtctggagtggtgtaggtgggagtggggtgaggtgtggatacaactccagcagaaagaggccaacaggctgggatgaagaatcaggccagaatcagggcttccagagcagctgaaattgaggaggtggggaggaattccagaaagaagagaccaacagagggagaacccccaaatctgtatataactcctctcgaattcttggctgactcctaagctgcaccagtacagggcaagactccaaggaatccagaggaaagcaagcactgacaagaggtttcaacagctgcccagtgctagagaaacagtgcagagctcagatcccatcaagtaatattaacttcttgtttgtcatacacaatcacaaatattttttcctggcttgtcatttaaattttaactctgcttattgcattttttcccataaacaagatttacagttttatgcatacaaacttgtcaatatttttcagtgtggctttgttttgctgaaatgcttgggcagtctatgaaattatgaaaatagactctataatttcttgattggtaggtttggttttgtttatattattgtttttgttattttgttatggctgattttttaaaactattaaatctttgctctaagttaatatccgagattttggcgaaagtgatatctcttataaaaatagatcagaatcagctctttaagtgtttaacaacatttattgaatgatcaattcacattagatgatcttgggaggtggacgtgggggatcaaaatgatgtgcttgtgattaaacttcctccaagaacaaaaaaaattctcaagc

SEQ ID NO: 467318 - DNA, 654 bp, Homo sapiens
gtgtgaaatcgtaggcttctggtccttggggagaagctgtgaagtttttgctaccagaactaggattctaggaggcttttagatgaccaggaagaggctgagactcctggtggggactcctgctgggaagtttctggaccacagccctcttggtatgaagagagcagaggacaggaccaggctagagcatctgcactctggagctggaaatggggcccagctctgggcctccactctcagtgtcaaatgtaggggcagccccaagcattggaagtcgccctgcaccctggcagctgcttcttgggctctgtctcccatgccgtgctctctgccccaacctcctaggaaggcccagcagcttcccaccaggccttcagcaaagactgctcctgtccctccagtgaaacactgccccaaaagtcacttgcccactcaggctgtgccgtgggggcagctgccacactctggggttccttggtctcccaaggagtccccaccctcacagagtgttggtcagctcttctggctctgaggaattgcagtttacctaaggaaatgggaaggccagagttgcagccaggtgccggggcttaggggtctggatggacagatttccatcctgcttcatttgtcttttacacttctcctctctgc

SEQ ID NO: 467319 - DNA, 1083 bp, Homo sapiens
gcatggtaatcccagcactttggcaggccgaggaagcccttgagtgaagggtagacggtggggctttgagggtcacagggcaagtgctgggcccagcatggccacggactgacttcaggaactcggacagatcacttctccctgcgcctccacctccccaccaccgccgtttgcacagccaggttcgggaactcctggccagcaggctgccaagcccccagctctgacggtctgagtgtctggtggaaagctgcaaagcccttggcccgccagcatgtctgacctgatgttttttgcccacttcaattcctggcatgttgtaatgatgagagatctggttatcctgggatgggacctggttcagtctttgacatcgtggccaacagtcacaagtaccccgaacatctcattccttccaaaatggggttgtcgcctgcgtgccttccttcttcctatgaccctggaaaagattgctccggaaggtgcccactatgtggatgggaagcatcagaggcaagactccaggcacatcagcgtgtctgtggacgtggacatgtggctgccatcttctgcctcttggtcagtgcatattagtggacagcacttagtagctgtggaggaagatgcagagtcagaagatgaagaggaggagagtgcgaaactcttaagtatatctggaaagcaatctgtccctggaggtggtagcaaggttccacagaaacaagtaaaacttgctgctgatgaagatgatgatgatcatgatgaagatgatggtgatgatgaagatgaagatgatgaagaagatgatgatgaagatgaagatggtggtgatgatgaagaagatgatgatgaagatgacgaggaaactgaagaaaaagtgccagtgaagaaatctatacgagatacttcagccaaaaatgcacaaaagtcaaatcagaatggaaaagactcaaaacctggctgcctgaagatctcagaacagcatctataggagatgcgcatccgatcctaggaaggatttctgatgctattttatctttagggacttgttactgggcttctgtctgccaagacaacagaaac

SEQ ID NO: 467320 - DNA, 1044 bp, Homo sapiens
gagtctggaggcatcggggttgaggagcagctctcccttgacgtttcagagatagcccatgacccacgaagatgggcccattgcaggatatgagggcccctgatccatggaacaggcaggcgaggcctctgagccagacactgctagtgaggacggatggatcctcccagggcaagcctgagaaaccaaattcttctgaagaggtccttctctatcttcttttcaacaatcaagtgtacagtaatggaactttgcaaaattccaaactggaggataagactgctcctcctccttccctgttctggctctatcttgccattgccccttgggctactcttgtcctgcttgtgggcacccttgtgtccgagctctgtcaccttttgttctttggacaggagcagcttccagacaagccattgtcccattgcgaatacaagcagtggggctgcccggcccaccctccccgggcagagccggacctgaatccagatccccttccaccgagttcccagcaagcgctgctcagtcacggtcaaatggacgatggctgcataatgagaaataactcagcccatcccgggaggggaccccacgatgccagaggcgtgtgaagatggtggaggacatggaggagactgtcacttggcagggcctgggagtaaagaagatcggctggggctttgggctgtgtcctgggtcaactgggtggtagaggtgggtacgattccaggccgggtggtgaggtgtgaacggagcagaagagctgaagctcctccccagcctgtctgtggagcagctgccctactctgagccccactgtttcagccccgccagtcacagtcacaaccttcctgcgctccgctgttccgaggatgcgcctctgtctctctttggtctgaggggtcctctcgggccagggcttgcctgacttatcaccggggtacagtgagaggcccagcccacactagcgctcctgtagttaatcataatgataacgccagtgccctgcgtcagcttcctatcatgcgaggaacaaattaccac

SEQ ID NO: 467321 - DNA, 1163 bp, Homo sapiens
ggccattttcacttcttttgtggtggaatgtcatcagttaaggtgggacagggcatattcacttcttttgtgattcttcagttacttcaggccatcagggcatattcgtgcaagtcacaggggatgcgatggcttggcttgggctcagaggcctgacactccccatttagaaagtagtgacttgctgtttgggaaagggccatggataatgggtgtttttaacttttggctgctactaaccaagctctcatatcctctgttaattttaaaacttcagcaagggctgcctgtgtttcttgttattgctggggatgcttggacagcattttaccctttggattctgggagcacagagcagggcggcagctgcacagcccttttaagaaggatatatgatccaggttaccacagacctcaccacttctcttactatgtcttaaacactacattcatctacattactcataatgctaagaaggcatttgagtctggaacccctggcctagaccttccaaaccaagactgggatggggaccatctcatgttggcacaactctatatacatcactgtactcaaaaaggctgttcctcctggaatcaggaatccaggaacaggaagcacaaagcccaattctgttaggggggatgaggagagaaaattacctttttattattttgctaatgattttgttctagaggaaaaaaaaaaccacagaataatttctatatgaaacttttagcatcattcagtagttttactgctaagaagcaattagttttacataaagataagtccattgaatttttcatcattcacctgtcgggtggccagttataaatgagagatttactataacatgtgacacaaaattccatagtaaaatagatttctcagagtttattaaacattatgcttagatctgtcacatcttgcaatgaactctgaaaatgcctttgtcattttccctgatggtaaactgatgaaaatccataggtgcttctgctttcatcaaaacctgtcccttggaaggagttggcatcaggcatttttatgttaatgtaaatggaagtttcggtgttagcatttgtggacattttgaatctcacctctcattttgtatcaaaagatggatggtcctctggaaagcatttgggaaaaataa

SEQ ID NO: 467322 - DNA, 1642 bp, Homo sapiens
ttgaagagaaagggggagaaccccccactatccagtttgttatgtcctctaatgcagcagtccccaacctttctggcaccagagactggttttgtggaagacgatttttccacagactgggaggcggggatggtttcaggatgaaactgtttcatctcagatgatcaggcattattagttagagtcgcataaggagcgggcaacctcgatccctcgcatgcgcagttcacaatgcgggggggtgggggggtggggggggggacgcactcctgtgagaatccaatgctgccactgatctgacgggaggtggagctcaggcggtaattccgcaggcctgccgctcacttcctgctgtgcgacctggatcctaatgggccacggacagcccgtgaaagcagctgcaggggtcgtaccctgcagagccacaggggcaaagctgcccaaggccttgggagcccacctcttggatcagcatgccctaaatttaagacatggaatcaaagaagattattttggagctttaaaatttgatgactgccctcttgggcttacatggcagctctccaagctgattaccagcaatatcttcattgctgcaccatatctcctggttgaaaatgacaggggcaggtcatgcaggaacagcattgccctctctttcacttatattgaccagctccctgtgagcaccattccttcaggtttcaatgaaatgaaaagaagcttctcccacactagaaggttagggtaccctgagttcaagtatgtaggtcacctgctaacttggagtttggtacaagacagctaaatcttagcattctttcacatattaagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgtctgtctattcatttagctatttcttttcttgtctttgcgatatttttttttaaagtgttttgtactttgctacatacccaaatgctcatggccatatacgttttggattagctaaagcagaccctattaatctgtgagacacagacccctacggaagtggttgaaagcttatttctaaaggcatttgaatccttatggacactaagcattatctgttcacaaaataagtaacatctcaaacattctattctaaacagttctatttttcaaatatttcaatacaattgtggctattaaaacaaataattatataacaacattactgaattagtattatctttctgtcagtactgtatgtattttctcaatagactaatattgcttggtgtctgtgaaacattgagtatcaaataa

SEQ ID NO: 467323 - DNA, 765 bp, Homo sapiens
agaggtttgagcagcagagcacggaagaagcgagccacacccccatcacatgccctttccgaactatgagtgagaacatgtggtgtttggttttcggtccttgtgatgctgtgggtctgttggagtttgctggaggtccactccagaacttgtttttctgggtatcaccagtggaggatgcagaacagcaaatattgcagaacagcaaatattgctgcctgctccttcttctggaagcttggtcccagaggggcacccacctgtatgaggtctatgctctgcccccagaggtggagtctacagaggcagccagccttgctgagctgcagtgtgctctgcccagttccagcttcccggggtgcttcttttacctactcaagcctcagcaatggcgaacgcccctccccctgccaggctgctgcctcacaggtcgatctcagactgctgcgctagcagtgagcaaggctctgtgggtgtgggtaccacatccacagtataatctcctggtgtgaatttgctaagaccgttggaaaagcacagtatttgggcaggagtgctttccattttctctcatgaagagtgtttgattctgggttatctgtgagtccatttattggatacttttgcataatatagtaaatatgagttcaagaattactgacattaacaattgtaaattgttcaaaatcaagaaccatcttcagtccagattcccattagatatcattttcttgctttgtatacactgtcatttttatttttgca

SEQ ID NO: 467324 - DNA, 1509 bp, Homo sapiens
gcaaacgctatccctttgaataaaggcagccttgcaaacagccagtctaagccatgataacaggagcagagagtcagcaagttcaagttcaatgtgggctttgtggggagcatgctgaactgccctcagacaactgcaaacatcagctctttttgcctgatggccttcaaattggaatatcagttctctgtgtgtgtcccataccaatggcccactctgcagatgttgaacataacagccttcataattgtggcaacatctgccttccggaccacacaattactgctgctatcactaaggtctttgagatggaaggtatttctccaaacagcaatatttggagctcctgtacagaaagaaaaaaaaaagacagtgaaaaatttatcttgaaattcatggtaaaaggaggattggaaccgatgaatcacaattatttatggttcctactttaccaagcactttgtacctacattggctgacaacaacaatgacatacaaaggtaaaagtagaaaatatagtatatgaaaaaggagtattaaggaaaattatgtttaaaggcctaaatatgaaaactttagagaaatcattgaacagaaatgtcacagcatgagggtggaccccaatggagggtgatatggcatagtcaatagctcttgggctgagcgtcttgcccttcataaggggcttcctttcaagtgggtggtctttacagattttttttgtaaagaagccagaaatcttttacgatgtgatatctcctgattgttaatatcactaacttattttaaaaattgaaaaatcagtagaaactcagtctttgtggtcagagaaatcaggaaaagaagcccctcagggtaagtggatgaataattcaaatgaggagagaatcttaattaatgtggctttgcactaagttttgaaatcaagaagtatgagtcctccgacgctgttatccttttttcgagattttttggttattctgtgttcttggcctttccacacgaattttaagatcaacatgtcaatttatgcaaaaaagccagcaggaattttggtatggattacgctgaatctgcatatcaatatggaagtgttgacatcttaacaattgtaaaccttccaatccatgaacatggaatgtctatttatttatgtcttctttaatttttcaatgatattttgtagttttcagtgtaaaaatcttgcacttcttttgttaaatttattcccaagcattttattcatttagatgtcattgataaagaaaattgttttggttttttttttagatagttcactattaatacatagatatacagttgattttgtatattaatcatttcctgcaatctttttggactcattcatttgttttcaagtgatttcaaacatattttgatttttcattcttagttgaatacattaaaagtctttttaaaactgcaaagaaatgttaaatcactcagtaatatattttaactaataataatttatgcacattgtaaact

SEQ ID NO: 467325 - DNA, 536 bp, Homo sapiens
tgcctgccagacctggctccactatcctcaaccagtgcctgaacatgccattttcaggcctagagatcaccccacctcatccaccacaattggcagcagaacactcctctcagaggcctgacgatgggcccaccttgcctgctgctaccaccacagtgggcacccacctgcatgcaccacctgctggcctggagactgacacacccagcccattgcagccactgctaacaccagcatgggccactcgagaatcagaaggctgtcccaccacaactactgccactgcccatgctatgcccactgtcccactcacttgctcatcacttgctcatcatttgctcatccacccaaggacctgcccactcaccttgctcatcaaagatgatgtacaggacaagtgtgtaaaatattcctttttgaagactttgccatcaaaccagagagtatagcaagctgtgtgctgaaaagttaaagtcttgtctaattctgaaagggcaatatcaaggtcagttttttctattggtgcaggctacttc

SEQ ID NO: 467326 - DNA, 849 bp, Homo sapiens
tttaccggaatgagggcaaggaacacctggaccgcccagggtggaaaatcgcataaaggcattcttaagccacatagcattttatttgacaagactattgcagtaggagggggggactattgtaagaggacaacacacagaccacaagatctgcaagagtctcaagagagacctcggatgtgtgatcatgaagggcggctgctccatatgccaatgctggctcaggttaaaggtcacgcaaatagtctcggtttccttggcccactagcaagagaacttccttattcatcggggatgcagttcaacccacaacagctaataagtggtgggcctggtgttctgaacactcatcagtcagctgcagagtggagtgtccatgccccagggaccagtaaagatgacccattggaagtgtgtgagcctcctgatccaccaagaccatatggtgtttttcataaaagagagagatcattcccttgactttggacttcgcttattgaacccctggacagaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaacttgttga

SEQ ID NO: 467327 - DNA, 478 bp, Homo sapiens
gaaaacgggccatgatgaagatggcggttttctgtgcgtggacgagtcagcttccgggtgtgactggagcagggcttgtcgtcttcttcagagtcactttgcaggggctggcgaagctgctcccatctacataccgctcacagtctactgatgccacgcttccactcaaatggagtgagcaagttcccaagactagtcttaccaagtttcaaatgtccggactccaagtaccagttccttcccagtgtttagcctctgtgttgatcctccatggaggcctgccacacactgctctggcgatgtgtcccactggggcaaatgcctaccaaggagcgctctcaggatccgcgtcacttgggctggtaggagtctgctgcagggatgttccacagggcaggcttaagtcgcctaaggagctgcctcgaccatccaccaatcacctcgcttcccagtcagggaaccaagaaatgtagcagga

SEQ ID NO: 467328 - DNA, 843 bp, Homo sapiens
aaacaacagcagccacaggttaaccttgttaaaaaatgtgtggtaacatctgggttggtttgttgccatggaaaagggtggtaatttccaagtgttgccattgcaatgtaagctgacatggtactggaggaaagaggaaacaatctctgaagaatcactatttcaggtaggaaaggctgaggaatatatcagcgtttgggggtatctgcagattagtgggagtaaaagagtggtttttcaaagagaagagaaagaagaggaagctgcctcttttcacagaaagtgtcaaggtgatcacaaatttcatatggaaattcaagagatccagaatatccaaaatgatcttgaaaagaataaatttggtggactcacacttcccgatttcaaaacttactgcaaagttacagtcattgaaatcagcctataccaaaatttagcaaaagtatcttgggagtgggagatgggaaataaaagcaaacctacagattaatttcattttacttatataaaaactttcaataaaatgttagcaaatagaatttagtagtaaaaaaaattataaaataggattcatctcagggatgcaaggaaatttatcaataaaatttaccacattggcagttcaaagtaaaaatacaataatagtgggagatatagaacttatttgtaagataactcattttctatttcctcctgtattagttttgttaaattttgttttttaaggaatttgtccatttcatctattttttaacagctttattgagatgtaattcacatgtcataaaattcacctatttaaagtatacaattcagtgtttttttagtatattctcagagttg

SEQ ID NO: 467329 - DNA, 817 bp, Homo sapiens
ctgaaactgtgaaggtgacagcagtcggttggaggcctcttggtgatctgcaaggcgttctcagatggctgtctctgagggcctggtccctcctttagcttgtcaaaggacacagagatgggtcactggagctggctctccttgggatacaatccagtcccctcagctagggcatttgtatcactgccctcgggtggagctcaacagtgaccccatggttaggccatctggaaacaggctgctgacacccgggacttctgtgctgccaggaagaacaaggcaggaggatgcgtccctgcacccaggctgccctccaaacctgtggaatgcagcccctggtcatagaggaggcccaactgttgctgacacgtatgggaatccagaggctgggctccccttcatacagccagggccccactcagacctgagccaacccatcatatgccagatgggacagagtgctcacatgggccacttgccggaccctctgacacttttaggaagcagctgctggcggtgcgtgtgtttgcccggaagggtgatccagggcttcatcaggcaaagcattggggatggaagttccggcgactctcatggcctcgcctggacttatggcaaatttcagcaagttgatgagaaaaatagagggaaaatgaagatataaacataaaatggagccagcagagactaatacagaaagtacatccttactttagtgggtcacaggattggctctaagcttcctagcacccaatgagatgaaagaaactgaattagttacataatgtaacactgttgtccatgaaataaaacaagc

SEQ ID NO: 467330 - DNA, 796 bp, Homo sapiens
aagcaaggacagtctaaaggccagaaaacagcagaatgttcttaaacaaatgtagatgtaagatgtcgagaaaatggaaaggaaggatgatggctgtctctgagggcctggtccctcctttagcttgtcaaaggacacagagatgggtcactggagctggctctccttgggatacaatccagtcccctcagctagggcatttgtatcactgccctcgggtggagctcaacagtgaccccatggttaggccatctggaaacaggctgctgacacccgggacttctgtgctgccaggaggaacaaggcaggaggatgcgtccctgcacccaggctgccctccaaacctgtggaatgcagcccctggtcatagaggaggcccaactgttgctgacacgtatgggaatccagaggctgggctccccttcatacagccagggccccactcagacctgagccaacccatcatatgccagatgggacagagtgctcacatgggccacttgccggaccctctgacacttttaggaagcagctgctggcggtgcgtgtatttgcccggaagggtgatccagggcttcatcaggcaaagcattggggatggaagttccggcgactctcatggcctcgcctgcaaaacagtttctgctggcttccgtccaccaaatcctctcttagataattttcctctgccctcaatcccctagattgaagagattatctaaagcctttctcttctccattcattgctctaggtcagactcaaatatttttactatttcccatttggacaatttac

SEQ ID NO: 467331 - DNA, 1874 bp, Homo sapiens
attagttcaccattaagtttgttgaagatcaggtgattgtaggtatgcagtcttattcctggttgcagcaacggcagtatatcacggaggggtgggacagggtgtgttcaggccagcatcaatggcatggcacagtggggtgcacaagctcacccacattgacaggggttgagaagcaaggtcctcctgtgcacgtgtgcaccggcaaagcagtgagagaggagtatggtgagcattgggagatgggcatccctggccatgctccactgcagactttcccacaccaaaccctatgggctctacacagactgaagccctgcccctactacctgtctagcagctctccccgccagctcaagtgtcaatggatgttgtgtattccctgctgccaggattctagagttccatgggttgctccccagctgcttaactcctcccttctccaggagtcaatgagggtcaaaaatgagtcctggtaatcccacagctatctgctagaattgcatggcctgctatttgctgaagggaaggagtaaagacaattctcaggacctgctagtttgctggctgctgcgttcacttccagtgtcaactagccttagggtatcacatcttcttatatatttttatctattagtatcattcttctatttgaataggttttatcatacctggtgttcattttggaaaatactttgaaacaattctttttcaccaggataaatacgaataaatatgtgctgacaaagcttggtttttcattataactaacataatttacagtttcaggatattattgcatatcagcctttcaaaatgttccaggaagtctcatgtgttataaaattattattcagtaattgcaccttcaagtggctggagtagcaaaatacattccctaagatattaggtataggatttgaaaccgataacagcgattttttgacatgtgcttaaaatacaggaggcttattttgatcataaaaatgttaagatatgtaagtatatttaatcctattgctttcctattttacttgtcagcttcagaaatgttcccttaaaaaattagcttaatagtattatctttataaataaaattctttatactttcatatttacaatttaaactgttctattttgttctcaatgacaaggttattacgaatgccattaataagtatgctatttcattataatttcatcaataattactatttttaacattttccaggcctgtcttcaagttatcttcaacctgaataaatttattaaaatttatatttaaaaaagtaaatatttatacttatttaaagataaaagtagtaaaaattaccaggaatgtaattaattatttgtttaatcttttttatatttccttaatccatatttaatactcctttggtatgctgtgttgaaagtagctactttcttttcagagaggtatacattttaagtacccttcagtccattttaattcatgaaagaactaggcaacttgaaaaaataggtaagcccttgttattcatattgccattctattctacaattctgctttccattctttggtctttggagttgtcactttaaaatacaggcttaaggaagtgaataactgtatctttcaattctgtttttactcatcaatattattcagttatatagtgtatatgcctaaacttattttattatgattattagttctaactaaaatgtggaaaagatatttttgtcttaataattgctttggagaagcaatatttcacccttatctacatgctcttctttttttccttttcattacctaaaatgtgactgtattagttcattttcatgctgctgataaagatatacctgagactgggaagaaaaaaagg

SEQ ID NO: 467332 - DNA, 831 bp, Homo sapiens
ctggagctgtgagaagagggtcaccatcctccagaaaccagaatggtagagccactgacagcttgcaccatgtgcctgaaagggatgcagacactcaacaccatcagctgtgggggcagaaccctgcaaaatcacagcggtgaagctactcaagacctcaggagcctaccccttgcatcagtgtatcctggatacaagagccagctgcagccaatgtggctgggtgtatacttgatccttgttttctcggagaaacctgctgcctctggcaatgggttgattcatgaagtgaacaatgatttcagctccctgctcagccctaagggagaatgggtgctccagatgcccagagatctgtctgggcatacagtggagagggctcctctgcaccaggatctctgcacaggaagggcagggtggcttaggctgctgaaccgggtgctccgaatgcctggagatctacttgggtgtgaagcagagagggccactctgcaacatgatctatgcacaggaagggtggagaagctcaggctgcagaaccaggtgagtgggtgctccaaattcctggagattggccttggcatggaatggatagggcctgccctccttcaatctcagcccatgaagagtggggtggctcaggctgctagcccatgcaagtgggtgcttcaaatgcctgaatttctgcctgagggtagagcagagagggtcctgcttcaccaggggagcagcctggggcattcagcaatggcacatgcagacctgttgcaggtctccaaactgcccctggctataagtctcaccatccagaggatactgtagctgtggcag

SEQ ID NO: 467333 - DNA, 2445 bp, Homo sapiens
tggggtttaccccgaaactgcatcacaacttgtattttaacaagatcctgaggtgtaggaagtatatgataaggagcagcaaaaggatatactctggatacactcccagaccccagcagggaaggagggaagccattctcaatcctacctcatagaggaacctcatagacatgtgccaggaaatgaccttcaggcctcacaagaaaaagcatcagaggatttacaccagatcattgcatctggacaatgaaatgctggacccctcatccatgatgattgctcccttgtctctccctaagcacgaacccaccgggaggaacgagcaactgcagacgcgccgccttaagagctccagcaagaccacgaacccaccagaaggaagaaactccgaacacatccgaacatcagtagggacaaactccggacacgcagcctttaagaactgtaacattcaccgcgaggctaaaatccgggttcttgtcacagaaccaggaataattaggcacgtggacacattgaaagaatgtcagcaaagctgttgcaaagacattgaatcacttctctatgcttttcagtttttaattggacaaactcaatgatgtgccagttaatgaatagctcatattgctgcagctaccagaggacccaaagcctcaatataaaaaatatctcatctcctatcttgtaatatttgttttatcaccaagcactcatccttccatggcagcatggaaggatgggatatgtttctgtggcaaattgatcacaaaatttatcatacatactgggatacttttgtaaaaggctgatgaaaatgatttgaatatattctcctaaattgtaagccatggatttccaagtaaatgcaaagtactaaaatataaagaaacaaatagaaacaaaattttaaaaggacaaaaaagtatctacttttgttttcacaaggatgatgatgatgatgtttataattatagtgataatgattgagtcagttaatccgtgtatctgtggtgtttaagtatgatggttctgaagacaggctgttggggtttgaaacctaactctactttttactagctctgtgacttttctcaagttaattaaagcctgtatgcctcagtttccttatctgtaaagtgaagaataagcatactttctttacgtgataatggtgaagattaaatgagttaataccttaaagtcttaggaactgtgactatcacatattaagtattaaaaaattcaacactattatgaggagtaatatgaaattatttaatgacgtgctatgctagctgaacttcagtgttcatcatttattagtgatacatatggttggaatatgcctgatgttgaattttcttataaccacactctaagataagaagttaagtacaaatgttttatttggagatgatcaaggaagcacaggtgttagataaagtaatacagcgattggaaaaaggccaataacctgtgttaatgagtatttatcactctcagctcagtcctgcttgggatcctctgggaatcaaagcagaatatatctcaaaattgccacccacacccacccataactggaaggctgggacatttgtccactaacttttactccactgtggtttaaggttgcctctaggagcattatccctcccttcatttctacaatgctagtgatcaacttttttgaattgaacttaactggagtcagtaaaaagctcgtccaatttatccagaatgcctgagaaattgaaattttttttcatactataaagaagttacataaagaacatttgaaacacaagcaattccaaatatgtattttgaccaaattactttgcccatgaagcagctccacataggtacaatattgagtgtgtacatagaaaatgttagtaatcactagtgctaaagaagagaacagatatggagatagtcgttctgcagtaatatcatactttttttttctaaaatgtataaggctgcgtaatcctttgtctccaacaaacactaaaactcttttaaagtactggctatttttatttggcctcatccatttatgtttttggtttgtttgtttcatcttctctaatagatcataagctactttagtgaaaaaacgaggtttctttcactatgtcatggtagaacttagcaagtgcctagcaagctgtgtttaagtcagtgagtaaagaaggatggaaatagcatggaatgcaaataaaaaaactagcatttaaaaataatactttacatttattgagtgctttatatatgttatatattttatttttatcttataatttcatcatattaatcttaggtaagcattattagctctattttataggtgagataattgaggcttgaaatgggtaatgtgctcaagttttcatagctagaaaatatcaaagcctacactttaaaatgtatatttttaaaaaa

SEQ ID NO: 467334 - DNA, 750 bp, Homo sapiens
cctggattgccaagttccccattgggagtgcatatcccagaggcagtttctcttcctcttatgctctggggacttgcagtattccacttggctcacagtgtaagctgcagcctgctgcttccttcaaaaggactgtggtttctttcagttttccctctatctagtaaacacactcatatcaatatgttagaaaccatcaacacaaaacacattactgacagcagaatttcagtgcctcgggaacagacacaagtggatggacatcaagaggaacacgctggcagatgccagcaggccatcgatggtggaacaaagcggactccgagggaaattcggcctaggacaggaaggaaccctgggatacagaaagccctctgtccttgcaataaggcagaaggtctaattgagcttattaacacaagctacctgcagatgggaaagctgaaagagcacactgtaacacacgctcactggggcttcagaagctgtaaacacaaccctagacgctgcacccccaaattgcctgtcatcaaatcaaagcagtttgtacataagaagattgccttacaacaagtgaaaatttaaagcattatcttttgtttaaataacttagtagaagagctagtttttatgtaattatttgtacaatcaataaatgtttttaaaatacatatttaagttttaaaggcaaggagtgggaaaataagctagatttaatttagtcttgtagtcttttactttcagatttaa

SEQ ID NO: 467335 - DNA, 6410 bp, Homo sapiens
agaaaggagtcactttgagatctgcaagtacttgcagtaagaagccagtgatgtgtctgagagtagtaaatgccaaggatctgtgtctcagcccacttgggctattaccacaagaacaccataaacaataacaaacctttacttctcacagttctggaggctaaatccaaaatcaagattctggcagatctggtgtttgaaacatcaaggaagccagtacagctgaagcagtgtgaagagtcggggaacgtgcaagatgagtcagataaatcaggtgaactggcaggacattgtaaagacattaagtcttactttaaaacgcataagattaccaaggaagaggccataggtagagtaaaaacaaagggaaaaggtataactaaccatatggagaagtttgattttaaaagaaacaataaagaaagactaacaataccaaccactggggcagtagttggcagaagatggagagttatgaaagtggaaaaggatacaagttcttgaacaaataagaaaggagatttaaagaacaagtgaaagatacgttctcagaaaggggcatagggagcttctcggtggtaaacaaggaaaggaagattatatgaacacaggtgcagagaggtggagagaggttttggtgagagctaaggtaatttcttttcagatggctcccattccttcaatgaacatctcatctgctttatatactcatgtgtaaaaaatatgttttacaaatgtaataaaagcaagctaaatatttggaggcttacctgttggaaaagaagactggaaagaaggtagtgaaggcttgagaagaaattttgaagtggttggcttaaaatagaagaataaataaactataggaaagtagtaatgatgggtatctctaagcactatgaggttaatgttagcacatttagcaataaatctgtcagttctagtctctctacatatgcaaattcagaaacttaattcaaaaggaaaaatgtctttacaacttaggtatttcagctataaattacaacaagaagatttcagtcttatatgctatgaaatagaattttatatataatttttaatataattatatattatataattttataatataacatataattgtgtgtataattatataattttatatataattatatactatgtaattatgtataattatgtaattttatatgtaattatgtactatacaattatacataattatataccctataattatatactatacaattatatataactatataccctagaattataaatagaatataattatataccctagaattatatatagaatataattatataccctagaattatatatagaatataattatataccctagaattatatatagaatataattatataccctagaattatatatagaatataattatataccctagaattataaatagaatataattatataccctagaattataaatagaatataattatataccctagaattatatacagaatataattatataccctagaattatatacagaatataattatataccctagaactatatacagaatataattatataccctagaactatatacagaatataattatataccctagaactatatacagaatataattatataccctagaactatatacagaatataattatataccctagaactatatacagaatataattatataccctagaactatatatagaatataattattaccctagaattatatatagaatataattatataccctagaattataaatagaatataattatataccctagaattataaatagaatataattatataccctagaattataaatagaatataattatataccctagaattataaatagaatataattatataccctagaattataaatagaatataattatataccctagaattataaatagaatataattatataccctagaattataaatagaatataattatataccctagaattataaatagaatataattatataccctataattataaatagaatataattatataccctataattataaatagaatataattatataccctataattataaatagaatataattatataccctataattataaatagaatataattatataccctataattataaatagaatataattatataccctataattatatatagaatataattatataccctataattatatatagaatataattatataccctataattataaatggaatataattatataccctataattatatatggaatataattatataccctataattatatatggaatataattatataccctataattatatatggaatataattatataccctataattatatatggaatataattatataccctataattatatatggaatataattatataccctataattatatatggaatataattatataccctataattatatatggaatataattatataccctataattatatatggaatataattatataccctataattatatatggaatataattatataccctataattatatatggaatataattatataccctataattatatatggaatataattatataccctataattatatatggaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctataattatatatagaatataattatataccctattattatatatagaatataattatataccctattattatatatagattataattatataccctattattatatatagattataattatataccctattattatatatagaatataattatataccctaaaattataaatagaatataattatataccctataattatatatagaatataattatataatatataactttatatatttttataatatataaaattatattttaataattttatatattttataatatactataatatataatgatatatacttttataatataatatataatgatatacaattttgtaatataatatatcattatatatataatttttgctatttattgcttgtctgcctaactctggtctttcaaataaccacatataccatgaatctcagctgatcatcatttctttggcaatcctttcactaactctgtcacgtgttctgttccttctcatatcccccttctattattatatatttctctttatgggcttaatttatgttgtctctaaaacatagtcaatagaatgaataaaacatgttaaggaaccctaaaccagtcaagatttatttccaatgattactcaagttgaattaattatcatgcctattgtgaataatttataaaccaagaatgaatagatcattaattcggatgagttcctgtaggtttgtaaatcattattcatgagtgataattatataaagaaagggctttgcacctcattggtgcattatcacaaaattctccagcagcagttgagaaagagctctaaccagaaacaagagtaaatagatgaccaagggcctaccacagagatataaatttgtttatttctgatctcagagcaagaccatggatattcatttgaaaagaattgtaaactcctacaaaacaaagctctctttttgacatctctgaaatcttgctccatctcctttgcccagtatagctctttgtacttaaaagctactcaatagttttgttcacttgattttttaaatttgattggttggtgattgcaatcatgtcaataaagcaagaaaagagaagaatgcttaagccaaggagtgcaatgcctcccagcatagaaatattttaaaatattgaatacagatttcatctacatgcatatttaatcaaatttgactctgttggtgtgccctagtctagtatcaggtggtgtgcaatccagctaatcaggcaacaggtttgaaaacgcaataaaggctatgttaactataaagcaaaactaccaaattttctcgcataattttaaagcaacaacttttcatctttataacctgctaacagtttaacagcattcacaattacacttatgcggaataaacacaatgattgcctacaaggttatcataatgttaggatatagcaactattttccaaacaaaataaaaacaactacattcaacaatgcgatggtttaatattatcatgcaatggtttaatattatcataatgatgcaaatttcttaaattaattgaatgccatttattcagaatggaaaacaaaaatacattttatgcaagcaatatttttacatatactggcatcgagtattattctttgtttacctgtaagtgtgaaaaattttaaggtactttgaggagcttataaataaaaaacaatgtgtgaaatatatttagtttcatttctgagttaagtgcatttattgaatgtcaacactatggtgagtagtaactttataattgtgtttaatctggaaacatttattgattactttctctgcacaaggcagaagttttggagccacaaaattaaaccagataagttcatctttcaagttgcctgtattatattagaggagacaaatgaatatacaatctttcatatacgtatgccttatcaatcattgaaaatagccttgtctattttaaaacaaaaattagactatttaaaaagttgaatattcataaattattttttctgataatgaaagagaactttaaatggttttcttaaagcaaatcatttatcaaaggaatcaaaattttaaatggctcaaaatttcattcagaactaatgacaggctttactaaagtcattttataccatgatcgcaagcgatttattttccactgttatcttctgggacttccctacatataccccggaaacattagaaattcagtctctgttctctgcatgcatactatgctctgctactttgtttgacactttgcttagtctccttctaataattaaggtgtttttaagcactcataaaaatccagtcaatttttcaatagtatatcaatgaaggattttatgatcttataattcatttctcaaaatcctagtaatgtttttttaaagtctctcccagggcacttattttgtaaagttaaagcattttgtactgtgttttttgtttgtgttttcatacctatcttagtgggtgtgaagtcacatctcattgtgattttgatttgaatgtccctcatgactataaataggaggggattcccctctttttatttttgaagagtcacgcttctggctaaaattctaggtgtgactttcaggtctggccaagggcaattacaaggcatggtgtgtagccaatgcatcgcagtctttgaagggaattacgggccaggattgaggcccctctttccaaccatgctatcctacatacctgctttcttagcctaggagctttcatctggaggtgtgtctatccagggctttcagcagatgccttcctcaggtgcctctgtcaagatttccttatggggagacagaaaggacattgaagacacttttctttaccccactctgactgaagtactcagaactttttaactcttagctttttaccttcaccttcctctaccattctcatcaacttggtccctgtgacccataaaatccttgttctggagctcctttgctgtgagacaacccctacatctgtgctgatcctctactgacacattgttccatgaggaaaatgcaacactgaagagaatcagagttttctctggtttagccttttgcttatactactgcaataagtgattaaaggcttaattgctcctttcattttgccttgttgtcttggttactctgatacctggtaacacaagattctccagttcagccgagctttgatgaaactttttacctttcttgagtcttcaaatacttgcaagtgaccaccttgtgtcaaacactttacttggtattacgtggcagtaaggaactaagaatatagtatcagaaacactcaaataaatcaatgtttgcagg

SEQ ID NO: 467336 - DNA, 2208 bp, Homo sapiens
gttttggtccacaggccatagttttccaacccttgggttgaagggttggtaatctgctcaagtttcatgtgggacctagatgacaatgggctctgtatggggagagactacagcataagctgttctggacttaaaatatattattcagaatatctaaaagtgctgtatcttgttgcagatatccacgactgttacagatgcttcgtggaggttcaaaaagactacagatcaaggccagtcctgaatctaaaattgcagagcagaatactttccccctgtgaggaagaattctcagaagagataggaaaacccgcggaattctcagaagagataggaaaaccattcaaaaatcctcatatagaggattatgagaaagcagagctcttccaggtgtgttcctgtgctggacaaaaccagctgcttgatgcagctgctagaataaaactggctgataaagcagtattggtgacagtgggtacttccttgccttaattggatagaattccaagtgggcattgcacttttaagttagaaaattatcaggcactaccacttccaaactgtttaccttgagactaggcaagtgaaattgggcaagaaatacaaattattttagaatggaagagatgacatttccaaacatggacttaagctacaaaatataaggttgaagaaatattaaatatataacatctaatgtttatgtttcattaaatttgtttatcttaaactgtgcttcttacttttgttaatgattgttcttgtggagacatctgcccagaactctgctacaaatacagagtgttggcaggagaatatgaataaataaaatttaaaagaaaaattatttattcaaaagtgaaaatgataaattcttttaaatacaactcaaatcaaatttttcatgtgcaaacaagctgttttatgttttgtgctgttcatagggcaatgataacaatgttatataacaaggttatataaactgtctaacaaggttactttaaaatgtattatcctggatgtgctttagggatgcagtatattaccaaatcactttaacacaaaaatttgaatttttgaaaatgtttaaaatatttttctatttataaatgattaatattgtagtagaaatagaaaactagaataatagcatagtgccttataagtcggtgagtgaaatgattaatatcagaaagggggcttgaatagacagtgaagttgtagaatagctctggaagagaatggaagatgtagtacaacaagaacacaagaaaggattgataaggagcaaaagactttccttgaattgatgacgatgtattgcaaatgttatcaatccgtgtctcaactttactgggaaatagagtttgctacaatgatgtcttcacatttaatagcaaacagtttgagaaatgcaatacatttatcatagcatggctgtacgttttatctaaacatttccaataccaacggatagtttcataaaaacagggtccctcttgccacgagaagtaaatttcagaatattcctgctaagcaattagcactgacagttggctttactcctttcacttggacacattgtgtaaaagcttttctgaaaagacttggttgtggttgattgttcacagttttaaggacagaattatttagctggattgtttaggactagggcaaattataggtttgagaatactgtccatttatgacagttctttatggtaccttgtgatatacttcactaaagacattttagtttttctataaaatattcattttgataaaataacatatcagcttttcaaatttccagttatgtgtatgataatcagtaaatctcataacctccatttttgcatatttgcttttatttttgcatgaagataagcagactataaaataaatatgaatccatattcttgcagtataacaggagggggtcctgctatcatgaactattttctctcttgatttcattttttgtatacatttttttccagcattttaacatgtctcttctcaactcatattgatactaaacaaataaataaaaagctatgtcaaagttcttttttccataaggaaaaagaatacctaaaaataaatgcataaaccgaacactagattttgctgtagctatttttcaaaatgaagtagttatactaacttaatggctttaataaactagttttttggagggttgtttct

SEQ ID NO: 467337 - DNA, 626 bp, Homo sapiens
tctcccacagtgcagcggcgggctgaagggctcctcaagtcgcctaagtgggagcccaggcaggggaggcgccgagagcaagcgagggctggcacctcacaatgttgtcagtggacctacctatcttcttgagacagttctcttattcctccatttccagaaaactgacaatttctacgtgtctggtagacaacacagagatgaagagagggccaccttgccttctgccaggggaggatgatacaaacctttggttctggtttgcttccacctgtaaggagctgtgggaagaggttcgagggagaactgagcatttcagtggatcaaagacatgtcttttacactcactggctgctgagcccaaaacagaaaagacgctgccacagggagatagtgcagaagccacgatagaattcacaaataacttgccagttttgaagaagataattgatgaaacagcaatagaattgaagtgtacctgcagtagaattgtagatgagagaaaaggtataagggatagaaataacatgtttggcacgaaggggtatgccttacagcagagagttggagataagtatttattatttgtcaacatgtaggtatgttggtcctcacactcttgcctt

SEQ ID NO: 467338 - DNA, 819 bp, Homo sapiens
cctgtccaaatggaccaatcaggtctctgtaaaacagaccaatgggatctctgcaaaatggaccaatcagcaggatgtggcttcacttctaagccaaaaagaccacgaacccaccagaaggaagaaactccaaacacatccgaatatcagaaggaagaaactccggacacgtcgcctttaagaactgtaacactcaccacgagggtccgtggcttcattcttcaagtcagtgagaccaagaactcaccaattccggacacagaagtttattgggcagtgctcttagaaacagccatcttaaggggaggaagctgggaaggattcgttagtgacattctgtcccagtgcatcagcaagacaatggggcttaataatatattgccaggtgtaacatatcaccgagcactggggcgaggaaagaagtcactttaatcaattattagtgctatgtttcatcaaggtgtcaccagttggctctcaagaacacaaacctgtgtaggagaggttataatattgttactttcattagtagtatctttgaattccaggtgattaaaaaaaattgttaaggactcttcaaaaatttctgtactcacagagaaatgtttagctatacacaggggccaggtccaaccaatcacaaaacctcattaacaggtccttatgtgtgactttccctgttgtctcagatttctatatgaaactggaaaatgaggatagcagacaatatttgcctacacattctgaaaaatataatgtaatgtaatgtaaagctaattaggctttgtggatagatgtttcaaaactttaaagtaaaac

SEQ ID NO: 467339 - DNA, 2297 bp, Homo sapiens
agatgatattatattaagtgaaataagtcgggcacagaaagataagttaatctcatagaagtagagaatagaatggtagctaagggtataagctccaaaccctcatggcttatatgtggtgttgggcctgtgtatgcacagaagtcaagaattaaggtttgggaacttctgcctagatttgacaggatgtatggagatgtctggatgtccaggcagaagttcgctgcaggggtgaatcctccctctgttaggacagtgtggaagggaaatgtggggtcagagcccccaaacaaaatctccactggggcactgtctagtagagctgtgagaagaggaccaccatcctccagaccccagaatggtagatccactgacagcttgcactgtccacctggaaaagccacagatgctcaatgccagcctgtgaaagcagccaggagaaaggctataccctgcaaagccactggggcagagcttccccagactgtgggagcccaccccttgcatcagcatgacctggatgtgagacatgaagtcaaaggcgattattttagagctttaggatttcccataatccccatgtgtcgtgggaataactcgaggagatgtaactgaaccatggaggaggttaccttcatgctattttcatgatactgtcagacctggattttagagtcaatatttgccctattctcttctccctctgtcctttatccctcacaggtatttttctccaacataatccttacatgaaaaattctatcttagcatctgcttcttgagtgcctgaaccaatttaatttaacagtcagtaaattttatttcaacaatgtttttattatttctcaaatttcatttaaaaatccccttctttccatggaaaaaaataaagcactacaaaaatagcaaaatcaatgtataaaccaatgaaaccaatgtaacaacacttgggatggtagaagaaaaggaaatgcggaaaacttaaaatttggggtgctaggaatcttttctaaataagatacattttatatacctttttatgtaggagaaaaatacatgcgcacatatacataattccatattcaatttcaaagtatttgtgctgcagtatatttgtctctaactgttattctttcaaatataagggaccaaatgactgaaatcatcattggtcttcaatgtgaataataacctgtatttgactccaactcttacttgcagatttattttatatgtctacataataaagatgatcttattctctcatttatatctacagtcttcagaataactgatctatattgtgactttcaatgttaataaactgcacgctaatgaaaagacaatgttacattgatattctccataacaattgcaggtacatacagtggcattaaataatggtaatacaaacaatgaagaaactgctcacttaaacattcaaacatcaaaatatcttttacatgacttagtttcaatataatcaatttccattacttttttcatatgttaataagtataatgtaaaattatacagctgaactataagtatctttgactcactcttcatgaagcttttatgagtcttaatattaatgctatacagacagttgactaaatatcttaaataattcaacttttcaactggccttttaggtcatatttgattaaagataactgtttcaaaagtgacagattttttttctttttttggggggaaggaaatatgtatcaaagacctctgatattgaaatattaaagatctgagacatcattctaagagcatactgtttaaaaaagaatggttcaaaattctccaaaactatgaatagaaaatgattattgaaagtactggttacctaacaacaacaacagttaaaaaaaccaaaacactgcagataaagcctaggactataactgacatcctgtctaacagactattaatggttatattttaatattaatttattctttgaaatgcagagactggtattttgaaataactactcagaggttactcataataatattaaacaagtatgttttttggggggggttcttttcaacacaatctttttttccttttgggttgttcatatacttattttcatatattttgttcttttccagccccagaattctcagttttaacaatttctgaattcattagcctcattttttattccctcctctctttatttgacttagatctcttagtccacagttttcacaccatattccatttttctctttttggtcttttgcctttttgtgtttgtgctgcatctgtgtggcgg

SEQ ID NO: 467340 - DNA, 571 bp, Homo sapiens
tggcttatatccaaaaaatagacaataacaaatattgacaaagatgtggagaaaagggatactttgtacactgttggttgaatgcaaggaatctgtggtagagagaattctgaaatgccatcctgccaaggtttctaccctctggttaggtgccccattctctctcttctggagtgtgggtgggaacacgaatacaatgcattccgcttccttctcaggggattgattggaaaagaatgggaatgtgcaacttgtaatggtgacgtgtgggaggaccctgatgatgttggagacactgagtttgtaaactctgatgaaccttttttgctagaagaaatagcttccccatccccaatagtggcaacatcccctccccaacccatgctgccatcagcctttacacatttgtttgaggagataaactctgcactgcctgagacaacagtgatggcctccaccaaggaaactaaagtactggtggggccctagaggtaaggttcagagtgtgacccatgaggaggtatgctacactagaaaagaactgcttgagttttctaatttatatgagcat

SEQ ID NO: 467341 - DNA, 514 bp, Homo sapiens
tttataatctccttagtgagcattggagtcacttggagagttgttaagatggactctgcagactatagcagtttgagtccctgggaagttgctaaaagcaccaatgatggtgtaaagccaggaaaggctgcaactctttctatgccccaaaaccaactgcgaagagaagattactccatgaactttggaggccatattgctacaagaagaagcttggagtcaatgaatcctatttctgtacttcctctttcaaaaatcaccctcaacagaaatcttccaaaagaaagctatgaatgctctaatagctatgattctaagtctgctcaagtgatcttgtacatggtgaaaaccctcacgcctcaaggtattgtctccaaagaaattgtctccaaagaaactgttccgacttcgaaggcatattttattaacctcaagatggaatatgtgaactgtagacttgggagcatttgtttgacacttcagtgaattcttatatacaggtactgccacgtgg

SEQ ID NO: 467342 - DNA, 3473 bp, Homo sapiens
gcacacgcttctcagacagttctcctctgttccaaggctggctgagactggacagccagtgagaatggacagacgtcttgtccagaagatatttgcacacagagctgtgctgtgcttggtcccagcacaccagggaccttgttccttgacactcctcatccggcactctgtagcctccaaatctcctggaagatgttgaggctctcgggcccctgggcctctatacctgccaaagtctccccaccttattcccccgcagccttttccacacctcctacctgcatttccgtgacccagtctggaaattcaaaccacacaagcctttgcctgtgctataaaaggagctccccgctggccccaccccctaaccacataaaacccccgatcggggaagaggttccccgatccctcaagccattgggtgtctggactggctgtgggcctccgtgctcctcctcagagcggtccctgtgtcagctgctcccaccccacatagagaggcagctggcaggtcctcctctctatgaccccttgcaggtcctgggtgtggagtcaggtgtcttcaagaacagaggcagtgggtctgaggcagctccccacttctggcatcagggctggcagctcctgggcactctgccctgctaaaccactggaaccaggtgacctctgactgtgaaggacagccaggccatctcaacacactgagtggacttggattctcaggctccagacactgcctcttgagacagcactctggctttgctagttggaaagtgcactggcagcctggggtttgttcttgatccacggatttgttcctgtttgtgtagtactaaagtcattgaaactagctgagtgtaacacagtgattttttaatgtctccttatcacatttttacatgtgtttattgcttagttcctgagggatgtattttttcccctttcatataaatacttgtgttgcctctttttgaagggagtttccttttattagactcagcggtttaatggaatcaactcttcagtgctcaaaactatttcaaaaagcgtaagcctcttttgttcccatccttgccctccagatgattctgattctattagaccaagagccgccagcctccacctgtaagttcagtacagagaacatgctttcaatagatcgcacaggttatttcatggatgtctattagaggaggatcacagtctcttttggatattttacatctagaagaaaaagcatttcccagtaggaattcatacccattatatggtccggggcttccccacatccttcctccttacagaagtgaggtggcatccggtactgctgaggctctgctttgaaaacccctggtgggttcactctggaggataaacaagagcccccactgttcacatccaaaatctttgggggaaccatagctctataggattagatatctgtgaaggtggaattctgtcaagggtttcccaaaagaaagattaggacatttggattagagcattcccaagctctatttgcttttgataagaagatttggcttatttatttatttatttatttatttatttgaatgcagtccccaagtccattgtatcattcttatacctttgcatcctcatagcttagctcccacatatcagtgagaacatgtggtgtttggtttccaattcttgagttacttcactaacattaatagtctccagtctcatccaggttgctgcaaatgccgttaattcattcctttttatggctgagtagtattccgttgtatatatatacaacagttcctttatccactcattaattgatggacatttgggttggttctatgattttgcaattgcgaactgtgctgctataaacatgcgtgtgcaagttcctttcttgtataatgacttcttttcctcagggtagatacccagtgatgggattgctggatcaaatggtagttctacttttaattctctaaggaatctccacactgttttccatagtggctgtactagtttacattccaccagcagtgtagaagtgttccctgatcaccgcatccacaccaacatctgctgttttttgatttttttgattatggccatccttgcaggagaaaggtggtattgtatcgtggttttgatttgcatttccctgatcactagtgatgttgagcattttttcatatgtttgttggccatttgtatatcttcttttgagaactgtctattcctaaaatcttttttaatgaagagtaatgcatattcattacagaaaagaaatgaagagcaagttgtctatagtgccaccctacaaacagaccattgttattattttagcatactccatttaaacagctttctctgtgtgtacaagtttatattacatgttttcatttagacatttcagtttttaaaaaaatattctaattagcacctttgacagtttaaaaaatgtgtttttcatcatttcacattatttccttcagatctttctttatcaggttactggtgaatccttagctgtggatggtggaggcagttttgttctgggcccttttgcatccacgttaatcttcatgagtttttctactcctaatgtactaatcagcttcagtccatgcttcttgatttcagaatacttgcttattttttatatgctaattccagagagttctcagttaagtggttccaaattcattcttgaatctataaaagttttctaactcagatccataggcattataaatgtattcctatttttctagctctacatattccattttaatactttagctattgtgcaactgttggaaatttaggaagtgtggtttcctttttgataacactttcttcaagataatttcctgcaactttcctgggatggggagaaattgaatataccgctttggtttttgaagaaagaatatctctgttggactggaagatgcctggaagattctccctaattactcaaaagtttctttatctctgttttcccccttttcttcagttttccattttccatttcatcctacctaaagtatatgcggtaacaaattctttgttcctgggatttgctgcattttggtgctcagtgttttacaagtactgtggaacatctataagagaaaatagagacatttattgagctccttccttgcatgattctcagcacttcctcgaggtgtttaaaatgtaatctttaccccagacgtctaaggtagacattatcctcccattttattagtaataaattaaacctcactggtgtatgcagaggaagagtctggatggagaacccagttggttctgattccttgatgagttcttgcatttttgtcagattgaatctttaaactatccttggattccttgagccaatgggttcctctctttgtccagcctggtttacgtgggtttctgtcatttgtaacctgaggaatcctgactaagatgtacttgtttaatcttccatt

SEQ ID NO: 467343 - DNA, 726 bp, Homo sapiens
tgaagtcaggcattttggcggtatggtatggcatattgttcctgggctagaaacgtgtatagtgtgtgactgtgctgaatactgtaggcaattgcagcacaatggactccgtgaggtactcagggcaggtgtggtggatgaggaattcaggcagaatagatccatagatatatccactgttattaagccagtgtttggggcatccagcactagaatcccggttctccagttcttggtctactgctccgattacgggacagctaccacagtagaagagatcaaattgcccttaaaaatctccagtctgatgtcacagaggcaaaatctgacttcaccaagagactccgggcctgaaatcccacaagatggagaaaggaagttatttggggtcctgagatttactcatcaatatttaaattcctttctatgtgaaagcaccaagctcactgtctcaagatgtaaagatgcatggctataattaatttgttccctcggagcaggagtcagagccctaggtttggggaggaaaatgaatgcaaagagcagtggatcactgagagctgtccttgggtggagatgccagttaggaggagagagattgagtcagggaagggcatgggggcgattctgctgagctccactgctacacttttttaagaaagatatcaactgaggatatttgtcacctgtttttcacaccgagctggcaaatttcagcattttcct

SEQ ID NO: 467344 - DNA, 513 bp, Homo sapiens
ctctctggcaaggaaagggtcatagccccatgagggcattactgcaaacaaagtactgcagtctatgtttggagcattctattgaccttaggtggtacaagggttttatcagagagtgtgaaaaagatgttcttaaccagagaggtgcatcagacatgggtgggagaaagcctgatcatcttgttttccctaatgacacaccagagcttggtgtctggtctgcatggcctgggaagctgatctgctgcttccttcctgaaaattgccctcatgtggctgagctggtggtcatgtcagaaatggaaaatgtgctttatggctggtctttgggacaaggcattctggtttgtgtggcccaacttggggaggaggttttatggctggtctttggaacaaggcattctagtttttgtgacctgccctggaggaggatgaacggggagagataggagggaaggagaaagtcagaaacttggcttcttcattttagggtggtgttttctgagccccaac

SEQ ID NO: 467345 - DNA, 756 bp, Homo sapiens
gggggaggcctgcaggccatctttgaggtgactcgtctagagtggagacttgatgggccagcgcgatgatccattccatccactcctttcagcacccgtggtcatggaggcagatggagcctccttgaccttcctgaatgaccatgatgggcagagacccccgggcttgcacaggccatgtaacaggtcctgctcctcagatgtggacatgcatgtgaaccacttgggaactggttacaatgcagattcggattcagtggctctgaggacacaacatgcagaagagtgccttcccccctgcagtatgcaacatgcagaagaacaccttccctccttctctgcagcatgcatcctgcagaagaatgcctttccctccactgcaggacacaacatgcagaagaatgccttccctgcctccgcagcatgcaacgtatttattgcatgcagaagaacaccttccttcccctctgcagcagcctctcgcttgccaaaaggagacagcaaaggagagtcctcaactcacctgcaggcgcccatgcagagtgggtgttcaacagacacccaagcctgccaatctctcttaactggtttccagttagatgctgtagttatagagcttgctggaagagaacccaggtgagaggaagaggtgagacactacatataaaatgcagacccgagagctttgcaaaggtgttgagggcagaaggcagtctggggctgtttaggttcatggcaaagagcattagggctttt

SEQ ID NO: 467346 - DNA, 615 bp, Homo sapiens
agagctcctgacctgaggtttgcaaagatctgtgggagaagcatggtttctgggtcgctcattcggtcattgcttctctgggcaggggagtatcccctggctcctcccagtgcgagtatctggctgtttcagttgaaggtgttgtattcactcgccccttctgttcctctccaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgctgttgtgttcactgacgtggaatggccccgcatggtctaccctggctagcttctctgatctcatgtcataccattgtccccttgtcaactctcttataccacgctggctgcctctcagcctggacaggccaagctggttcccatcgcaggatcttgctcaaaaatctgaaatgtagttgcaatgtaaaaatagttcttgttctgactactcaaatgttattttaatcatgtcgttttacttattgaagcaccacaagctgtgt

SEQ ID NO: 467347 - DNA, 516 bp, Homo sapiens
ttagggccattatgaacatgttacagtgctgcagagattgtttatggccagttttggggctggtttatcgccagattttggggggcctgctcccaacaggaagggctgtggtttccttggcaagcatggagattgaatccggaaaggaagaagaggagaaaaatcaaccaatgaaacttgcagatgccaataaaacaagcctcaataaatttaagaagattgaaattatatcaagcactctctcagataacagtggaataaaatcgaaaatcaactccaaaacgaaccttcaaaacaatgcaaatacacggaagttaagtaacctgttcctgaatgagcactgggtcaaaaacgaaaacaagatggaaattttaaaattcttcaaactgaatgacaataatgacacaacctatcaaagcctcttggatacagcaaaggtggtgctaagaggaaagttcatagccctgaacacctaaatcaaaaagattgaaaaagtgcaaactgacactctaaggt

SEQ ID NO: 467348 - DNA, 598 bp, Homo sapiens
gtcaccagcggaggccccccagctgcggaggcaggcatcctggcacctgccacccactatgccacagctgttgctactgctgctactggcactttccacaaagatgagaaggaatcagcacaagaaccctgataactcaaaaagccagagtaccttctttgctccaaatgaccacatcacctctccagcaagggttctgaactggattgagatggctgaaatgacagaaatagaattcagaatatggataggaataaagatcattgagctacagaagtattttgaaacccaatccaaggaagctaaaaatcatgataaaatgatgcaggagctgacagtcaaaatagccagcctagaaaagaatctaattgacctgatagagctgaaaaacacactacaagaatttcatagtgcaatcacaagtattaatagcagaatagaacaagtggaggaaagaatcccagagcttgaaaactggctgtctgaaataagacattcagacaagaatagagaaaaaagaatgaaaaggaacaaacaaaacctccaagaaatatgggattatgtaaagagaccaaatctgtgactcatttttgtccct

SEQ ID NO: 467349 - DNA, 1261 bp, Homo sapiens
tgtaaaaaaccaattagagaagagtgggtatttgtaaaataggtgaaggatggagatcaatcagaggaaagtgcaccaaatgggaagagaggttctcaatccagtccttcagctaaagactgggtccttgtccattccacgaccacgacaatttaggctcatagatggtttgaaggcgtgcttcctacccagccgtttgaattccaggttccacacaggaagaggaggagtcggactcctggctgctgcaaagggcaccaacttctgtattttcactccagtgcgcattcccagtgcgcaggctggccaaagcccaacccagagcaaggccctaactctccccaattttgtgaaggctgataatggtgaggaagctgcagaagaaaagtttgaagctagcagagattggtttgtcccgtattttagagaggcctgttctcctttcccccagccccaggcatgttcagtgtacccagaaatccggagttacctgcccaaaggtcttgatcgaatggtgtgcacacccctgggctgggcaggtcactgactaacaaaatgcttaatacataattctagtcaataaacatctgttaaatgcatgaatgaacaaatgaacaagagatggatagatggatgaacaaataatatctttcatgtagcatgggaacagaaaatactcttaaaagttttatttgaatctacctgttatattaatcactgttttctgaacttaacagacaagtatttgcagtcttcattttctcattcaacaatgaatgaactcaagctttatgctttacagtctaggaaaggggaagacactcagaacacaagtaaagaatttactacagggccatggtaaccccttaagtaaaacttcaaggcaaagcatttttctattaatgagggatctgcccccaagacccagacactgtccatgaggctccatctctaacactgaggtcaaatttcaaaatgaggttttgaggcatcaagcatccaagccataacagaggctaaaaggaaaaaaaaagatatgaatactgacttgatgttttaaacagaaaatagctatctaaatttctgccaggacactgacaatcgcaactagtgctgtcaaagtatcctggagaatgtcctccattctagatttgtctaatagttttctcatgattagtctggggttataggtttgtagaaaaaaagtaccaaacagctgaagcactcttctcatcatatcatatcaggatgggcatgatat

SEQ ID NO: 467350 - DNA, 630 bp, Homo sapiens
ctgccactgacacctcaagcatcattggatctgctgggccatatggcccaagtggcagagcagcttgcacagcagcctggacccattgcagacccttctcctgttctggacaccacccaaaaccggcagcctttcaggacacttaataaatgggagagtaaaggtatattgctggccttgccagctgaaggcgaattgcttctggtgggccttatggacagaaatggagaaaagggcatttgccaaatcaatggctgcataccaggtgctaagtacatctatgcaaattatgcattctggcactggggaaatgaccacaggatgagtccagggactcactggacccacttaagcacagagtttatctcctcggacaaaagtggaaaggctgatggcagcgtgggtcagggaggggatgttgccactactgggggtgggaaagctgtttcttctggcaaaaaaaggttcatcagagttcacaactcagtatccccagcttcatcaaggtcctcccacacatccccattccaagttgtaaggtcccattttttccaatcaatgtcctcactttaacagcagacacctggtgaggctgtgcatgcacttttcattgcagatcattagacgtac

SEQ ID NO: 467351 - DNA, 2536 bp, Homo sapiens
cagccactgctgagcgcccaatttgccaacagcagagaccagcactgaaccttcaatatggcaccattcctaggggagatcagccagctactcattggcaggttgcttatatttccatcattgaaagcacagagatttgtcctcactggaatagacactctagatatgagtttgcctatcctacacacaatgcttctgccaagactaccatccgtggactcacagaatgccttttccaccggctggggcaaagttctccggaaggccatgtatgctctgaatcagtgtccaatatatggtactgtttctcccatagccaggattcacaagtccaggaatcagggggtggaagtggaagtggcaccacccaccatcacccctagtgattcactagcaaaatttttgcttcctgttcccatgacattacattctgctggcctacaggtcttaattccagagggaggagcattcccaccaggagacacaacaattccattaaactggaagttgagattgccacgtggacactttgggctcttcctacctttaagtcaacaggctaagaagggagttacaatgttggctggggtgacttacccagcctatcaagatgaaatctgtctactactccataatggaagtaagaaagagcatgcctggaatacaggagatccctttggggcttgtcttagtatcaccatgccctgtgattaaggtcaataggaaactacaacatcccaatccaggcaggactacaaatggtccagacagacccttcaggaatgaaggtttgggtcactccaccaggaaaaaaaaaaacacgacctgctgaggtgcttgctgaaggcaaagggaaacagaatgggtcgtagaagaaggtaatcatcaataccagtcacaaccaagtgaccagttgcagaaaggagaactgtaattgtcatgagtatttcctccttcttttgttaaaaacatatttgttcatgcatacacttgtactaagaaaatatcttcattttatttcctttttccattatcatgtgatttaagatttactgacttcacattagcatttaagtgtttttaactttatgtaatagcatttggattggggattggtgcctttccagttgtatgaaggatagttgtaatatgttaggcataattatgaccttataattctctttatttgaagattatgtatgatctcaggaggtgtgtatggggtcgacttcagtgaagatcatgggtttgcatttaaaaatgaaatttcaagagcctttgagacattaagcaggatatggcagaaaggctatagatatagatatatagattgtgagttcagagaagcggtcagtgctgtagataaaattttcttatttttcttggtagtaaatgaactctaaaacctgagttagattatctaaggagaaggtttagagcaggtagtatgagaaccacagaaagtacagtgccaaactcaaatgaatttcaaaatttaatgtcaaggtagaaaaggatgatcttagaaagacggcaatgagaagtcagggaagcagaaataaaactgcagagccttgtaacagaaaaccagagagcattataccagataatttagagacaataatttaagtaaagaaagaaggaggcatgaaaagtgttcaatggtactggaatatttggaggaagaagggagaaaaaatataagttgaatttagtgagggcattggccaatggcttggccctgagagcctctagggggaaggatggtaatcaccctttatggcataaaaaactaaatataatgtgaatgtgcagaaaaggggaacaaaaacaatatataattacaaaacaaaatcttcaaaatatattaaaaaattcaaacaattcttaaaagcatttacgggcttaataaataatgtatattttatattgtatggttgtatataattgaactatttgaaaatatatcatgcatagaaataagagaaatacaggttattcagaagaaacgtcttcaaatattaagattatgtaaatactctctggatgagggagaaggaaggacctcaaagacaaagtagcaaacaaaaatgtatttatttatttaaatagtatttttataaatgatatgtgtactattctactaatgcattataccctctgaaaaacataatgagaatgtaaatttatatgtcaagacgtgatttcttgtgtttttttattcaccaaaatatgtgaagatctgataattagtcaactacactggtatagaaactggctctaacatataacaaactgacccacattaagatatcatatcaaagaaaaaaaaatcgtcgaatattttaaggtgatattatggagataataaaaataatttattctgtcatagcatgtggggataaaaagccataaaaaaggcaacttacagagtataccatttcctttcttcactaaatttgcaatatgctaacctgcttaatcattttcttaattttttttatttctgtaagttattggggaacaggtggtgttt

SEQ ID NO: 467352 - DNA, 1431 bp, Homo sapiens
agcgtccgcggtttcattcttgaagtcaggaactcagaggctggcgggatcctccatatgctgaacgctggtcccctgggtccccttatttctttctctatactttctctctgtgtctttttcttttccaagtctctcgttccacctaacgagaaacacccacagtgtcggacagcagacagagccccacaagagccagtggtagataaagtccaaaggcagtctgctggagaatttcctcttactcgaggagcaatacttcaagaacattcaatgggtcaaagtaacattggtggctcaggcttaagagagctgcagcttttcgaaactccatctctatgttttgtgaggaagaagccatgtggagaggcccacataaaggaaaacggtgcctcggcagatctaacagctgctggccatcagataactccatctggagacagagagatgggcttcagaggacccaaaagtcactattaatccagaaaatcacttctaatcttataaatgtctttccctgttgtcagacactgaatgtatttattctgcctgcaagtgtcacaagaagaaagtttgctatttattaagtcaatgtttacataattgaaaatatttttctttcttcatttttgttgtgctgtagttttactacactttagttactattcccattagcagacagagaaaatgaatcttggaacaatttgtattttttctcaacaaatcagtgtgaaaataaaacagaatcttgttaccagaggaatgaagcaaaatatgctaacaaacaaatgaactaaaacaaacaaacaaaaacctttcctttctaggtggataatgattcagcttctgatattctttcatgcacatgctactctatgacataacagtgggcagtacaagctcctgttttatgaggcataaatcttttatttatatgcacagctccctaattatgctgcatgctctttcaagtaatatttatatttttattttcattacaccagtaactagtacaatgattcacaatggtaggagcacacacaaaaaagtttatttatcaatattgactatatgacaggcgctgtcctaaggctaaatgatataaatttgaataagatctggtacctgtcctcaagcaatatagaatagagtctactgagatagcgacaaacagaattatattaatatgcccgagatctgtataacaggccgcaagaacctgaaataaatagtgcaatgatcttcagagatgatagggaagacatcctagagcatgagatagttgtgtatggtaaaaacaaggacatattaaatagaataactcattccgtaactgctagtctacaagggggagggataatatatactgaagctgagagagttttaagcaaggctgtgatggttaattttatgtgtcatcttggctagact

SEQ ID NO: 467353 - DNA, 947 bp, Homo sapiens
cacagctcggcctgctagtgcccacagacaggaagagttaaactgctgactctgaaggcagggaagagccagccatgcagctgtatgtgggagccgccagaataagcagccgagacagggcggacagtcacctggaaaagctgtagacactcaatgcagcccatgaaagcagccagaacgggggctataccctgcaaagccacaggggcagagctgcccaagaccattagaacccaccttttgaatcagcatgacctggatgtgagacctggagtcaaaatagataattttgcagctgtaaaatttgactgccccactggatttcagacttgcatgggccccaagtcaggtgccctctgtgatagggagaagcaggctgctgatttccgggtcaccagcagaaatttcagtcaggggcaggcagaatgctcaggcagtggaagagtgctgagatgcatggctcagtggcagcaactgctgcggaggccaaagggtggatcaccagccccgggttggggatggctctcagaacacctggctgcagccagcatgctcaagtgggagcagggtggctgggctgcagacctgtctcagagtcaggtcaaataaagcccgttgaccctggacttctcagcctccataattgtaagcaatgaatttcttttgtttttattaataaattacccagttttggatattctgctataagaaatagaaaatggactaagacaatattaaaaacagaggaaagtgtggatcttgagagttattaaataataaaatagttattaaatagtaaaagattggtaagagattaaggttttgaacatactaatgtacaagatttatcttaaatcaggatgaaaaaaatatctaattaaatgcaaaatcataaacaatataaaatagagaggtagagatcagacattgtcactttaccgactatt

SEQ ID NO: 467354 - DNA, 580 bp, Homo sapiens
caacccatggttgggaagctgtagctatgcccgggagtgtgggctccccctgccaacttggtagggtgtggggcccctgctggaatcacctgttcccagccttcaccagttccatggagcacaccgcagcagctgcacttcccctgctgcagctgatgtccttgcagaacttctccagatgggtggctgccaccatcacaaggaccttcaaagagtacacttcactcccctgctacctccactggagtaggtgttggtatccacagccccatccccaggggaaggaggagagaactacatcaagggagcacactgtgggaaaaaagaatttgaacaacagccctggagccccagatcttccttctgtcataatctacccaaatgagaaggaaccagaaaaacaattctgcaatggattcaaactaaggaaaaaatctcagggttgccagaaaaagaattcagaagggcaattattgaactactcaaagaggtactagagaaaggtgaataccaacttaaaggaataaaaaaaaaattacaagctatggacagaaaaatctccagtaaaatagatagcata

SEQ ID NO: 467355 - DNA, 774 bp, Homo sapiens
ggctttaccctgattgagctaaacaagggttggtgaatccagaaggacaagcacacatgtcaaatcgaatgtttctgcgggacaccttgtgtgtgtttctgcaacgccgcattgtgggtttggagggtcacccaacagcagcgttggtgtgagctgaatcctccggtgtgtgttatagccgtctgtgtttccgcacgcgtctgcaagctgtattatggcttctccaaagaaggaggaggacatggaggaggagagggagggggagagggaggaacgagaggaagaggaactgtccatggcaggacatggtgtggtcacaaccttgcctccggcacctgcgcggctgctgtgggctgagcatttggccatctgggccctgtgggctccaccttatagccccattcttccagcctccaaggagaaattcagtaacaacatggtggggacacaagttttcaaaagcgcttgtggaagaggtggtcccatcccacctgaagaatggggagaatcggatcctggtcccaggcagtgggcggtgggcggcgggcagtgggcaggtccgctggacctcggagtgtggcttctactggagacaccagctcagcctctgccctgggacttctgtttaaaaatgcaaaccacacagaatccattacctaaaaccttccactttgcattaaaaagtataattaagagttttaatgagttcgtgtggagctgcaggtgagtgtcattaacacatctcagggctgcagctggaacttttaaatggca

SEQ ID NO: 467356 - DNA, 681 bp, Homo sapiens
tcagagcccttcctctaagatggtggcagagaggggacctgggacgctatgcgcaggccacacacggccctcattcacctagctcagggccttcctgaaaatgtccccgctcaaaggaagatcatactgactccaactcccactgcaggagccagacacctgctgtccagactgttgggacaagagtgttgcaggcagcccgggggtcctggggggatgatccccatccagggccaaggacactttgagattcagcaagaggcccacctgctccaggctgcagctcctcagctgcctgattccaacaagcagcccggaccagccgcggcctctcgtctccctccttggcggctgctgcaattgtcctcattactgctgaggtttctggagcttcttcaaagggtggaggcaccagcgggcatcccaccccccttcagcaaggggctcacaattcctgcagctgagcaggggtcttcaggaccagaagtaaactgagtcaccctgttctaagccctggacgtctcacccctggtgtgcaagcttttctggagatgcttgttacttttgtcttttcacagaaggttgcataattcagggctcagccttcgtgttccctccccaagcaagcctttccaacccacgctaggtgaggtctgtctatgcagctggccccggctctcc

SEQ ID NO: 467357 - DNA, 1138 bp, Homo sapiens
aggccatttgttgaaagtcttgatactcagttctgcttcaattcattacgggaatgttgggggctgagggtggcagaacattccaggaaagaggaacaacccatgcaaaaatccggtgggatgaaaacaagcatggcgactttgaggtctgcaagaaggctgatgaaaagattaattggtttggggaaagctcaagaaatactagtcttgacagagtccgaggtcattccaaagctctcccaacacagaaaatgaggcagaccctcttagattttacacatttcacgaagtcttatatcacaagtgggaaaatagataattctggaggaatttgtatcaaagctgaaaagctgacatattatttgaaacttaataggatcaaacctccttccagcacagttagggattgggctcttgcaggtgctactgacactcactacaaaggacctgacacgcccacagaacatcaggcctttaaatcctcaatggacaaatgtggccttactggcctatgctggcattgaaacagatgggtcggggaagttagacaatgtttataagaatccatcaattgactttttcagactcatgattggctgactcatattcagccagggtggatgagcaaagctttataatattgtcgtaaggacaaaattgaataatattatcaaaggatcctgaaaggcattatttcaatgagcatttcccaatgaaaatattgctacatgattgaatgctgatggaaataatctattagagaagataaagttgaggatcttgaaggagggaagcagacaacaattgtagtagaaatacccctaagaggcaaaaggagatgggatctggtgcttaagaggaaggattggccttaggactgagacagaaaggacagaggaaggaaggccatgggcatagactgagagagtgaatagatgttgagaaatctcagacatgtttttatcagcagtatgaaaatggactaatataatattagattctaaaattggcagaatgaaaatagtgatatgaatggtctaacatgactgatctaattgtttagtatcaaaaaatatatatttcagttggtttatgaataataattatagctataatttattcagtatttactatgtac

SEQ ID NO: 467358 - DNA, 993 bp, Homo sapiens
tttttcattcctgcagcacaacatctgtcttttcttcttttgaatataagacgttttcatctgagaaaagtctaggtattgagaagacctatggacctgcatttaagtattcccagcaccgctgcctttggctcaggaaagcgtcagtgggtcctctctctgtttagaaactggaagcagtggcgccctgctcctaggctgtcatccacccggcagcaaagccttgactataggcacatcgtaaaacttcaaaagaacattcccatcccatctcgtaagcggggacttttgcaaagacaggagtgtagagcacagagagctcctcccaggactcgggacgccaccccttgctccctcttggctccttcctggcctcagctcctgccatacccctgggctttcactctcagctctgccttggtctgctcagccgtgtccctctggcacctggagagccagcacagggcatccagtcttcagttcacccctagagagcagccccacgtcacgcaaaggagagggagccatgtgattctcaactccgatccccagaagtaacctcaactaaatccctttctgttaaactagttgagaaaactcagattaaataatgaagatcaaacccgtttttcactccaatggacaccaacaccaaaaatgcagaaaacaagtagagtgacccagattgtgaggacgcttcaggcctttctttttcatttgttattcctaagccaccatttctacttctttcccaaaaaacatctccattcaccccagaacttgagcttatctaaggaagacacgggccctattgcaatttgtcatacttccacagatttttctcattgttttccctggatttcacatacagaaaacattttaagttaaggaatatatgtattttttctatcaaaaagtgtgaaaactccttaaactagatgggaagatatttaataagctgatattcagaaatgttggcaaaagttcactttt

SEQ ID NO: 467359 - DNA, 2817 bp, Homo sapiens
gaagctccttcaccagcactcctccctctgctcctccctctgcgcctccctctgctcctgcctctggtcctccctcagcttttctttccactcctccctccgctcctccctctgcccctctctccactcctcccttcactcatgcctctgctcctctcctttctctgctcctccctctgctcctccctctggtcctctctcggatcctctctccactcctccctcttgtcttccctctgcccctctctccgctcctccctccgctcattcctccattcatctctcttcttctccctctgctcctccctgaatccctctccctgctcctccctccgcttctccctctgctcctccctctgttcctccctctggtcctacctcagctcctccctcttatcctccctctgcccctctctctgctcctccctctgctcattcctccattcatctctcttctcctccctctgctccaccctcagtccctctccctgctcctccctctgctcctccctctgctcctccctctgatcctccctctgccccctctctgctcctccctccactcctccctctgcttcttcctctgctcctccctctgtccttccctctgcttcttcgtccgctgctccctccacttctccctccattcctccctccgctcctccctctgttccttccttctctcctacctctgctcctccctacctcctaccttgctcctccctctggtcctccctcaactcttctctccactcctccctctggttctccctctgcctctccctctgcctctctctctgctcctccttcagctcctccctctggttattcctctgctcctccctctgttcccccatctatccctctctctgcttctccctccgctccttcctctggtcctttctcagctcctcttcactcctccctttgctcctccctctgcttctccctttgctcctccctttgctcctccctctgcttctccctttgctccttcctctagtccttccttagctcctttctccactcctccctctgctcctccctctgccttactctccactcttccctccactcctctctctgctcctccctccactcatccctctgctcctccctctgttcctccctctatccctgtctctgctcctccctccgatccaccctcggcttctccctctttttctctctctgctcctccctccactttttcctctgctcctcccttcgctcctccctctgctcctccctttgctcctccctctagtcctcccttagctcctttctccactcctccctctgctcctccctctgccttactctccactcttccctccactcctctctctgctcctccctccgctcatccctctgctcctccctctactcctccctctatccctctctctgctcctccctccgatccaccctccgcttctccctctttttctctctctgctcctccctccactttttcctctgctcctcccttcgctcctccctctgctcctccctttgctcctccctctgcttctccctccactcctccctctgttcctccctctgcttttctctctgctcctcctttggcctctccctttgcccctccctctgtgctttgctggtgtaaaaacaaattctggtgacttttccaggccatgagttctgtctgctccacagacatgcagagtggaaggaaaaccacacaatacaaccaacgatgaaagaacgggggctcaggcacccgctgctcccgagcatccctgcagcactgacctttacccacggcgctgaccttcacctgggctgcataaagacgaagtcttatgggcctgggtttgctccagggagagggaagtgtgactctggggtgggccctggggaggcctggggtggaggcgaggctggggtcaccagtgtgcagacgggggagcgtcacggccatgggcacaccgatgggcactggaacactggggcctcacagaaggaaaaccccccagcgggcctggaccctgaaccaaagacgatcaacatggctcgcatgtccgtggacagtgtccactcctcagcctgcccttcgcggccacagggatgggctccttcttgcagctcccgcctgacttccagctgtggctgttctggagattcttgcagcagctgcagggacctgcctgttccagacaccttccctccctccagcctccatctcactggcctcatgttctccctgcctggactctgtgcacagacccccatggtcagggtcttcctgcctgagagggaacacctgcaccctgctcagggcccacctccttccaaatgccaggtaacaccactggtgccttcctgctgccccaggcagctgctgtcctggggtggggtccccccagcattgcagatcccacagggggtgctttctgtttgataagtacctgctggtagtaggttggtaaattggaacaagtcagttaaaaaggaaaatcataccaagtgcatagcttaagtcttttaagtcttggtgttgccatttggcggggagccgagtcctttcccaggtgagggtccgtggcttgaacctgcatctcctgccactcattcctgccatttcccttttctctgtcacctgtggttacttgtcaaggccagagtctctgtatcatgacctggaggttgatgggtcattctctgctacgtgacaagttggacggctcctgcagaaactgcaagtgctgtgtgaagctgccaggctttggggggttctgtgagccccttgccctcgctcccttcacctttcctgcccactggctgtcctcagac

SEQ ID NO: 467360 - DNA, 1005 bp, Homo sapiens
tgtaacagctgccaatgcagacatgcacctcctgccttctggggatgagtgtggctcctgtcctgggcttggtggcaagaccgaaatcccagagaagagcagaaagggcagctgtggccatgcaggtggtcagaacactgctgtggcgagacaggtgggttcagtacctggcagtcggagaggtggcagcacagccctacccggcactagggccagtgagaagagggctgccgttcctgtctgtgcagccagtgagctgggtccccagacctcaaggaggttctgtgaggtacccagtattcagtaccccagaccccatggaggttctgtgaggctaggtgctccctcatccatggtgctcctccacggttcaggatcctcctcccctgtgggcctggtgctccctcatccgtggtgctcctccacggttcaggatcctcctcccctgtgggcctggtgctccctcatccgtggtgctcctccacggttcaggatcctcctcccctgtgggcctggtgctccctcatccgtggtgctcctccacggttcaggatcctcctcccctgtgggcctggtgctccctcatccgtggtgctcctccacggttcaggatcctcctcccctgtgggcctggtgctccctcatccgtggtgctcctccacggttcaggatcctcctcccctgtgggcctggtgctccctcatccgtggtgctcctccacggatcaggatcctcctcccctgtgggcctggtgctccctcatccgtggtgctcctccacggttcaggatcctcctcccctgtgggcctggtgctccctcatccgtggtgctgctcttcttcatccctcatctggcaaggacactgctggctggcagctgccaggtagccccttccatctagagcagcaggccagaagagacaaaatcaggtacccttctgggtgaccctggtgagaacttaccttcctcaagaactgcaggccaaacagattccaaagcataga

SEQ ID NO: 467361 - DNA, 633 bp, Homo sapiens
cctcctcaccctctcatgcatgggcctggcctgatgcagctgagctgggcccggggaccaggcccaagtcaaggaactcacaagaatgcagatgacaaacctagcaggcaggaagtcactcagacactcagacctggcctatcccacaccagaaaatgaaggatggaaacgacacagggatcggcagaggatagtcaacccacttcgtcccccaggtcccggggcgagggcaggcacagcgcagtccccctgtgcaatgccaccacgcctcactccctgggcatcggtgaccctgcaagaaaatgaacaagcttattatcatttgcagatgttggtgaggactttttcatccctaaggtgtgaagacttcaccaaaaataaaggattttttctgatttcactgagagaaaatcacataatacagggaagctacaattcaattctcgaagtccagtgcaaatgtagcagcattcagccaaagcccccatttggtggaggttttgcacagggaaaattcatgtgagttgtgtgggtcgcctttgggggaaatctttgtgttcaatctttattacccaaggatcaatcgcactccggagatttgctgtttgatgtaatatttatctacagactgtc

SEQ ID NO: 467362 - DNA, 1292 bp, Homo sapiens
ggataggaacacctccagtctacagctcccagcatgggtgatgcagaagatgggtgatttctgcatttccaactgagtaccaggttcatctcactggggattgtcggacagtgggtgcaggacagtgggtgctgtgcaccgagcatgagccgaagcagggtgaggcattgcctcacccgggaagcacaaggggtcagggaattccgtttcctagtcaaagaaaggggtgacagacggcacctggaaaatcgggtcactcccaccctaatactgcgcttttccaatggtcttagcaaatagcacaccaggagattatatcccgcacctgtcttggagggtcctacaagcacggagcctcgctcattgctagcacagcaggctgagatcaaactgcaaggcagcagcaaggctggaggaggggcaccccgccattgcccaggcttgagtaggtaaacaaagcggctgggaagctcaaactgggtggagcccaccacagctcaaggagacctgcctgcctctgtagactccacctctgagggcagggcatagccaaacaaaaggcagcagaaacctctgcagacttaaatgtccctgtctgacaggtttaaagagagtagtggttctcccagcacgcagctggagatctgagaacggacagactacctcctcaagtgggtccctgacccccgagtagcctaactgggaggcaccccaaagtaggggcagactgacacttcacatggccgggtactcctctgggacaaaacttccagaggaacaatcaggcagcaacatttgctgttcaccaatatccactgttctgcagcttctgctgctgatacccaggcaaagagggtctggagtggacctccagcaaactccaacagatctgcagctgagggtcctgactgttagaaggaaaactaacaaacagaaaggacatccacaccaaaacaccatctgtacgtcaccatcatcaaagaccaaagcaatggaacaaaggtggacagagaatgactttgacgagttgagagaagacagcttcagacaatcaaactactctgagctaaaggaggaagttcgaacccatagcaaagaagttaaaaaccttgaaaaaaaatttgacaaatggctaactagaataaccaatgcagagaagtccttaaaggacctgatgatgctgaaaaccatggcacgagaactacatgacaaatgcataagcctcagtagccgattcgatcaactggaagaaagggtatcagtgatgtaagatcaaatgaataaaatgaagc

SEQ ID NO: 467363 - DNA, 802 bp, Homo sapiens
ggagtaactaaccaccagcattttactctcccaccctcatctcattatggtcacgtggatgcagaccttcaggtgggaccagaccgaccctctcaggacagacgcactgtgggatacccgctgtgccgggagagacccacagagaaggcggccccgtgaccacggagacacagaggttggaggatgcagctccaagccaagaactgcccaggaaggcaaaggacaccaggagccgggggagggcaccggacagaccctccctcagcgcctcgagcgggagccaacctgggactcagacatttccaccatggacaagacagcgttatcttcatttcgtgagcgtcacgtgacggagaagagtctaacagcagctaacttctgcattgctgatggtttcatgtttaacatcatcattgttccaggctttagacttgcagtgctatttgactgtgacagtgcaggagtatcgccgtcttggacaagcaccatcatgctaaagttcaccttgatcaaaaaccgcctaaatccaaagggctaaagtcagcatgaccataagccccaaataacatctcctaccagaaacattccaaacccctccccgaccagagacatgccagccctgagataacccccctccggctgggaagatgtcagccccaagataacctcccctctgcccagagacattcccaccccaccataaaacttctccctcacacagaaacctcccaagcttgtgataagccccctcaccctaaaaccaatctgtacccttggcctgtaagagaacgtgctcctgacc

SEQ ID NO: 467364 - DNA, 1641 bp, Homo sapiens
gtgctccgtgggctctctgtgggttgcgggtttggtgcgaggcttcacctgcccagtaggcacaggcacacttctctttattgtgcgtccctttcttgtgccttgctgatagtgtgtttttacaagttgaaggctcagaagtgactgctcccactgctgagcctggcactcctggcagctgggcccagggcctgcaattcgctcccagaggagccaaccctggcagggttgtgagctgggcaaaggggagccctggaccacccctgagcactagggcccccggggaacttgtggcaacatcacccttgccctcgactctggcacgggcctggcaaggccctggagcccccaccgaagtctgcaaggaggtggacagggcagcaggactggtggtgggagcagcagtggggttccctgtgccccatgtccccaaggcagccaactgtgccacctccacccttgcatggctgggcaggacctgctccgaggcttggagcctctgccacagcttcaacctcacactctgccatgtcctgggagcccataagcacccggccaaagttgcagccaggactcatgggaccagccccaggaacatcgggttcacttgtgcaagggccaccactgcggcagagggagacgcagagaagggcacagccaggtctgctcactttgcagagctgggacaggcaggagccatgacccccctcaagttggcagtgtgggagctgccgaggctcagttgcagccacccaggttgcagctgtgggcctgggcctcccgatgctctcagggcttaggcttgggggtatctgctcctgctgcctggcctctccctgcttccagtgcttactccgatcctagagtagggttggggccaagcctgggtgctgttgcagtccagccaggtgtgtgcacactcagggcagtgctcatgtgcagtgccctgctgcctcagattctctggactttgggcaccaatgagcgcaggtgggaggctgagacggggctggtggcaactcagcactggcctgcgggtacccctgggtgcaagcggcctgggcatgatgagtggtggcaggaggcagacgggctcctgggtgtgaaggagtgggttccagatgaggatgcaccttcaggccagggaggacctgaaggctgggggccggttgccagtcctctggactggagtagggacttgtgccttttccaggccctctcatggccacccatggaccaattggaaggcacttcctcccctctgaggcccataaaagccataaaagactcagccagagcagagcagaggacagagaggtgccaggatgaccagctgcagagaggagttatcagctgcagagagcagcagatgtagggacgaccagccacagagaggagctaccctctccaaggcctcctctctgctgagaactacagatgtccagttgaccagctgcagcagaagctaccctctctgctgagagctgaacactcatcaggatgacctgcctgcagagaggagccacccattccagggcctcctctctgctgagagcctctgagctgttctaacacttaataaagctcctctttgtcttgctcaccctccacttgtctgtgtacctcattctttctggactc

SEQ ID NO: 467365 - DNA, 817 bp, Homo sapiens
agcaggctgctgtcctgctgtcctcaacccaggcaggtccacgcagaggcaccacaggggttctctgtgccactttatggagcaacacttgagaaggaccaggtaacctgtgatatgaggatgatgcagggaactggggagctgggcggtgagtctggggaaaagggtgcaggcccaggaatctctgagtggccccagctcaaggtcagccccagactcaggatctcaggaacacagagcaggagctccaaggaggaagtctgggccctccagccttgggatgagctgctctgtatgtggccctcaggtgggggatcggggtcttcagcacctgacttacagactcatgccattcatccatccttgactcctcccaccaaagccctacagccagcccagcctccccggacactgggctgtttccactcatccagtcatgctctctgcatcctgctggccctgggtcctgggagcatggaccccaggtctctggtcctggttaccttccagatacccccaactccccagatacccctcacttgtattgaccgggtgtagggccatccgcagcctcaagaggcgaagtcttcctgcctgcctcccaggaggcctcccggcaggtgtcctcacatggcaagcaagccagaaccaatggcaatttgaaggcaggtgtgattcaaataaaggacttcattagctcaagttttggatattaaaacaatcaagttgaaaaatgtcagaataaataggtttataaatatcaccagatacttagaattaaaatttgcacattgacattagcttatttaatctcaat

SEQ ID NO: 467366 - DNA, 1027 bp, Homo sapiens
tcactcatgtagctacttctcctcggaagtggagcacaacctgtacccctaagtgtgggctgtgtatggcgatgtccttccagagaggacagcatggagagggggacttcacagtggggagacctcagccagccgaccacggccaccactgtcagtgaagagtcatgtcagcagtgtgctatttacgaggaaaacctcagacaaatcccaactgaggagtgtcctgcaatgcacctgaccagggctcctcaaaccatcaaggtcatcaacggcaagggccatctgagaccctgtcacagccaagaggagtccaaggagatatggcagcgaaatgtgatgaggtccttggcagaaatggaaaattgggtatcagcattttctacctgggagaaagaattacacaaaatcgtgtttgacccacgctatctcctgctcaactctgaggaacgaaagcaggttgacaataatagtgatgaaataggagtggtccagagaacactagcagcacagtgaagggtggagttctacaaaacgccacccagaaaacacggaattgattagagggggttctccggggactattttaaggagagacttgccagggctctgccctagcttttcacaaaaaggtccagtgggaaagaggaggaagcaggccacgccatagccagtgcactggagggtccagagagcgctcagaagaagtgcctgcaacctcatcaaaggggagcatggcagctcgtatgaggaatgggatggaaagaaatcatagctggaccccatccaaagaccacagtcctatttaggaagaaattgggttagaagtatcagacatagaatctgtacaggacctggtgtcacacagcgttttcatggggaaagctaaggcccctggtgtgaaaatcacagcccttcctctgccgggggagctgcacaggagaagagggtgatcctacacagaatcagggtcgagggagtgtgaatcaggcctgtttctatggcaacaaatagtgttttgtttttttgc

SEQ ID NO: 467367 - DNA, 903 bp, Homo sapiens
caaaaggcacagtgcaggtgagcatgactaattcctgccgattagccacctcatcccatctcatggacagagaacgtgctagcatccatggcatagctcaaggccctgggactctacaatcagcagttgcaaaaccagccgggcccatgtcctttccttcaggggagcaaggtcccccaggccctgaccacaagctgtgcagcctggcaaagaagttaaaaaccttgaaaaaaagattagatgaatggctacctagaataaccaatgcagagaagtccttaaaggacctgatggagctgaaaaccatggcacaaaaactacgtgatgaatgcacaagccacagtagccgattcaatcaactggtagaaagagtatcagtgatggaagatcaaatgaatgaaatgaagcgagaagagaagtttagagaaaaaagaataaaaagaaacaaacaaaacctcccagaaatatgggactatgtgaaaagaccaaatctacgtctgattggtgtacctgaaagtgatggggagaatggaaccaagttggaaaacactgcaggatattatccaggagaacttccccagtctagaaaggcaggccaacattcaaattcaggaaatacagataacaccacaaagatattcctcaagaagagcaatcccaagacacgtaattatcagattgactaaggttgaaatgaaggaaaaaatgttaagggcagccagagagaaagggataaacacgtctattttattggaaatcctgtgaaagtgtgaagtcaaacttcagggtttgagattggtgacctgttcagaggattcttatcaacctgaatctcattctggggtgaatttttactacaggaaacaaaaatacttctttcatttagccaacagtgcaagaaac

SEQ ID NO: 467368 - DNA, 4492 bp, Homo sapiens
aacatagaacactgctgcgaggaatacacttgtgcacgcactggttgatgtttggagacattcacctgtaagggaaattcctggacatgcagctctaggtcaaaggcacgtgcctatgctacctccttagaagtcttctcattcccctccacaatgcagtaacatccctgctccaaccagcactgcgtggggtggcttcccccagccttgcccatggagtgctgccagctgtaaattggcatcgatctgagagaccagatcacaacaggaggctagccagcctgcttcacagggagcaaaagagtttcccagcatgcacgattcttgcatctggatagagtccatcctggaaactgggattttcaaacttagttccatagaatctggttcatgttctcgtaaagaagacatccacatactctccgtggctctggtgggcacatgtctgggtgggtgtggggagccccagagcagtagggaagacccaagcactgtgagagctgccaaagacagactactggagtctctcaccctggaggccctcacctggagaccctcacctggaggccctcacttggagaccttcacctggagaccctcaactggagactgtcacctggagaccctcacctggaagccctcacctggaggctctcacctagagaccctcacctggagattctcacctggataccctgacctggaagccctcatccagaggctctcacctggaggccttcactttgagaccttcacctggagtctctcacctaaagaccctctccgggaagcccttccttggaacccctccctgatgactgctgagtccagagccagagtcaggtttattcacaggtatttgccttcagggatgctctttgaggtagcaaggatgactgttgacacaaatgaaaattcaccagacgacccatctgatgctggcgaattcaccaggcgactcacccaatgccagagaattcaccaggcgacctacctgatgccaggaaattcaccagatgacccactcatgccggcaaattcaccagggccatattccccaatggatttatgcagattcatggaagaaaattgctgcttgatgtgtcgatagtcagcaaccttaaccaaagcactgtgcccttttgaccaccattacacaagggataggagtaaattcaacaaacactttcacttgtgttatcctctctttgttcacttcaattatgttacaagaaatgtcaaagaaaaacatcaataacagcaaaaataattttttaaaattcctatcactgatcataaagtttatagaggctataacatgacaacaataattgttattttacccaattctgtactgtaccatcccatgcatggagaagataccatacattaatgagattatttgacattgcattctgtaaaacttacagataagtgtgtatacccctaggagacctcaggaaaaaaacctcctgttttcctgttttgaatgatattcatacaccaagaaaaacatcctttgaaatggaactcaagtaaactggagcctcgagaaggtgacatttattttctctcagaagcaaacattgtaaacagagagaggctgtgtcacagaagctggaaaatctagtgttttgtactgaaaattatttgactgaagccttaggacaaatataaaggatattcaggaggaaatttgaaagacagttcacatgttaattataatcatcaaaacacataaagtttagaacttcctaacttgccagaaagactccaggttatagagtatttttgatccaactttccatctaacaggaaaaataagactctaaactgcagtcgttctgagaggaaagaaccctgcgggtgtcctacaccaattctttcttcctttgcttttctcgtaatgtgatcacagtgaaatgaagtaataataggaaccatttgactcataacctcaccagatatttatgggagcacaatcttatttatctgtagttgtgatgtttatttgctagatgtttatttacaacgtgggggagaaatgtttttagactcaaaaatatattcattattagaattttctatacaagacttttgttgtacacacatgtatgtctgaattacaacttttccttatttttatttgcataaaggggtgcaacattatcttctgttacttaggggaactacattctcttaaagactttgggaatattactgttaataataaacactaaaatgtgcatacctgtgtgtaagttttatttcatgaatttagagagaactgagaacttaataatttgcgatttactagtgttgggatctgtactaactctggcagccagtgccaggacagtcctgcagaattgcacaaacaggcttttgctatttttgtctctaatgacacagccatgtgggttctatgtgctcaatggtgactaaaatgttgggtccagatgttatctccagcagcttgtgcctaaacagtaaatgcttataggcaccaccatgccacgccctgtatacatcattcattcagactcagtaattaatgatgtggatccaccagagtcctcggagcccctgggagggacaggtgtctgtgtttaaaagacatacgagatagatagtaggagggggtgtgactactccttcagatatattttttcctttttttcttctcttcacaaaacccacacaagcacctcactgacgctctaccactgaccccaagtttttagttgcacaaagaaaacaatagttcttccgtgctctaacaatgcttcgccataccttttactgaatagattccagaaactggcctgaggaaatccaaacttcgaaccaaggttgtgtagtgtcccaccttgggaagaaatgcagcgtgattgattcacagccttgttgctgccagacagatggccaagtgacccatgactcaagaaaaccacagtgaccagatatgctgacccgcatgccctacccccagggactctccccagtccagctgtgtaccctactcctgatgtcaattcccacgctttgcctaattaaaaaaaaaaacccactgactctttttgtggaaccagctggagtattcttgcacctccactgtctcccttgcattcaagcacaagcctccaaataaaagccttgtctgggaaaactgcttggccctgcattagtttccaggccatggaacccgagaccctgtggtctggaacacatggagaatgaggcaacagacagaggctttgggagcactcatttgaggatttcccatgaggtaagctccatgacacgtcagctccatgacacgtcagctccctgacacatcagctccatgaaggaagaactagtatttgtcacgtgcgtccatgtgaagagaccaccagacaggctttgtgtgagcaataaaactttttaatcacctgggtgcaggcgggctgagtccgaaaaggtagtcagcaaagggagagaggggtggggcaggaacaaatcataatggtagaatgtcatcttttgtggttcttcagttgctccaggccatctggatgtatacgtgcaggtcacaggggttatgatggcttagcttgggctcagaggcctgacagtatcatattctttttatgggtgaggaaacccaacctgggaatgtgaaatttctctctccaggcccccccatttgttaggtggggaaggatttggtccatatggtgtgactccacaacccactgtcttctccaccaaagaagcaagaatgcgtcattgcaaagtcttgagcagatgactgtggagagcaatttctcagacctgtgaggctactgagcccttgcaatggggcaagttgaaactgcaatttgctataagtttgaaatgcaccctggattcacaagacttagtataaaaaaagtaaactgttttattactaatttttatattgatgatatgttggaataaaaatattttggatctactgagttaaataaaatgttactgaaattaatatcacctgcttcttattgcatttttaaaatgtggctgttggaaaatatttttaaacattatttatgtggcttgcattatgacatcacaaataaaattgaattgtatttctattgcttaagttctactgaccagtaaagtgctgctttgaagaatcagactaggagatggtttgggagaagaaccagacaaggcctggagaggaggaccaggcacccagacagcacaaggcacccccgctggggtctcttagactgagttacccaagcacaaggaatgagtaattgaaaaatattgtcattggccccaatcagcgcttcctctgttccctgctgggcccattggagtgtgcccctcctggtgacagtgctgtggagtagctctgcagggtgcagtgggaggaggggctggctcattaccggttttgtgatgctaaagagattccagcactgactgcacctgttgggagggagtaggggtgagc

SEQ ID NO: 467369 - DNA, 1825 bp, Homo sapiens
ccagaaacaaagccatttgactatgcttatctcgtaccacagtcaaaactcaagggcaaaaaaagaacataaaagcaaaaagccatatccaaaggacagcagtgccccagtggggactctgtatgggagctacaaccccacattttctttctgcactggcctagcagaggttctccatgaggaagctgccatggtttggggcttgcaccctctgaagcaaaggcctgagctgtatgttggcccattttttctatggctgggatgcagggcaccaagtctggagactgcacaaagcagcaaggccctggatctggcccacaaaacccaatacaccacaagcacagtcaaccaaagcaaaaatagacaaatgggatcatatcaggttctgcacaacaaaggaaacaatcaacaaagtgaagagatggcccacagaatgggagaaaatattcaatgactgataggttatgaaccgttgtaaagaaaagaatgtcctggtttaatatgtttaataaattggaaaatctgtgtattcatcaaatagttactctttactgattgtgtgccaggcactactctagatgcttcttacacatttttaccagttttgatttctgtgtttcctagatttctttttatttttgatttttaatttgttagcatatggtcagatgacgaactctgtatgctttcaatctttaaaatacattgagacattttatatcctggcatatggtctgtcttgctttggtccatgaccagaatttggtgactgaaaatttaatccaatccaacaaatgttttaaattaaaaatattatactgtgtttattagtttatattttgtatttgctgatttttgtagtttctacttctctaccatgattccctatttttctcattataattatacatttttacaattccttgaaaatgtgtgtaaagcttgcttagtgcccttgtcttctattttcatacctttgccaatttaaagcctttatcttttggatgacatttctcatcaatgtcaagagtaaagaatgggtcaatgggtcatgtgttcttgcttatttttctaggacatttttgtttgacagtgtgattgttacgttgttgattgtttgagttttctatctgccttaatagagtcttaagtttggtctagctgtccattcagttacttgcaggtcaacttgattccttaaaattttgcctttacactttttaaagataaatttctagttgcttgtgctccatgactagatatactacttagaagttctctatgcttcttctattggtgatttgacatctgttattaatttgggaatgctcctagtcattattacttcaaatatttatctgctgcattatttctttcctcactttctgacattctcattgaacataggttacaacttttgaagttgtcccatagtacttgaatgtcccgttctattttttcccttctgcttttctttgaattacagtttgggaagtttctattgaatgatcttcacactcattgattattttatcagtcgtgctcagtgtattgctaagttcatcaatagcatacttcattgcagttacagtggttttttttgttttatttctaacattgccttttggtactttcttacaatttttatttctctgctatatttatcatatgttatagcacaatgtctactttttcactaagaggctgtattcgtttgcatagccttgcggaaaatttatatatatctattgacctgaaacctgtgaatgtgaccttatttggaaatagagtcttgcagatgaaagcaaatgaaaatgaggtcgta

SEQ ID NO: 467370 - DNA, 636 bp, Homo sapiens
cagaatcagaatgttaagaatgcttaaaaacattcttccacaagcctacattgtatttggcaagtctgcttctgaaatccagggccttttcctccttgagagcatcttggttgatttccgcagggtgcatgatccttcaatactattcaggattatacgaggcatcagaaataccagagaactggacgtggctcatggaaagagctcagggagaaaggcctttatggccagaacagcactgagtcacccactattgctgctggtggatcccccattttctgaaaaaatggtgaggaatctggcaggtcactctgtgcttctaatgaaatttcttccagataaacctgacagcaaagaaaagtatgacaccactgagaagagtattatgaatgtttaatgtttccaggtcacttcactgttcatgaagagactgccccggacttagagaccacaggtgaggttgagcatatagaacagataagcaaaaaaattgtgacattttttgcactgatgcctagatgctcagtttttgtgacttagtcatttgtatggctctgtaagacttgatacccatgaggctgtgcagattcagcccactgacttcagctgatttgcatgaatgcagaactgcctcac

SEQ ID NO: 467371 - DNA, 747 bp, Homo sapiens
gagggctgccagcacacttgctggcggtagatcatggcttggtactcctggggtagccactgcagctctggggtgatctcagtaattatgttctttccccagcttggaggcagcaaagggacctcagtagtggtgtggccaaggggtcttttgcttttcttctggaggctccacctcacagagatgcaggagagtctaatgcttgatgatctgaggtggaacagtttcaagccgaaaccatcccccactgtccgaggaaaaactgtcttccacgaaactggtccttggtgcggaaaatgttgggaaactgctgctttaaagggacagttgctgagcaatgaatcaatttcccagttgcttttcaccgtcgctttcactgttgtgctgagtgctctcagggttgaactttttcaatctcatcctttggggtatacaggtataaaaggagctctctgttctatatcctgtttctcattctgggcaaaatatttgagctgctgctctggtgctccaggcagggaaagcaacaggccgtaatttgagtgaccttgagttgccaaatgacaattgataatggtctatggaatgaaatttatcttccaaaagcatattttatgaaagcttgcgtataaaactttcccattacaagttagtaaaagctgacttattaacagctactcttcaaagtggtccgatcacagattgagaattttaatgaagttaccatgaaggaaatgagttatgtgt

SEQ ID NO: 467372 - DNA, 7031 bp, Homo sapiens
gttatttggaatagccagaggctgccatgaatattggctgccaacagcttttacctccaccctttgttggggaatcgcacttggctaaacaagatcccaaagtcaggttatggccaatgattgatgggaagggtgtacaatatggccttaagatcagactggcacagtctcatgggcaagatcaccctgcagagttcaggtccaacagttcccctggggtcaaaatatcctatgggagcaaagaaacactgggggccacgaatgagtcctggtgtgcagtagccccattcaggcttcccagcttcctctcccatcagcccagcatctgtgtcttccctctctccactgtcaatgacttccctctgaagatctgctcagagcaggccagtcttcctgatttcctagtcctcagggctaaatgttcaagagtggcagaaatagcagagtgctgtggaagacaatatccttgaattatacatgtcatcttcttttgaactaacatcaaggatgtttcctcagtaattacaagatttaaatatgtttttcaatattccattgaaatgatatatttttaaatcatatgattatttgttctattttcatctcatttctatcacccattgtagttccctatgagagatttttttatgtggatatttattgaccttgttctccaagttacccaagagaagggtgggtatgaatgagattattgacatcagtatggaaatgagtttgagaagctctttgacgacaaaggaatacatgaaagtttatctaagttgtaaagattactaaaggtcgtaagtttctgctatggttttagccaacttttaaaaagtcagactatgttaagtagaaccggatgaaacaaatgtaagaatattgaaaggccataaaagttaggagcctttgaggaaaatgacaatttcttttgagttagtgttcagcagcaaatgtattaataatatgtaagtataactcttaacttcactcaaatctagacttctgatggtatttttttaaaaaaaaacacaggtcatgaattatagtgaggacttgccataagaaaattggacttagcagcttgctattgatccattcaatgagtagtaacaaacatttcttttcatcggctttgcatctgcacatttatctgtttcgaaagccaattcgataaagcctcttatttgacattacctttccatgttctatactatttgttttggttagattgaactacgactgttgatacagtttcctgagggcattggtatacttaccattgcagagttatttatttcacaagacttcttctttgtccctttcaaaactgccatcttttccactgtgaaatggcctggatttgcaagcaggatgataactttggtatctcattgtgccatcaccttataacacttgctatgcttacataacttttcaattatgtgaccctattcaatattatgatgagggagctgaaatgagattttttctcaggtatcttatccactttcatgtagaaattctaatctttgcacgaatagcaaaattagtgttttggtaacacaaacattgaagcctctgaattttaaaaaaggagattctcaacttgagaaagaatacaggctctaaacttccaattatatgtgataaatcactaaaaatgaagccataatgtatgtgcgtgtatgtttataatctctcaggatttagtgaatttgcagacataaatttgcttctgacttataaaatcgagagttggaaacccttcagtaagcggaatgaaaggaacaatgaaatagtttaatgcctccaggtgttccttacccccagccgtgctttcttttgctgctttctgtcttgtcttcttcaacactcttgaacatgtaatgtataattgtgatccagcatagcatagaggttcaaaatgtagacctccaaacaagtcatctgtattcaagtcccaaatctgcctctaagcggctaggtagccttaaacaaaacttaatctctctgtgttttaatgaccttaaatggaaaatacgaaaaaaaaaaatagtacttgctcataggattgtggttagttttaaatgagatagaatatttttaatggttacttaagatataaatgtcagttattgttaatatctgccattaccatatttgatggccatctattgttttgtctgtgtaatatccctactattttcttgtctttaagtctccttgagaaatttctttccttattgtggttttcttagactcttactcaagacgatttgtcctgctcaagccaagcagtgaccatgagacaaacctcctagggcaatcaatctccactccatgtaattaaaaaaaaaaaaagtcaacaatactgcatttcatgcttaaacatttgctaagggagtagatcttatgtcacgtgttcttatcacaaataatatttataagagaatgggagaaaacttctggaggtgatgcataggtttgtggcatagattgtggtgatggtttcacaggtgtatatttatcactaaactcatcatgttgtatacctaaattatacagctttttgtatgtcaaatttaaaaaatattataaagagactagtaacattagacacatttccaaagcacagaaaacagcatgtaatgatgtgttatttacatgtggtacacaagtattgggtccacatttataattttttacacctatataaactcctataactatcccctatctaaagataaagaggactttctataccacagaaactgctttatgctctcttccagtcactacccataagataaccaatatactgatttctattatcataggatatttttgtatatttttgaagtttatataaatgtgttcataagatatatacttatatcatttttgacaacaatatgtctgaagttcattcatgtaatatagcactagtctttttgctctgctgtgcagtatctgattgtaggaatataccacattttatgttttctcttgcagatgagcatttggatttgctaattatgaataaaactgctgtgaacatgctggtatatatctttgaatgagcaaatgcaactatttccattagtattttcccattagtgtgattgttggatcatagaatatgatgtataaaatactatgttaagagacagtgtcaaatggtttttcacataagttaaattgtatgtctaccaccattaagtgagaattaaaactgttctatttcatcatcaatatttggtatcattagtctttttaattgccttatgagtgggaatatttattaatagttacatggtaatatcttaaatggtatttatgtttaattttctatttgtttattgtgattacataaaactcaatttttatcttatgatggcttatgccaaatatatattttaatttttctatgtgtacatttatgagtgttttcaaaatacaatattcatgtcatttttccctttgtcatgtcatggtgactggaatatctaagaaaatgattattttaaattattttatgtactttacctcaactttcaaaattatcagaataaaattgttaataatatctccattgtatattttgatgtttacatatttgaggtatattctcttttctattactaatattatattgataatttgtgttttttgcctcttttttctgatcattcttgttaaaatgtaatactaattttgaagaacaaattttggctttgtaattaaatttattttatatttgccttcttttcaataatatgtgttgtttattttcaaaccctttatttccttgagtttaatttgatgttcttttaatagctgtatgagataaaatgttagataattaacgttcaactttgtatagttctaaatatggccctttagacacattattagctgtatctagtggattttgatgtcatatttttaatttttattttcctcagaatattttctgattttcattgtgatatcctctttgacccatgcattatttggaaacatgtttcttaatttcttaattttggggggaatttaaatttcaagatgggtaccacagggaaataatggcaaaaatgatcacattaaatgtaatggcccaaagagatcgcctttgagtttgccaccaatgtcttcacagctgccttatctctgaccttttctcacttgatttactaaattactccatattcatccaatcagttctccttttgcttatgttatccagagtttctttctgcttcgtgcaacaaacagccctaactgagacattctgtacacaaaataccctgttctgccattccttgttaccctattcaaatgttgccaaatattcaaggtccaatttaactcatacttcatttaagaaatgcccacatcctctggattctgctaaatagtaacatagtttcttggacttattagttaaattgttttatattcaattattatttagcattctttctctaccaagattcttagaggtaggaggtagttaggaagcttagaaattatataggagctgaaattctggttaggtagttatccagactctatttttactctactagtgactggaaattcactactttaagaaggcaggctcttcaatgtttgagcagctctaatctttttaaaaagtatttttaatagagataaatagtacttttggaattcatatctacgatactagttcagttctcttaaacattacagtatctactcctttctcctcagaaaatatattgcagatatttagaaagtgctaccccatctacgctgaatcttgactttgacactttctgctctattaattattccttgggaggggatggcctccagcctcctgtcaccctgcatacagattctggattgcattacatttaaactgtcgatggctttcaactgagagaacacagcatgtcactcaagatgtgttccaatgattgtaggttagagtggaattcttacttcatattcataaatcatttaactctgcagttactagaacataaaatatagtaataagttgcagtaaagagactgttgctgaaatatgattagaggtgactttctattaaggcattttaagtgaaccctaaatacaatcctttaaccactgaaaatgagactatggcacaagagtaattgtcccctcaacaaaatgtcacatggtgggattaatttttttaactaatatgttaagaaagtaatttatgaacagtattaatagaagagattattactgaaaggaaataatattcttcgtttatgaaatttcatatatatacacacttacatatacaaaaaatgtaattcatagataactctcaggaatatgtcacccattaattattatgtaaagtaaaattatccaataataattattttggtttaaaatagaaaagtcaatattttaatatgatagaataatttacaagttactaaaaagccaaatttgtaatccataaaattctaataaaatgcaatatatatatagtgtatgtgtgaatttaagaaagatcaatagactctatacaaatagaaacagaagaagattaaagagttaaaaaggaagagagaatggaaaaagcataaaataatatcaaataatctaacgtatgaataattggacttccacagtaggaagaaagagagcaagaggaagatgaattatttgaagaaataatacctgagaagtttccaaaataataagaccataaattacagattcaagaagctaatataattccagaataattaaaaacaaaacaaaacaaacaaattctagacgtattgaaattgctgaagatgaaagacaaagagaaaatcttgaaggtatccagaaaaaaaaaacatattttatatactgaaatgtagaataaaaaatgaaagcagatttttcatttcaaactctgaaagccagacaataatagaataatatctacaaacagagatttctaggctcagggaaactgtctttttaaaaaagaggaataaataaagacttttcagacagtcaaagccttgaaggagtctatgccaacagcactgcacacaagagatattaaaggaaccacagaaaaagaaatctagaaagaaataaagctgaaaatgtcatacgtaattgtaaatataaaattattatgactttttaaatcaaaaagcaatgatgatataggtttatagactatggaagcgtaaagcatatgactaaatacaacaaagaatgggaagaggaattggaattatactattttaagatctatatatgacacatgaaaaactaaaatatttgaaggtagattcagtaattaactatgtactatttatgatacatactaatacatatagtaaacttgtactgaaatgacatgagtgtacgcgccatagtgcagtatacatactaaaatgtactatggcttaagtagtacactgtatgtattaatatgtactaatatgtactcatatgacttcaagaatttttatataacattcttgaaatgacaaaattatatgtacagagtacaatttagtggttggtagaggcttagtctagggaaaatgctgaaaaactaaaaggatataaatataagccaatagtagaattaataagaaattgtaaaatataggcaattcattttaaaatttttatctatttattttacaattttttgtggacacatacactatagaagccagagtttctcagctgatactgtgctgttccccagagctataagaaagcttaagatcagctgcgatttactgaagcaattaaattaagttattattttctggaagtagcattaaccagtactaaataagataagaaaatatttacagaagttacattgagcattcctggcatttaagcggtttttttaggaagacgttgcatcgagttttaatattttcccctatcacttggtggggttttatttgtccaatgatttaatatctgatccaaaacaattatgacctaatttatagcaataaatcaaaat

SEQ ID NO: 467373 - DNA, 822 bp, Homo sapiens
tgctttaggtaaaagaaaggatagaggctctctcgctctcccctctcactttcctcctaactctcctccttctccctctctccgtgccctccacccccgctgtctccttctcccttcccctctctctgatacccgtgctgtgtgcagcctagggacttggtgccctgcatcatggccactccagctgtggttgaaaagaagcaatgtagagcttggagcctggcttcagagggtgcaagccccaagccttggcagctgccacatggtgttgagcctgtgagtgcacagaagtcaaaaactgggggcagtgcagaaggaaatgtgggtttggaggccccacacaaagtctgtactggggcacgacctagtgcagctgtgagaagagggccactgtcctctggaccccagaatggtagatccaatgacagcttgcactgtgtgcctggaaaagtcacagacattcaacaccagcctgtgaaagcagccaggagggaggccgtaccctacagagccatggagcggagctgcccaagaccatgggaacccaccttttgcatcaatgtgacctatatccaagacatggagtcaaaggagatcatgctagaagtctgacatgagttttactcgtataaagtcaaggtttcagcaagttccgttcattttgggggctttggggagaaagtatttcttgcctttttacttcaagaggctgttgtcatttcttggtttatggctgcatttctccaatctcttgcttttgtcattagtctcctactacttactctgatctcctgacacctgtttataaagttgcttataatt

SEQ ID NO: 467374 - DNA, 1071 bp, Homo sapiens
ggttactatgcccatcttcactgctgtgagcctttgatgatccaatgttgtcaggcaaactaggacaattggtcgccttcattataggatcactccttcttctctctctctctctctctgtgctaagccacctggaactgggggtgtggtcgtgcaagcactcctgtggccacaactactgggactacactgggtcagacctgaagccagtacagcactgggtcttgttcatttctactgcagattttcacttaaagcccaagggctcttcagtcagcttggttgaattctgccaggcctggaactcacccttcagggcagtgggctcccctctggtccatggcaggtccagaaatgctgacccagaggctaggcctggaatcggggacccaagagcctgcttgttgctctaccctgttctggatgtgctagaaccaaaggtgcaagacaaagtcccctttactttcttgtctgcttttcttaaacagaaggagtcttttactgtagccaccgcagctaggaatgtgctgggccacacagatagtcagcacatctcagagccccaggcccacggcataccacctgaacatcactgctggttattcagggcccaagggctctttagtcagcagaaatgtctgggagctagagcctggaaagggggcctcataactttggcgccctatcctactgtggctgagctgatttccaagatgcaagagaaagtcctctttattctttgctctccaccacttacgcagaagattcgaggatacacgtgcttgtttgttacatgtgtttattgcatactggtggggatgaggcttctagcgtaccggatatccaagtagtgaacattgtacctatagatttatagaaataggagactgttcattattccatggtatatatgtgccttttctctccccttcctttcctttatgtgactttaagaagaccattttaaaaaagaaaataaaatatgcatttatttgaaatctatgagtgtctctgtttcattagagttaattgtagatttaatcagcaactattgggttgaaataggatgcc

SEQ ID NO: 467375 - DNA, 616 bp, Homo sapiens
gcgtctgatgctgatgatatttgccttctggctcacccacctcctccacaccaccggctccgggagactcgctgccggctcctattacgtcctcaccatccttctcggtgtgtggtttgtcaaagatcagatagttgtagatgtgtggtattatttctgaggcctctgttctgctccattgggcaccacctagtggagctgtgagaagagggccaccgtcctccagaccccagaatggtagatccactgacagcttgcactgtgcacctggaaaagccacagacactcaatgccagcccgtgaaagcagccaggagggtggctatagcctgcaaagccacaggggtggagctgcccaagaccatgagaacccgcctcttgcatcagaatacaaataagagacttctcaattatgtgaaccagtggatctggggaggactgctttccttcttgtgcctaaaaaatggaatacaggaaaggtcacaaagcagccaggctctggagataaatatgaactcaactggctcaatgaatgactcagaggtacagtttttgctgttgtttgtttcccaataagaggagaaagaacaaaggtttgcattgagcctcagaatatg

SEQ ID NO: 467376 - DNA, 1058 bp, Homo sapiens
ccgagcgctatccctggagcgggctcggggcactggggcatccatggcggttgctgcacgctccggccggaggagacggagcggagcggatcaggagaaggcagaacggggagagggcgcgagtcggagcccccggggagtgctaagagatggagggcagcaggagcctgggactcgggagcgggacccggacaaagccacccgcttccggatggaggagctgagactgaccagcaccacgtttgcgctgacgggagactcagcacacaaccaagccatggtccactggtctggccacaacagcagcggaccaagtggatgcaagtttcagggcaggaactctccagcatcttctaacagcactaagcgagggtgttttgagaactggggctttccagcccatgtcctcccctataaatctgcccccagacccattcaggaccacaggcagtgcacatcctgtgaacccttctcacctttagcaaaaagcctttgctatgaagagtctctgattatgacaacacctgcattcaaggtgcaaatgcatggtaattataggctgcttgtcaatctggtgaggaattctggatggttcactcacctccttcccttcactttcctgccccctcagctgttggacttgagcagttgtataaagacatgtctgttttgcctcgtctgtgggtgtgatgtgattcctctgtactgcagtctcgattgatggaaactgttgctagagttggtggaacacctggggggatcttctggcatgaaaggtgctgggtatgaatcatttgtcatgagcttggtgtcgtaagcaagaacatattgttcccaccctactcatcccaggcatgctgtgccctgatctaaatttatatagtaatccttagagtgttaaaatatatatttgcctttatatgtatgcataatggtgtatgtgtttattccttatttccaagggattttaaagtgctgtagcattaatctttataaaatcctttgtaggtagtaagtaggtgacgggtgttaatatctctttttcatatttttatgcc

SEQ ID NO: 467377 - DNA, 1462 bp, Homo sapiens
aaagtttaatgattgccccgctggatttcagacttgtgtgggacctgtagcccctttgttttggccaatttctcccatttggtgatttgcaacggagacgtgatttgtaaaggggagagtgccatgttgtgaaaccaacatgaacgctgtcaggactcttgctgctgagtggctggagagcagaggccccttgctgtccttatccagacctcttcttcaggtagctccagagaagggcctgctgccccttaccaggagcaggaagggctgctcttctcctgtcctgtgcaattcccacccttgtggacgttcaagaccacaaatgaaggctgactttcagttaaaatcatatggtgatagaaaaggaaaaatggactgccaatgtgatgaacagccaatgacagaattttattatacagctctgctgaatttgggagaagatggcagcttatccaagaaggggttgtaccaaacaggttctactgaaagtaaggaatatgatgccccaggagagactaaggtgcttttaccaaaagacgtggggaagataatgcgaaggcatcaacaagagcattaccctggtttagctccaccaccaacaccccaatgagaaataatgaaaaagcctctccattcatcttcctatatcactgcccaaggactcttgtgtctccccaatcaaatatttgtctcattcctcattgtttgcaacataaattgaagaggaagaatctaactaggttcttgccattgtggggttgaatgtactttttctgacctactacccactctaattctgtatgctaaattccaggagtccagctttccaacctagtttccgtattgaacagtaagtatgtcaaaatctggataagaaattgtttaggcttatacagatgagtatgtatatgtatagacacgtatacttacacgcatgttcttgttgaaaaattgttgtggcaaatttagtgtttgtgcatacaaatataagttaaaaatcttttcatatcagcacatataaatttagcaacttcatggttaattgatacatagaactccattataaagtcaactatatttagtaattactaaattatagagacctttgtagatatacagacctctggttatttcaaacaatgcgaatatatacacatacacacatattatttatttggttagtccgcattcaagctcgcgtaagcagcaaacactacggaaagagaatttatgaaggaaaattcctgggtcagagattatatacatttcaaatttttgtaaacattgtcagattgccttctgaaatatttgcaacaataaatagtctatcagtatcataatgcctgtgtttgcaagccctcagcaatcttggacattatcaaagacttttcaaatataacccatctgagagcaaattttaaaaaggcatatccttattgttttaatctgtatttatttaatt

SEQ ID NO: 467378 - DNA, 478 bp, Homo sapiens
agtgaagggaattcaaaatgtatcttcttctgcctacccatgggaaatttggaatcctacaatttcaattaagctttaaagggacaattggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttatggagaaatcaaggattggagaagcactgtgactctggcatcactttatgctcaaagcaagtcagaacaagaacataaccgagtcacactctcaggcatcttaaagatggagggtgtcatgagtgactgtggatgccaaagtgccatgatatggcagtgagaggtggctttataggggaaagaaaagcactggactgagtc

SEQ ID NO: 467379 - DNA, 987 bp, Homo sapiens
acagtcagctgcatcggggatgtggggcacaggggtcccaccaccacaactgctgctcctatagccagcacccacacctccccgctgcagctggaccaagaagataaagcgggatttctccgagctgaaagccgtcctccttccatggcaacagggtcagactcatcctacacagacaagaagcattagcatctgatctgctttatcctgcagcaacaggagcccaagtgctttatggcggaaagcagcccttggtgtatccgtggagacagggagcttctccttgctcagcttgttctaggatcagttaacaacttccctgagacgtgcctcatggttgtgctaagagaggatgggggaccctggttggagagaaccgaaaggtccactctggtgtccaggaggaggtccaccttcctcccttcaattaccagaatcacctggaggctcctgtatggtaatggtcatctggaccattggagccagggagaggagccctggaacctgttggtcttgctggaccatttgtgagactggctctggacttggtgacctgcatctccagggacagtccgcccttcagtggtccccattacagattggacagggaggggacaagctagaggagaaactcctcctgggtggacccagtgaggcagggctggagggagcctgttctcctcctggagatgcctctggggtttgtttctttagttttctgggattgtctcttgcagccttacctgagctggccaacaggagggttggatcagtcttataatgttggcaaagatctggattaccctgcaaggtagaatcttatattattgattttatatttttcttctttactaatatatgtatttaatactatgaatttttctgtaagcactacatttactatatcccacaagttttgataagttgtatgtttattttcatttacttcagtatatttttaaaatttttcttgaaatttcttctttg

SEQ ID NO: 467380 - DNA, 724 bp, Homo sapiens
aatatccttatatacgagctattgggacccctgtcccggatgccatgcttttcaggggtctgctgttgctgttcccagctgtgtggaagaatgccactcagtgtctgccactcagtacttcagttttggttgccaactgcagcactctctatctgtggcctggcagggagctgggctatagggaaaggtacacagacctcattttccttctgacctcccatctcctgtggtgtcttgcatttgctgaacctgataggaaaccagaagagaaggaggctttatcgcagcagaatacacaagcctgcctcccaggcaccaaaatgcggggagaaaagtggattgtaaacccatggaggacaaaacccaagacacagaacatggctctcttcctggagggtttcttccctttcatgctttcccatttttgtgtctacacatttaatttgagaaccttagcagccatgggatagtgtgatatttgtcattcaccttagggtgtagataaccatattctatggacactctgatgttgtctagacaagaatgtgaaatcatgtatatactttttgtagctcaaatgtacttagaaattagtgtcatagtaaaaaaaaataaaaatcagaaattgaattaaagaaactgagacctactcactaattagttcctatattttcttacctagcattagtttaacccttctgtaaaccaggactgtgaattatat

SEQ ID NO: 467381 - DNA, 686 bp, Homo sapiens
agatacccgaactatggtgctatcctgaactgccacaactcacatgaattttgctgcttccatggtgttcttcagtgtacttctgcagtcactctactcaaaatataattattttttgtttctgtccgctttttctgcattagtctggattctgtattctgcattagcctggattaaatgggaaggcatatggaagcatatgaaaactaaaaacagaaatatcatccttatgatagataatgctgtttgtgaaatttggcttaggtctgagggacaaattggctttcaaaagcttcttctcctgtgcttgatccccaacaggtggggaacaggccacacctcttcccctatctatctttggggcaacccacctcaggaaaaatgtgagttcttcagagcacttctcaaatcagtatccttcaatggcccagagcaatatcctgtggtgcaggacagacaatacaatggtcctgtggatgaggatagggtgtgcagagaaaggggcccagaaagaacacaagaagtggccctaaataacactaactgtttttagtggacaactttaaacgtacatctttttttgccagtgtttttggtaagagaattgatatgaggttgggatgcatacggactcctgaaaaattgcaaatagcttcgctgtggtcagtggactgaaaaaaaaatac

SEQ ID NO: 467382 - DNA, 806 bp, Homo sapiens
tcctcagacagctttacaatgcagtttttctaggagaggtagtcttcacgcagtctccagccatttatcaaagttactgatggcagctgtgggccatccagagtggccgctgcctttgtgcctgtcgcagcaggggctgggggcaggagtggcagcaggaatggccacgggagttgcagtggcagcactctcacctgctgcagctgtagggagggcatggggaagaagtggacagtccccagacccctctgccctcggggccactgtgatgggtctgggccgagtaaactgccagcagggaagctgtgcaatcaggcatgaaggagtgatcagagaggggccccaaggtggagctgggcctggagtggtgctgtgctccatggaacaggtgaaagccagtagcaagcagcagccccaccctcttgggcatgactgcagctgcccaagtcactgctgtggacctgggcctccctgtgctcttgggggtcaggagcaggcaggagccctgccctcctgggtgcagctgcaaatgtggacccagtcatctctctgcactcttgggggcttgggaaggcccctgttgcccccacaggctcagaggtatttactcccactgcctggcctttttctgctcctgcagcccactccaatcttggagcaagaatggggcaagccaggtgctgttgcagcctggccaggacctgaggtagagatattgagtgggcagttggagaatgaagatagagagagcccgtagaagaggtgtcattctctcccgcacacagatgagaataaggaggtatcaa

SEQ ID NO: 467383 - DNA, 597 bp, Homo sapiens
ggaagtgtaaatgtccaagaaatcttcagaatttatgttcttctgctgtggcttcagccggcccctccattcgggttccctgacttcccgcaacctcttttgcttggctgacgcccatgtacaaagccgctggaacctgcctccagtgagccaaggtgatcttctttcctatggaatggtgtttgccatttggctgcagttccagaggccaaagcatatggaaggactgaaaaagatgaaatgtgggagaaggatgagtttcctggtgggagttccctggggggagccctggcgtgcacaggttgcccagagctcccaagagagaagcagcagtgcttgggtgttgagggtcaatcctgtgctacatagacaggggcctgcttgttcccaggggacctggaaagcacccctgaagggctgcagaaggggttaggtttgtctccaaattcttcctgggtgtctgtcttaggggcatgcatagataaggattaggggaggctttcttcttttgccaggtcacagattaattacttaaaaaggaggatgcacaggtttgttacataagtaaacctgtgtcatgagggttggttgtacaga

SEQ ID NO: 467384 - DNA, 596 bp, Homo sapiens
cttaggcatcaagaagccgtgggcattattagccatcagggaaatgcaaacaaaaataatctcagtgacataccccttcctacccactagggtggctgtcatcaaaaaggtgggtttagatcggttttataatcttagactaacttcttatgatctggtcctaacaagtgttgatgaggctgtctttggctttagtgtgaggaccagacctggaggggcatttcagaggtcgctgcagggagaccagaggggaggctcttttaaacagtcagaattaatgtccttagccaaccaaaaggatgacatctgggccatagcgaggatatctggtgttgtagagtcacagaatgcaagctcagcagagaactatgagtttatccccaaatggaagtttctggaaagagtcacagtctactttggtcttttatgttcaaagttagagaagcttctggttgcatctgggtaactactgtcttaatctttactcttcctcaactatattttatggactaaattatagattatagaaatatatgtgaattgggggtttgggatggtttaggacaaccttttaaaagttacccatgcttggataa

SEQ ID NO: 467385 - DNA, 601 bp, Homo sapiens
tatttgacaccagatgtgcagctcactgactgtgaccctgagaagctgctgccaccctcccctttcaaaactattattgctctgttcggcttatgaagagctctagtaaagacagatcatgggagtctcaagatgcaggggaagatggctacaaaggagagaaaacagagcgactatggagagatggagaggacttcactgaaggctcgccaagttctcagcttgacccattgcaaggaatattctcagcacctgtccagtcccaaccaaagcccacagccctggcagagcagcaccagaaaaggaccttcccaaaagggggtaaagctctccatgggggtagagaggaggctgagcaggccaagtgcacacaggtgacagggcctggccacaggtcatgtctgagatggagattccagtgcaaagtgctttcacctgggagtggggatgacggaaaggacagcagggatgtggaagtaccagaggtctggaaccagctaggcacctcacagcccctggatcttgattcgtggcaccaagatcctgccaacttcatttgatttcccttttattttcattacttacagaactcagtacatat

SEQ ID NO: 467386 - DNA, 612 bp, Homo sapiens
tgccaccacaccatttaggtggggggaaaacttgacacagaatggaactcctcagatgctccaggagagaggtggtcttcaaaagcagccagcaggccaagtctcagagaagtgctttggccacagcaggagggattgaatgtcatgctgagcacccaacactagttctgatgctctttgccagtgtgctggtgacttgccttgaggctgctaaactcaccgtaggcttccagaccccctggaacatctcccatccattcagcatgcaaaggctgggtgcaggcctccagattgccatggacaaggtcaactcagagctagtggaccttggaaatttcaccacttacaccaactcagcctgcagcaccaaggagtctcttgctattttcaacaaccaggtccagaacgaacagatttctgccctgtttggaccagcatgcccagaagcagctgagcctgggtgacacagcaagactccgtctcaaaaaataaataaataaataaataaataaataaataaaagaagaagaagaagaaacaaatgcttggttttaaatagaaaactatcaattgtttgagtaggcttttctttggcgtatataataaattaat

SEQ ID NO: 467387 - DNA, 657 bp, Homo sapiens
ttctcataagatctggttgtttgaaagcatgtagcacctccaccttctttctctctctctctctgcctctctctctctctctctctctacctcccctctcctgccagccaagtgaagacatgcttgcttccccttcaccttcctccatcatgggttcagaagaagatggaaagatgaaggaaggttttaaacttcctagagaattggatacttctgtagaaaatgctgatagtgatatggacaatgaagttcaggctgaggatttctcagatggagatgagaaacttattgggaactggagtaaaggtcactcttcctgtgctttagcaaaaagattggcatcatcatgtccctaccctagagatctgtggaactttgaacttgagcaagatgatttagggtacctgactgaagaaatttctaagtgtcaaaggaagcaagatgtgtcctgcctgcctctaacagcatattctcatatgcatgcccaaagagattatctgacactggaagttacatttaaaagggaagcagaacataaaagtttgaataacttgagccccaccatgtagtagaaaagaaaaactcattttctgaggaagaattcaagccagctgcagaaatttgcaagataatcttcaccacggggtggaaggacgg

SEQ ID NO: 467388 - DNA, 491 bp, Homo sapiens
gacagtcagcgggcagccagatgcccaggaacctggaaatatgtggtgtcagagcccatggaagccatggcagctggccctttttcatgcctatccctgtgctggatgatggattatagtcaggacccggggcagacacagcccttttcttgccttctttacagtgaagaccgacataacacaatcaaccaggtggttccccagctgaggggctgtcctgaagtcttaattcctcccttccaagaaaaccagcagctgatcatcatcttaagcagatcagcaccagcagccagatgccgttcaggcttaagtgcccagaaagcctcacggattaattgcacactctgtgtcattaacctccaggcactgaaaaatgatcaggcttctgtctcttacatgtattcagtgagtcttcagggtacgttaaggcaggaaggggaagctggcccctcccgccactttaaagtctaggagggtgaggctatggagag

SEQ ID NO: 467389 - DNA, 1157 bp, Homo sapiens
cgcctgcttagccctcttccgagtgacgcccaactgctaagggaagaatgcctcaagtgagcatgcgcacaactccagtaaacaccgtgcctgcggccctcctgagcactagcaggccgctgtgcacgcggacggcacaccccaagggaagaaccaagggagaagaaatgcaaaccccagagccatgccaacacaaaaaaccccaagtcaagggtggatggagcactgagacctctcacatcgcctgcttggccctcttccgatctgatgttcttcctcatgcaaaagtttaccaggggattcaagatgtggtcgagaacaaactgcatgatctggtacaaggacatatccagaaaaagcctccgggtggacctatggccctggccacaaagtatgatgaccttgaaattccacgtgaatgccccggaagacatggactccagaggaggctccgaacagtcaggtgggcaggtgtatgccccgggaagacatggactccagaggaggctccgaacagtcaggtgggcaggtgtatgtcccggaagacatggaatccagaggaggctccgaacagccaggtgggcaggtgtatgccccggaagacatggactccagaggaggctccgaacagccaggtgggcaggtgtatgccccggaagacatggactccagaggaggctctaaacagccaggtgggcaggtgttccttggacatcacagttccaggaccaggaggaaaaaagaaaattcatgatgcacatcagggcatctgagacaaatgtgagaagcctgtcccagagcgtctgttctacggatgcgtcccactgtgatattttaatttatttctattttgtgttcatattttattttttatttgtgagcccttttgtattaagattattaactctttataattcttgaagctaataattttctgggttaattgaggttgtttctgagagatgtggctggtgggatgacagagagacagaaggagagagagaaagagagagagagagagaggagggagaggagggagaaggcaatgtaatttgccttactttgcttagttgcctagcagaattatactaagattgggagaaggcaatgtaatttgccttactttgcttagttgcctagcagaattatactaagat

SEQ ID NO: 467390 - DNA, 473 bp, Homo sapiens
tccagtctgaggccaagacttgccatgtgtaaaactcacaataaacatgaaagtaaatgcctgttaaggaggagcaagctggttctgaactttatggtcctgaatggcagaggaccagcctctgccatcaccatagatacatctaaccagctgaggcttctaagagccctgagcaggaatgggctgcacctgtcccaaacccagaaaaagctgacatctgtgtgcagaactggctccactagggagcagatccaagggggtgaaactgtacgtgtccagaatatgacacaggatgagggtgtcatggtcagcagctttgacagaagtgcctgccctcccccaacggcattcttcactgaactccaggagcctccttctctcggtttcccttccacgccactggtgctcattttctcccagtctgggtcctcgtcctctccatcttctgataagcactcagtcctctagcctcc

SEQ ID NO: 467391 - DNA, 561 bp, Homo sapiens
cagtttgcagatgatagaatggcagcacaccaggaagtcaacaaagaaaaacttcttataaaaatcacgaaggccattaaggtcaagaattctgggtgtgtggctggggccaggagcagggggacgtgccaggatgagaagaaacctacctgcacgtggcccctacccagcctggaggtcagaggtcgcccctccaaggtgagccatggcaagatcatctctccaaacctagcctggaggtgtcccaatccagcctcttatgaaaagccaaagctccacttttcacccatggtgaagccagtggttaaacctctggctcatcgaagagtcgcacatgttgttgagcaaagacagtgccagccaagggcccgcaacctgtgtgcacccttttctaaggccgtgacacactacaaatacttcaagcatgtggataagaaatactcaacgggtaaaaaaatcccacattaactagtaaaaaatagccaaggtttgttacatgggtaaattgagtgtcactggggtttggtgtacaaatggttttatcaccaaggtagtcagcac

SEQ ID NO: 467392 - DNA, 692 bp, Homo sapiens
agagaaagccccccgtacagtgcatgctaacttggattaaggggtgcagctctctccacccctgcgaagggaagcacgccaatctcccgttatggacagggtggggctggatgctccttcacccccgccccaggctctgctgcacactgcccgtccacgcagcccagcctgctgaggcctcagtgctgccgttttcccggtgcttacgctcgggcacagcaatcgatttggacagggaagccactcccaccctggcggagccccttccttcaccgctggggcccacctccgcacggtccctcgggcctgcaggggcctctgtgcaggtgcatggcgatgtgtcggcgcagggtggggaagcaggaacttggccattgagccagagagaaatgggaagggcgcggacacatgagttatcgtatgcagcagacacgggtcatggaaagggtggtggtgaggatgctgagaggtaccagggaccatctccttccccgtgaacagctactcctgtttcctgtcatgaagactatgggttgcattctcatgcttgtcatccagaaaataagttaggaaaacctgggacgtacggaggatggtttgttaattcctgcgctcctcgatttatatgcataaggctattgcccattcctgcatgattaccttcgttaaaaacacctttctcttgctctaac

SEQ ID NO: 467393 - DNA, 576 bp, Homo sapiens
agcagtgtgggggacttggacggattcaagtgggagaaacaggatgcctataaatttgtattcttgctctaccacgttgattatgccaattcctcaaaatttttccacctgtggtgttgcaagaagagggagtaggaagaaagaagggagaaaatcgaagtggtgggagagatgtggagagatctgcgagcatctgttgaaaggggtttctacaaggaactcaaaacaggccattctttcccatttctgtcaacatctttgtttcttattcatacataacccgtccaacccaagtcctgtgctcaaggacttgttgtgggagaagggtgcagattacagacatggacaggtgctttgcaacctccagcagcaagaactgggagtttccccagtccttgaacctgggcttgactttgacttgcctctgccaattgactgtggtggaggctttgttggaggctctgggtcttgttctcaggaggtctaacggtttattctgttgcccacggatctctgccagcctgtgggaaagatgggacagccttgctggggagagagacactaggtggagaggag

SEQ ID NO: 467394 - DNA, 1511 bp, Homo sapiens
gtaaatgctacttcattgccaccagcaaaatatatcctgtgtctgactcccagattctgcaaaccctgaattaaagcattgacaatgggaatctcacctgtctatcaacaaccccttccacatggactcacttttcctcagcctctccgtggcttgtcctttgaatgctatcattctggtgttattactgtcatttttgaaacagggcagtatatgttgctgacattactagctgtttttggggaacaggtggtgtttggttacatgaaacaatgtttcaatactgtttacaccaggggctttcttgtacaaaccgtctttacacaagacaagaataacataggaaagaactatttgtctctgatctgtgcaaagaaggagagcaaacgggaatcctcaggggctttttcgtcttttaaacctaccaggaggagattaatcaaagtatggtcaactgtgatacaaatggattttgccaaaacatggtcagtgtgtttgaagtttcttgcaagagaaaaatataagaggcaaagccacccaaaatatttctggtcagcagaatgtcacatagatgggtttatacaggatgtagctttttcagattgacttctttctcttagtaacatacatttaagtttcttccatgtcttttcatgacttcatagttcatttattttaagtgttgaatgacattccactctctggatggagcacagttgatttatccattcactcactgaagggcatcttagtttcttccaaggtttggcaattatgaataaagctgttatatacttctgtatgcaggcttttgtgtagacaaaagtttttaactcttttgaataaatagcaagaaacacaattgctgaattccatggtcagagtatgtttagtttttaaagaaactgtcaaactgtcttccacagtggagcaccattttgcattttgcaccatttccaccagcaatgaatgagaattcctgttgctccacatcctcaccagcatttggtggtgtcagcgttttgcattttgttcatgctaataggtatatagtagcagttcactgtgaacttgccaattcctagtaacatagggtttttcaattttttcatggacctatttttcatctttatatcttctttggtgaagtgtctgttcatatcttttgcccatttcttaactggattgtttgttttcttattgttgaattttaaggtctttgtatattttgaataccaatccttcatgagatatgtctcttgaaaatatttttttctcagtctgtggcttattttttcattaccttaacagtatcttttgcagaacagaaattttttattttaaccaagtccagcttactattttttttcatgggtcatactttcagtgttgtatctaaaaagtcattgctaaatccagggtcacctagattttcatatgttatcttcttggggattcatacttttgcattttacactcagttctagtatccattctgagttaatttttgc

SEQ ID NO: 467395 - DNA, 545 bp, Homo sapiens
aggcatccaaagacaaaaagaaaaaaaatacgcaaatgcatcttcttacaaaagaatacttcactccagcaggtgactgcataattgtgggcacaggccctgtgctcattacatggaacgtggtggagtctgaattgacttcctgcagagagaaatccccgcaccccgtttcaaataacgttggttcctctggggagagctgtgggtctgtctgttctcaccgcctgcctctgcttctggcaaaatctctgagccacttctcccaagctggtgcagggacggtggccacttctctcaaagtgacacctgctttatgggcggagcatgggccaggtgaagcagcttcaagttttctaatttggatttctgtgtgcaacctccatcatccaggcccaccagggtgcaggggacctgagttccgatgttcctggcttgtcttccctggagtcgagtctctgtcctctgagagggccctggggggacaaggcagccccaaactctcgaggaacttgtcctctgcatcacgtagttgtgggggatgagaa

SEQ ID NO: 467396 - DNA, 641 bp, Homo sapiens
agcagccagctcggagccgcacttcaacaggtcatgagcgcccacggagatgaatcagctactggcaccaaccaccaccacagccatatgcagcggactggggacgctgacccaccactctacaacactgggggtgcacagctaccctccatcctcaaacagaagcaacagagcgtgaccagtgctgagcaggtcctggagacacaaaggaagagaagacctgggcctgagttacagatggttctgcacggcatgcaggcagcacacaggagtggatgctggcagcaccaagcccctgtgaggtgtccccaaaggacaacggacaacggaaatccccccagggcagaactccagcagtgcccatggatgttcttttttattcttcttgttttttcatgtgtgtgtgtgtgtgtgtgtgtgcgcgcgcacatgtacgtgtgtgtgtgcgcataatatattgcctttaatgttttatttcctagtcatgtcaaatatttgtgttgtaagcaaacagtatctgaatttgccccataaatgcatatttatttattcaaatattaatacaggtaaaataatctttgtgtatctattatgataacttgaactcgtcagggtggtaatgacacaataggggtgcagcc

SEQ ID NO: 467397 - DNA, 1614 bp, Homo sapiens
accactgatgaggagtccatttctctcgtgactaatgtggatggcttttgctgaatggttgctctatcaatttgtgctagcctgacctggtgtaaagttatgtctctaatctccaacttgctgatccaaactaaaacttgcgaaggctgcagagccaactctgctgacatcatacctccagggagagatgagggggacattgttttcattgtgtcttccttaacagatacagctccaaactgtagacacagtttcatggaacacttagctatttttggtgaatgtggaggaaatgggcccccagggaatgagagcaggagctggcgctcttggagcaggctgtggggtgctcaccgaagaccctgggcccctcagcgatggttacagtgtacagcagcctggcctgccagggcccaggtgcagcgcagaagccagaagcccttgagaattaacagcctaacccgaagggagctggtgcataatgctcccagctcccacaagccccggagtgggcagatcccagccaaggggtccaaactgacgtccgtggatctccagcctggactgaggtccacttactcacagtgaatactggctttggactgaagccaatactggctgtctctactttcctgaataactccctaacttttaccaggatgtcccagggtcacttcccaataaaagccatacctcacatctttgtctgggtgtcctcttttggggtgaacctgaactaagagagccttcatactttatatgaaagcatatttctattaacttattgtgtactggtctaaaaagatagccttctatacttgttagtgaagacattgttgtaagagttatcactgttattttttaagcaatagcttagaattcttagagtatttcacattaaggaatgccagttctgctttttcaatagaaagttcttcaccctttccaagaaaaatttgaggatgtagaataagaacttacaagttatgaaatttatatagatgagtttatcttgggaatatttaaaaagcattcactaaactgtgtgctatatgcaggcagacacagagtccatttggtttttgtagttttctatatttattacaaagaagatatgacacttctgtgattaaaacaattaaatctcttttaatattctctggtaaatatttagctcagaaaccttaacttttcaactaatttaatttttcaactaatattaaaattaattaatttttcaaccaatattattttttcaactaatattaaccttaatttttcaactaatattaaaaaatgtttataattagagagctgtgtcttttattatttgaaaatcccaatttattattttttttgcttccttgtaattaaattatcaggtaaatgctagtccttaaatgtctgtcctgattccctgccttattgaattgaactaaatggactcattttttgcttccgtcggctgtagtgatgatttcctgatatttgcagatgacacaactcaggaagatttgcaaggggcattccttgttgcttatgaccaagtaagtgatgttccacaggaagcagtgttgttttctatttgttgtacatctaaacttttgctagagc

SEQ ID NO: 467398 - DNA, 677 bp, Homo sapiens
cgacgtgctggagaaactagagctgctgggaggagaggaggatgtggccctagacaggacgttcagtaggatgttgagtaataaccacaggaagaaacccctttgcctgggtccccgtcataaggggaagatggtccatttctcagctcctgatgcgatgctggctgtaagagagggacgctggaggaggggctgggaattggctgctggaggaggagaactgcccttccgtctgggcaggaaagcactggccaagcatttcctctggggagcaggtctgtgttcaacacagcagctttcttcttcctcctcgcagagacgtgaggtgatttgtttgactgtccgctatgaaaatctagtggggttccagggtgcaaacacacagaagtgtggggtccttctaagactgcagccccacgcgctcctcatttttgtgtcagtccatgacccacctcaagaaatttgtcataaaacatccacgcattctggcaaatttgtggctctgtggctctggcttcaggtcagctgccgtggcctgtccctccagatccagggtagccccctgtccttttgggggttctggaatgggcaacaatgttcaataggtttagtttttctcttgggttcaggataggagtgacagccttccagtccatgtcagagctgagagcagaaat

SEQ ID NO: 467399 - DNA, 646 bp, Homo sapiens
tcctctgggccattggcttgctgggatcccagggcatgactattatctttgtcccctctggtcttcacggacactgcactgggatgaagggtgatggtcttgctcctgtcccaggagctctcaagctggcgtggaactcaaagttgtcctctgaggagaggagacctgggcatgtggcccacacaggggaacacacaggggaacacaaggaacacaacctaaaggtgagggcagacattggatgggacgggtgcaaccacaagccaggaataccagggacagcagagtgtggaagaggcaaggaggctcatcccttggaggctttggagggagcttggctcccaaacacctcgatcttggactttgagtctccagaacacagagaaaatcaatgtctgggagtgcaagccctccaccttgcggcgcttcttgatggcagccctgggaaatgtgtgggctctcaggggcagacacgtgggcatggactatgattctgcaactttctagggatgctaatttaggcaacttagttaatctttctaaacctcattttcatcaaatgtaaagtggatatggagagactgcttaagtcacatggctattttaagagtttcatcaaacatttgaaatacttcacctagtgtct

SEQ ID NO: 467400 - DNA, 2012 bp, Homo sapiens
tgctcacatctccctctttctacgagcaataatgatgatgatgatgctgctggtggtggtgattgtgaagataaggataatgaggttgtatcatcataattatggtggtgatgatgatggtattgatgatgatggtgacatgatattgatggggatagtgatgatgagggtgatgacgatggtgttggtgatgatgatggtgatgaggatgatagtgaatgatggttatgtgatgatgagaatgatgatggtgatgatattatgtcatggtgatgatgatgttgatggtgatgaggatgatgagggtgatggtgacagtgatgatggtgatgatgatggcaatgatgttgatggtgacagtgatgatggtggtgatgatggtgatagtgatgaagatgattatgataatggtaatgatgatggtggtgatgatgataatcactatgtcacaaaggagacagggctgtgtcctcacatggaaataactgagctgctcaagcctttccttcctggtgggatccccaaccgccaccctgtttccaagctgggtttttacggagcagctgacaagaggggaatgtactgcacgctgctgatcggtgcacttaaaaacggttaagatggtataaagtgtgtcgtgcctctgctcgattttagtgatacaaagatcacaaggaatacatgctccctttttatacggcgtccatagaaagatggagtaggagataaattgaacaaagaaaagttaagtgattgcaattcagataagaactatggagatgcagagagtgttatgaaaattatcaacagggcacttgactttgtggcaagtagtctgtatacacaattactttataaaggcttaaatgtatgaattatttataaatgtccaatatagctttctactgtaattgttcaacaatatactacatcattacctgcgcagtttgtatcagattgtgctgccataagaatttggtgaggaaagacatacagaaagacaatcgcagtgcctgacatgggctagatcagtaaagagtagctgtgatgtctggtactattggtggttgcagccagatggtagcagcatatattaaaattataatttgtctggatgttgagagctgcaaaaacaactataactcttttcctaatcatgaactatttaatgaatttttccctgtgaagagcttggaacagtggctggcacatgacaactattacacttattacccatgctattaacattgttacaattattattactattgttacaggcattctttagggagagacgtgtttcttgccatttccaaacaaccaataattgcttgtggctcttttttaagcagtttatcacaggaaaattctgcatatgcttctggtttgccctggccgcgtctccatctgttactcagtttctctcatggattcgcaacccacattcaactgccttttcaacttgcaaaagggtcttgttttttgcatgactctttatttttaatcataaaaagtaaccattttgtgtgctcgtttttctttgtcctacaaggatatagcgtactaacctttattcagtgctgagtcatttgacatttgattattttatttatggaacatctctcttttcgggcacgggaccaccagctgcttaaaatctttgatattgtctttgcctctgtcaccctcactagaggttgagttctttgtgccattttcttttacacagacagcaggatgttgtttatccagtaggcgtaaatatgcatgtgacatggcctggggtggcgggggtctcaccagaatgcagaccctggatggtgagtgaggttggttaaccaccaaagaacgtatgcattcagacatcaacataattgtccctcctatacctgtggtttcttgagaatagtcaaatttggagatatgaatttttgaatcccacgtacttgtttactactaaagtacagtaatgtttattctaaatactcagcaaaatatggcttccttttaac

SEQ ID NO: 467401 - DNA, 543 bp, Homo sapiens
caggtctttcctgtgctgttctaatgatagtgaataagtctcatgagatctgatggtactgtaagggaaagtttctctgcacaagccctctgttttccttctgccatccacgtaagatgtgactcgctcctccttgccttccaccatgattgtgaggcctccccagccacgtggaactgtaagtccattaaaccactttctcttgtaaattgtccagtctcctcagtgttagagctaccgcaggaccactggattcctggtgctgctgtgatttgcaaccacacggagcctgttgacatcctccacatcctctcctttctcagcttaagagggtctctctctgggtcttctgaactcagtgtgacgaatgaggactataaaatggaaggaacgggggcaataatctcatggtataatactgccttcctttggtctacccaaaaatcactaccttgataataagatataataataatataacaataataataaatatatctgcgccttcattttcattgcagcattattcgtaataggcaagac

SEQ ID NO: 467402 - DNA, 653 bp, Homo sapiens
acgattttcagagaagttcccagatactatttttttaaatcaaccctccttttaagccagtagggactgtgaaaacaaacaaacaaacaaacaaacaaacaaaacttatcatggcaacaacaatccaatcctgtattctgaacttgggtttcctgtatcagcctctctggcaataccctgagatagatagaaactgtacctctttctgttgtataaaagtgggcaccaccagctctgggagttacattcctgcaactgagcagaatcgcccatccagctccattgagcagaatcgcccatccagctccattgagcagaatcgcccatccagctccattgagcagaattgcccatccagctccattgagcagaattgcccatccagctccattgagcagaaccgcccatccagctccatcctgccacctggacacaaatggagctttttggatgcctattcttctgtctcatttcataaattcctgaagacagtgaaaggcaatgcagatgggcttaattattatcttcttctgcctgagcatgctgtgagaaaagattaacgggagggagagaaagaagagataaaatatccatgacacaaattagtatttagcatacattttgaaatcatgctgtttctgccagcttcatgc

SEQ ID NO: 467403 - DNA, 548 bp, Homo sapiens
gttgagctgtggtgttggcatgtgagagggcgggttggtttaggtccgacgtttcccagcagcagtccatgccagaagacacgatcagcccccatattcagatctcacaatcacagctggagaaaacagtaaaggatgcactcagtaaaccttgccctcaggacagacttggtgtaaccaaccccacacctccaggagcagcaactcactattcatctgctcaagcagccaccatccggatcatgatacaggttgcttcagagccctggggcgctcctgcatggcccctcgcatcggttaataacccccagaggcagaaagttacaattactttagctaaaaaggcaatgaaagaggctgattcacagaataaaaatgatccttcccacggccctggccctggctccatacttgcaattcactttcatcctcagtcccatctgctgctccaggtccctcaaccccagcagcaggttcattggtctttattgtttgccaggggggtcagtaagatcagcatatctcaggaggagtgaggctctggttac

SEQ ID NO: 467404 - DNA, 647 bp, Homo sapiens
ccgggagctctggtcccactttctcaatttctctcagagatgactgaccaaacttggccaatcctatgtgtttcagggagaattccaggcatggaccaagtgatgtggcatcagcaggtccccatcagagctgtggaggtggcttctgtctcacgacggttcttgtcttctttgctcacaaaccccggaatgctcttgatctctgcgtcttccactcctgttcctcaggtttcatcaaagtgaaacttgagtttaagaaatacccaaaatataaaatgcaccttcatccaatgcaagctgagacagttacaaacaggggtgatgaggctggcatgagactccaccggctacctgctgggtgccacgaaggctctgggatcctcgaatgctcagaaaataaagctgctcttgcagaactaaaatgtaaaaagttctcagcattagagaagattgccccattcctccactgtacaaactgcagtaaatcaccaagaatagaaaaccgggagataattcagcatacttttcattatttacctccccaacctccatcactctgaatctctctggtgacgggaaacctgtagctcatccaagaacatggctttcctggattgcgttaatgtcactcaacgtcttttcctgtt

SEQ ID NO: 467405 - DNA, 723 bp, Homo sapiens
ctatgaaaactcccagggttggtatgaaactgttccagaatattaaaatgttaaggtattttgaaaaattaaagcaagaagtaaataaaagacagccagccccttcattttgtctgctagtctgttttattccactcagcatccctcagcccacagtaaaaagccttagggtgagatcccctcatcgaaagcagaccagcacagtctctctttcctgcagagcacttgggattcagtgggtcccatcccagaatctcttttctacagtcattgcagcagcttttgcccctggtctgccaggccctgcattttctggaacagtggaacatgaatttcatggatgtccaacagtgcattcaacatgtatggttatctatgcattcaacacgtatgataacacgattccgtgtcccaggcactattccaattggcaggaacaccatgatgaacagacacatcccttgtctacatggagaagtttagattccttgcctgcatgttgatgaggacctgaccctaaaatttatattttgttacagaactctacattataagacaaataatcagattttccctaaaagcaggaatgattttccagcctcaatatcaagcataaagagccttttgtgaccctacccacctgaaatcgaaagttcactgaatttttcaaccatagagttagggctccattgagagttgtaaccgccaacactcagttgtatt

SEQ ID NO: 467406 - DNA, 673 bp, Homo sapiens
cggaggcaagttctatggcaggaatggaagtctacttaaagagggcttataacaggaaagaacgaaaggtgccctggcacatgaaggttaaagagaggtcaagtgtccggtttaaccgtgatcttaagattttgatagactcaccccttttccatgattcttccctcagggtgcactgtccgcatgcgcagagccctccttgccctgggaaatgcgcatgcgcagtgtgcttagggacggacaacacaggtcccgctgaggtttccttcccgtgtggaccatcaggaaagggcgcctccccggcactgctggattatcaccctcagagaggcaatgcaattattgctgaaccatcacccgatgtttctcgtgggtgggggagagccgtctcctgcccctctcagccagtccaaccacctgtcacacacgtgcggagctcagtggctttccgtgctggggcacaggcaagacaacacgtagaggatgcagaggaaacggggttagaaatgtgcagagccaggacagacgagaggataggatttgaaaaggagcacgtgggtagtttagtgatataacaaatattttatttcttaatttgtatgatgagttcatgaatacatcttccatcattatgcttcgtaacttacatatagtttatattaccatacattgt

SEQ ID NO: 467407 - DNA, 633 bp, Homo sapiens
gaaaatacttaacgtcataaagccatgcccaagcacgtctactgctatgacagcaaagtgacagtgaaacccgcctctgccttcccatccttttcagaacccaaattccttgagtatgaaatttacaatgaactggcagagagggaagcctggcaaaccagccgtctggagggacctgtttgcctgggtgacatttgcaggccacactgtcctggtttctggattcagaaggtttggtgtctgtctacagggacacacagcactctggtgctggcgtggagcctgaacgcgagcggattcaagacaccaagagttagagaagcagaacatagagacctttatgtgggaatgttgcagacctgcagatacttctccctcatgaagctgatccctatgagtctgcagatatttctcgctcgtgaatctgatccctgcacttctttgacagcaacaaatcctgtcttaattcaggtgctagagaggccaacagaattgcctgactttaaaccactgttcccacgttcccagctgcctttactggtctcatcttcctattgcccactacacatggaattatcctgttctatgattgcttaattgaattcagctcattttaaaaattacaattatttc

SEQ ID NO: 467408 - DNA, 858 bp, Homo sapiens
acagacaagaacatcctgactccacacgcatgttgaattcttttctaaaaccgttattgctttgcaggcgtctgacgtgtggtcaggaagtgcgctggagcagtgccgcttccagaacagggtaggcccagagggtcttaatcaaggattctccagtgtcccaggggatgcgtgaaactctccgctgtctttctggtgtccgcttgtccctcagagcccctgatgctcgaggttcccaggacactcagctccatgggtcatttgctccccatctgccactagatctttctcttgctctccctgttagctctgtgggaacacaggtacagccaattttcaaagtactacatagcaccagtatccacacgagccctacgaaccatgagccgatgggcctttcaaatcactggaaacctggaattgcgtccaggacacacactcggccacattctgaatctatgagtcgaatcgcacctgggcctggctcgctcctgtttcttcacgtcacggagtgcagattttctctccaggatagcgcttctattattgctctgtttcccacgtgcaagttttcttctcatgctcagccaggcttgttgcttgaacaaacagcaaactgtgatgttccgacaccatctgggccaaggaggcagcagaccatgttgcaatgtgacacttggcacaggatgacgccatcgccaccaaagcccctgtgctctggtggaagcaaagagactgaggtcaaccacagccactcctgaacaccaagctcagcacacaagcaatgtccccctggagctgatcctgcaggcttcccaccccacattcccacagtgcctgatctgttgccagagagac

SEQ ID NO: 467409 - DNA, 603 bp, Homo sapiens
aatattcctttttttctactgaatactacagaaagctaaaatatgatgggtgtctcctctatggcactggtgccagggactggacaaagtacacattatagccgagaccctgggggccggggcactgatcagagggtgcagaaaacaggaaatgacccagcgttcataaatgtctgtgctttaagttgttacaaaggccgtggtatttgttttactcgatggattgatggatgcggtaaacgtggattgggattttatttctcagcaatgcaagcagctaggaaaggcagagactttgaatgctgctcaaatgaaatacaggagtgtgccttaagcgctacgctctgcacaatgccaggaattttgaggaaattcaaagccgatacttctcaagcccagatatcctcacattattcacatatgcactacatttttctagacactatgtaatcatgtaactctggatggtatttcagatagagggataacctgaccaacatatcttttgtgtagcatgcccttttatttgaatttcttgtaaagaagtaacgttatagaaattgcgacattttaaagcagcatgtgacttaagtacctatggat

SEQ ID NO: 467410 - DNA, 476 bp, Homo sapiens
tctggaaaaaaggcacggaatcaaacacagtaacatttctgccaggaaatatgcagtagtaaatgaactatttttatacactggttcctctgttctatctgtacagttatgaatctgtatcatacaagggcattttttttataagtcaactttccatgttccccttttgccaaactctttttcaagtgtctgctaaagtcaaggtctatgataaaacaacatccacatactctcagtttagtgtggggaaaaggatcatggactctgagattgatttttacttcctcagaggccaaggcaatgaaggatgtttccaaagggtatgcccagacctcaaagggcagggagacacctgccctatggatgataatcttcatcctttaattcccacagctctaggccagaagtctttcctgaattcagacaagtgtagcaactgtttcacaggcttttcaaactcatgacttttaaaacca

SEQ ID NO: 467411 - DNA, 518 bp, Homo sapiens
taccccctagtttgatcaagcatttcaggtgaccatggtcctgactgaaggcagatacctgattcacattacggggcctgcaatgagtccaggcattcgtggagatggtcaaaaacctactccatcagcaccattcatctggtcaccccttagtgttcacgtcagacttggtgagcaagcaagcaaaaagggcctctctgaacagattctcatgctgcctgctatgtcaggagtaagcaccttctttgtctctgactcaggagtctcaggtcatgctaccatcatttatgaagttgtgattgctgaacatgttagattgcaaacgagtaaacaggaaataagtgatgtggcttcctgtgttgtttgggataaacatgtgaaaaggaagcctggagctcttctgacctggcagaagctgacccaaaactgcccacctgagagtcattctaaggaactccagagagagggctagggtggcagacagacactgggacctgcgtgaactttaacaaactgcc

SEQ ID NO: 467412 - DNA, 1136 bp, Homo sapiens
ccagcgggaccttgggaggacatagagggaagacgccttctgcaaaccactgagagaggcctcgaggaaccagccctggccgacaccttgatatgggacttccagcctccaggacgattgcatgcatgcacttggcaaaacctgtaggtttcacttcagaaacattaagttccaaaaaggctacatcagcccctgctttacccctgagttccgtgcactacctgctcgtgtctccaaatacggcaacagggcccaccgccggcgctgaggatggaacagtgaacacagcaagccacgtccttcctcctagggcccatattctgatggaaggagtcagacgaaaggcagagaaatgcaatagaacgagagaaacactcagtttttccaagttgaggtcagagaggaacagtctctccataccccacaccgttcagtcacttagctcagccaccgtgggaacagtgcatgaattgcgacaaggctgctcagccaaggccctctctgaagatgaatcagtgatagacgctgtcttctggaagcattccctgcagcttgcatcgcggccctgagtgcatagtctattatctgccgcttgccggcttcatgctgtcatatgtttttttcagtagtcaataaattgctgaaggccacatttggagatatatcaatatttatttgatatgctctaggctggaacagttgggaagtgtttaacctgaataaatctttttccaggagtgcatacttaatgtggcaaaaagctgggtaaagtgattactaaaacatttattttctccatatccataatgcagtggcaaaatagtaaacatcagtatatttattaatttatttctgtttctggcttgaaaccaagtgctaaggtttggggaatgaaaataatgggatatttatcttgagaaactttacaatgcaaacaaattggaaaattacctggtatagataacatgatgtttcagatggaagctgtttgggaacagctaatggtttctcacaagcctcagtaagcaaaatatctgcgtttcgaatgtattgattgagttttatgaaattagaaacctgatcagtgacattttccgtcattcccgagcactttgatgtgagtctcaagtcttttc

SEQ ID NO: 467413 - DNA, 1014 bp, Homo sapiens
tccacattcactcgctttctgctgtgtcttctgcaggcctcagtggctgtgcttccctcccgtgggatgctctgggctagcctcccacctcttctactcacaggggaaacatcagacaagtatcagctgaaggatattttacaaaaccctgacctgcagtcctccagatggtcattctacaaacccccgaccagcagtcctccagatggtcattctacaaacccccgaccagcagtcctccagatggtcattctacaaacccctgaccagcagtcctccagatggtcattctacaaacccccgaccagcagtcctccagatggtcattctacaaaaacctcaaccagcagtcctccagatggtcattctacaaacccccgaccatcagttctccagatggtcattctacaaacccccgaccggcagtcctccagatggtcattctacaaacccccgaccaacagtcctccagatggtcattctataagccccgaccagcagtcctccagatggtcattctacaaacccctgaccagcagtcctccagatggtcattctataaaccccgaccggcagtcctccaaatggtcattctataaacccgaccagcagtcctccagagggtcattctataaactcccaaccagcagtcctccagagggtcattctataaacccccaaccagcagtcctccagatggtcaaggtcatcccacaaggtctaagaaagtgtcacagccacaaagagcccaagagacctgactcgtaaatgtcacatggcacaaagataaattaaaaattgaggaaaactaaatagagtatgaactgcagttagtaatcatgtactaatatccattcatgattgtgacaaatgtaccatactaatatgttagtcacacaggctggtgggtgtgaaatgtggcagttatctgtaatatcatctgaactttcctgcaaatttatacctaccctacaattttcaaaaaagtttatttaaaaaattaaaaagttggcc

SEQ ID NO: 467414 - DNA, 753 bp, Homo sapiens
gacccgaaaatgctcgggctgcgttctggacccaaacagaaacaaggttacttctaaaggcacaaagagggagggaagatatgagaggaatccaaacagctaaagttaagcaagtattgctcacagtgaaatcgcaagccttgcagaccccatgtggagtgtgagctctgaggctggcggccttcagaacagatcagctgcaggggaaacctgtgtgtgcagaaaagctcgagtgaagatgcaggaaagtctcacaacaaccaagtacaaatctccccggccacaacaaatcaatggcattgttaaacttggaaataatccatcccagctttcatatcacctgtctctgtgccgactggctgctggctgctctgtcttcctatacaaccatgctgcacaagcagccctgaggctccgattgactccccaggggtcagtgtcctcaaagggcagcacagccatgcaagcggactggacggagatggcaaagtctcacattttcatcaagtgccgtgcgtgctttgctattgttgctgttttaaatgtggataacatacaatttaccattgtaaccattgtaacggtacagctttttggcattaagtattaggttggtggaaaagtaattgctggttttgccattacttctaaatcagcaattgcttttgcaccaacctaatacattcatattgttataccaatctccagaactttcacctgccctaactgaggctctgtaccattagtgtgaat

SEQ ID NO: 467415 - DNA, 977 bp, Homo sapiens
ccaggccacctcgccctcactcaggtgacacagcctaaaaattcttgaaaacgggtcaaagtggagagaatgggaggatgagaaccagtgctttccccatccccaaacacaaacatcaaagtacagtgggtggtattagggtgtttatagaggagttgcttctgctgcaagatagacaagaactaaaggtggaaaggaagcaagctcctgaaagaggacaggtgcgggaacatccaagactctcagattctacgtcattccctgcagggaggcaagatggcaacgtacgtcctcatggagagaaacgtgaatggacttcaaggggatttctggattcggatgagcagaggagactggcgagagcagatggggggaggagctgcagctggattgcagactttcctttttcgtcattggatgtgtggatttggatcagcgcagacgggaacgctcagatccacaaccagaaattaaaaagttctcaagggaaagcctgtcccatctacattcataattccaaagacacctgtgcattccgctgcctgtgtaaagtacacaccatcaatctttgtggatttactcttgcatgtttagtatacacaattttattggaccagttccaatctcagaaacgggaaagtatgctaaagcagcagctgagcttcttccacatttgtgccaatttgttcaattcaacttcaatgaatgaggccatgaccaggtgtgtccaagacatggcagtaggaagcacatcacacaagctcacgaagagctacagatggtaccatggcagctgcataatgctgcaaaatagaggggctctgcttatgaaaatgaaaggctttccagccataaaaaatgaaatgcggttaaacctaacagttgagcaagttgaaattgttttaaaatattgaggtcaaataattatatttcaaacagattaaaatctctatgaaatgaggctatataagaactac

SEQ ID NO: 467416 - DNA, 709 bp, Homo sapiens
gaccaggtccctggagaagctgcgtgaagcccgccgtgtggtagtgcccacccgggctgcctgcagtgaaagtcattttgcactaagaaccgactcttttgggagtagcatctgctcctccaagccctgatggagagccctttctcctgcggacagcagcagcgtgctgagtccatgagtgatgacgatgaaggcagtccacatccctcccttcagctcccgtgtgggtagagcagcagcgcaagagagctttgttatacaccgaagtccaggtgagagtgccacagctgtcttgctaatgcacctgcaggatcagggaagatacagagacatactcacaagccatgagctgctaagcaatcgggaaccctgcagaggaagccctttcaaatgggaagtcaactgccaaatgatcaggaggtgtgaaaggaagaaccaatcacaaaagaaaaacagaaggcaaccttccacctgtaccaacagagcagataagtgcacgtgttccctggtgacaggaggcagcactaagtctcttttggaagagacatttctcctaggagtcgagctgacaatcccaagaactatgctaagtaacaatacatctgtgtgtgtggtggccaaagtgactccaaagaaggagctgtgtgtgtcactgtcacagtcgtgttgaaagcatattgagacagctgtgttcagatgagagggtttt

SEQ ID NO: 467417 - DNA, 1870 bp, Homo sapiens
ctgactgtcagcctgtggccccggctggcttttgaagcactgtttgtggcacccagccgtccataacacagctaagatctgcctgctcacatcacattgcacatgggcgtttgctgtgatgagaagtcattgcatgtttccaagcagccattctcaatttcaggtggcattcctggcttctcacaggattctcagcacaggagcagaggagtcacccacaccactgctcaaaccctgtgtggcttcccacctaactccctaaaagccaatgcccttccagtggctgaaggccctgcatgtgaggggccaaatggccattccgggctttgcgttgtctcaggtgactggaccatgccctggaatttcaagcacaaaggtgtagaaaagggggttacatctccagggaacagccttggagcacgtctgagaaaactgggaagtgagtccaggtctcccaagtcgactgttttacctaggaccgagctccctgtgccgcttccagaacacctgcttcacctgctttattctaaatggggaatttacgcaattccacacccattgacaatgtgctcgtcttctaaggaacgtttttatagctcatcactcaaatgaagccaaaaactttacggaaacagatgttgagttcagaccagttggttgctcagtgctagattcatgctggatcctaaatgtgtacattctaagctggttttgtcgatgggaggcggtaaaaacaatgaccattctatctgccctgggttttgcaatatcagaacttgtgcttaatcaccttccatccctccagagatgacatcctcagtaggaaatagagtaacagaaatcatttcctctctcctttttccttctgtaaagcatatggctaatctaccctgtgaaaactccaatttattttagcattcatgaaacttcatgactaatttcctgagccaaagtataattactttaattcgactctgctggagagaatttgaaaacaggacttctttagaagaaaattaacttacataatgagagaagagataaatcatattaactctaattaaagtatattaacattttggttgcatatgaataaaaatcagacacaatgaaagcaggtttctcataaagagtcaatttatggagatttatgaagattttagaaacttgcaaaatttcattacttaacatctctattaagatctttacaagcatgcataatgaaaagcctaataaaagatttaataaatggacttttgcttaaagtcacactgattcagtgcaagcaaaggttttaaacccctcatggagattaaaatgataattgtcaatttaaaaaatacatatgctttccacgtggtgagaagtggagagttagaacatcagaaagtcagaaaactattcttagccaatgtcagtaattccacggctttgcttcgtatcccaagactgtgatgattacctccgtcttccatattatgttatctagtacatcatagatgacatattacctacaggtaacatattaactgtaaataatagactacagatgacatattaactgtagataccacaataactacagagtcctggaaaaaaatatgaatgtttctttaccgtgaaaccatatttcaaatgctcctgtttcacctcaatacaagatatttagctctgtctctatgtgtagaacaaaagtctaacacaaatagtagacttccaggtaagcttacttaagtttaacttgagaatgaaaagaattaatttttcttccaaaatgctgtttctccaaatgtatacaatgaaactgctcaatgattgaattttcagtattgctcctgagtagctcgtaaggtagatgctctcaaactac

SEQ ID NO: 467418 - DNA, 527 bp, Homo sapiens
gacggtgcactacttaagatgcaattattcaattgaccgtacatgaatagactttaccaatggcaaagctggagatgtaaggtcacaacatctgacactgattggttaaaagcagagattgggctcagagtcctgcggccgacacctcctcaccatgttccacccttctctgcagcagttcctaagggccatgagatcagtagtgatggccccattttcatttttgacgttggtaatttaccattgataattctccctcttttctccatagtgctcacttctacagagataggcttgcactcaaacattctagcatcgaatacgggcgtttgcagggtaagccctggttctgtgcactgtcagccagttttcaggagacagcagatcacaatggataaagttacagaagaactgtacctcctcttccaaatcccagctcccggttacagaaccactgtcgtgtctcccacgtgaggggaagtggtttgaacggttgctggtggccttcacttgcgtgcttgtcagcc

SEQ ID NO: 467419 - DNA, 654 bp, Homo sapiens
gcaaggacacactgggtgtctgatgcatcgcatagctatgaagaaagagagagatgacatcttttactctgtttttactcctgatctccattgtgaaggctcaacctctgaacgggtggccctcttccacctctttgggccaacgctcaggggccctgtggactctgactttccagccacactttatgtttatccaaaatgctccatggtcatatttgaggaaactttggcttctttaacagaaaaggttccatgtgggggcagcagaagtgaaggacggatctcttggaggagaagaaagactgaacctccagcctcagcacgctctggtcttgggcctccccgttgtccgtgggttcagaccagcaccactccacagctttccatggagcagaattcgctgagagcctggggaatggtaaaggcagctacggccaggagcctctgggctggctggcagatgtggctgctctctgctcctcgtgggcacaggccatcttcatgggatcccaacaagtgcccaccatggcaccagccagcttttcctcactttcctgacaaccaccacacaaaacgaatcctctgagcccagccaaaggaacaaggctgcccacaaccagcctcagacacagtggaagtctggctgtgatggga

SEQ ID NO: 467420 - DNA, 561 bp, Homo sapiens
gactttgactttcagtcttttctcagttaaaataggattgaaaacacggaggcttcctaatgcacgcaggttctataagaagcatggaaaaccatgcacagagaaagacttggaccattttcctctcggtaagaagcacaggaatggtaaagagggtaaaaatgacaatccccttcgcaacaaagattacaataactaaaaagtgcatgctcctaggaaacgtcattgaggtcaccttcatgccaactgctacatttcctgctccttctgcaggttccgctgcgacttccacggggccaaccctcctggaagcaggttccactgagctatccatggggccaaccctgctggaagcaggttccactgtgacttccacggagccatccctgctggaaggatttgggccaggaagttttgatcttcagtgtctccactccttaccatttctattcttggaaagtttattaaaatagaccataaaattatcttggaagatgaaaaaataaggttcccaaagtgctgtgcacacctgaaatgtgaacgtttgggagggttgttgcc

SEQ ID NO: 467421 - DNA, 967 bp, Homo sapiens
gtctcctcctcgtgcctgtgtggtctgagagaactggggcgtctcctccaactggggcgtctcctcctcgtgcctgtgcgtctgagagaactgcggggtctcctcctcgtgcctgtgtggtctgagagaactgcggggtctcctcctcgtgcctgtgcggtctgagagaactgcggtggccccttgtgggcctcttggttctggggacagaggacacttttcactcagcccggggacctttggttctttctgtgaagatggcgcccatgagatgacgccttgtgactcagcccttaggtgtggggatggctgcactatcactgacacccacacccatgcccacgcctacaccatcacccctgcccacacctgtctctcccacgaggctggaaggagccgcgtaaccacccatgcccatgcctacaccgtcacccatgcccacacctacagcctcacccacacccacactatcacctacagcaacaccgtcacccatgcccacacctacagcctggcccacacccacaccatcacccacacccatgcccatgcctacactgtcgcccatgcctacactgtcacccatgcccacacctacagcctcgcccacacccatgccatcacccacacccacatcatcacccacactctcaccatcacccacacccatgaccacgcctacaccatcacccacacccacatccacactcatgcccatgcctgcaccgtcacccacactcacatccacacccacaccatcacccatgcccacacctacagcttggcccacacccacacacccacaccacactgtcatccacaccctttcccaacttgagtgctctcctgtgccctggtgcactgaatgactgtggccacaggaggccagaagcccacacagaggacggaggggacatcagatgatgtgtaaggaaatgtgacaaaaggtttctccacaatgttttac

SEQ ID NO: 467422 - DNA, 2467 bp, Homo sapiens
gtgcccccagaatgcggaggcgccttgctgtggggaggcgctgtgaggaggcgctgagtactggtgagacactgaactgtgaggaggtgctgtgctgtgaggagatgctgaactgtgaggaggcgctgagctgtgaggaggcgctgagctgtgaggaggcgctgagctgtgaggaggcactgagctgtgaggtgctgagctgtgaggagatgctgaactgtgaggaggcgctgtgctgtggggaggcgctgagctgtgaggaggcgctgtgcagtgaggcgcttgcggaggcgctgggcagtgaggaggcgctgtgccgtggggaggcgctgggcagtgaggaggcgctgtgcagtgaggaggcgctgtgcagtgaggaggcgctgggccgtgaggaggcgctgggcagtgaggaggcgctgtgccatggggaggcgctgggcagtgaggaggcgctgtgcagtgaggaggcgctgtgcagtgaggaggcgctgtgcagtgaggaggcgctgggccgtggggaggcgctgggcagtgaggaggcgctgtgcagtgaggaggcgctgtgcagtgaggaggcgctgtgcagtgaggaggcgctgggcagtgaggaggcgctgtgccatggggaggcgctgggcagtgaggaggcgctgtgcagtgaggaggcgctgtgcagtgaggaggcgctgtgcagtggggaggcgctgggccgtggggaggcgctgggccgtggggaggcgctgggcagtggggaggcgctgggcagtggggaggcgctgtgcagtggggaggcgctgtgccgtggggaggcgctgggcagtgaggaggcgctgtgcagtgaggaggcgctgggcagtgaggaggtgctgtgccgtggggaggcgctgggcagtgaggaggcgctgtgcagtgaggaggcgctgggcagtgaggaggtgctgtgccgtggggaggcgctgaactgtgaggaggcgctgtgccttggggaggcgctgaactgtgggcaggcactaaactgtgacgaggcactgtgcagtgaggaggcgctgtgcagtgaggcgctgtgccgtggggaggcgctgtgcagtggggaggcgctgggcagtggggaggcgctgggcagtggggaggcgctgtgccgtggggaggcgctgggccgtggggaggcgctgggcagtggggaggcgctgtgccgtggggaggcgctgggcagtgggggtgctgaactgtgggtaggcactaaacttgcggaggcgctgggcagtgaggaggcgctgtgccgtggggaggcgctgggcagtgaggaggcgctgtgcagtgaggaggcgctgtgcagtgaggaggcgctgggccgtgaggaggcgctgggcagtgaggaggcgctgtgccatggggaggcgctgggcagtgaggaggcgctgtgcagtgaggaggcgctgtgcagtgaggaggcgctgggccgtggggaggcgctgggcagtggggaggcgctgggcagtggggaggcgctgtgcagtggggaggcgctgtgccgtggggaggcgctgggccgtgaggaggcgctgtgcagtgaggaggcgctgtgcagtgaggaggtgctgtgccgtggggaggcgctgggcagtgaggaggcgctgtgcagtgaggaggcgctgggcagtgaggaggtgctgtgccgtggggaggcgctgaactgtgaggaggcgctgtgccttggggaggcgctgaactgtgggcaggcactaaactgtgacgaggcactgtgcagtgaggaggcgctgtgcagtgaggcgctgtgccgtggggaggcgctgtgcagtgaggaggcgctgtgcagtggggaggcgctgggcagtggggaggcgctgggcagtggggaggcgctgtgccgtggggaggcgctgggcagtggggaggcgctgggccgtggggaggcgctgggccgtggggaggcgctgtgccgtggggaggcgctgggcagtggggaggcgctgggcagtggggaggcgctgggcagtggggaggcgctgtgccgtggggaggcgctgggcagtggggaggcgctgggccgtggggaggcgctgggccgtggggaggcgctgggccgtggggaggcgctgggcagtgaggaggggctgtgctaccagaggcgccgtgccgtcgggaggcgccgtgccatggggaggcgctgtgaggagacgctgagctgtgaggaggcactgtgttgtgggaaggagccctatgggtttaacattcttgtgcttcctcagcacagtaaagctgaagatagtgacttcctgttctctgtgtgtttcactctgtggacaagacaccaaaatgggtaagttttaccaagtatggggggaatggtcaaattcacttgcattcagttttccaagataagagtatcttactgtttacatatctactgttttaactttttattgccttctctcttcgattc

SEQ ID NO: 467423 - DNA, 2548 bp, Homo sapiens
ttcttctttatggctgcatagtattccatggtgtatatgtagcatattttctgtatccagtccacaatggatgggcatttaggttgattccatgactttgcaattgtgaatagtgctgcgatggacatgcgcgtgcctgtgtgtctatggtagaacaatttatattcctttgggtatatacccagtaatggggttgctgggtcagatggtagttctgttttaagttctttgagaatttgccaaattgctttccacaatggccgagctaatctacattcccactagctcattcccactgagctaatttacattccattcttttttctcgccagcatctgttatttttggactttttagtactagccattctgacggctgtgagatgctgatgctgattatcgccgttgcagggcacgttgttctctggtggatgctggttattgccgctgtggggcgcgtggttctctggtggatgctggttattgccactgtggggcacgtggttctctggtggatgcttgttattgccgctgtggggcatgtggttctctggtggatgctggttattgccactgtggggcacgtggttctctggtggatgccggttattgccgctgtggggtgcgtcgttctctggtggatgctggttattgccgctgtggggcatgtggttctctggctgatgctgattatcgccgttgcagggcacgttgttctctggtggatgctggttattgccactgtggggcacgtggttctctggtggatgctggttattgccgctgtggggcatgtggttctctggtggatgctggttattgccactgtggggcacgtggttctctggtggatgctggttattgccgctgtggggcacatggttctctggtggatgctggttatcactgctttggggcatgtggttctctgcctgatgatgattatcaccactgtaggacactttgttctgtggtggatgccagttatcgccgctgtggggcacgtggttctctggtggatgctggttattgccgatgtggggcacagggttctctggtggatgctggttatcactgctttggggcatgtggttctctgcctgatgctgattatcaccactgcgggacactttgttctctggtggatgctggttattgccgctgtggggcgcgtggttctctggtggatgctggttattgccactgtggggtgtgtggttctctggtggatgctggttattgccgctgtggggcgcgtggttctctggtggatgctggttatcgccgctgtggggcacgtggttctctggtggatgctggttattgccgctgtggggcgcgtggttctctggtggatgccggttattgccactgtggggcacgtggttctctggtggatgccggttattgccgctgtggggtgtgtggttctctggtggatgccggttattgccgctgtggggcacgtggttctctggtggatgccggttattgccgctgtggggcgtgtggttctctggtggatgccggttattgccgctgtggggcacgtggttctctggtggatgccggttattgccgctgtggggtgtgtggttctctggtggatgccggttattgccgctgtggggcacgtggttctctggtggatgccggttattgccgctgtggggtgtgtggttctctggtggatgccggttattgccgctgtggggcacgtggttctctggtggatgccggttattgccgctgtggggtgtgtggttctctggtggatgccggttattgccgctgtggggcgcgtggttctctggtggatgccggttattgctgctgtggggcgtgtggttctctggtggatgctggttattgccgctgtggggcgcgtggttctctggtggatgctggttattgccgctgtggggcgcgtggttctctggtggatgctggttattgccgctgtggggcgcgtggttctctggtgggtgctgattcaattccggacccacgtggctctaggctgtctggggccacagcatacaggaaagttgataatcacaggtgtggcatgttccctctccactgcccacccccagctgtgagcccacccctgcccctctggagacaccaagccagaatgcaggagtgctgctgtgagagtagcttcaaaactgtcaaaacttctatcaaaagcagttattccaaaccttctgtgtcatattgttgggaatgcattcctttttgaaagtctgcacttggtcacgggtgggctggcacctgctatcgatggatgtttcttcatcctctgagctcccagtggggcttcagagcaggggccagagcagccccacacccgctccctctgcagatcgctgctgctcagcttttcatggccagaaaagctcttttctaatgggagtattgacttggagaattttcaaagtttggcaagaatccactgcagcctggatgggttgatatttatgctgtgtttggtgttgtttgattttgtttatctgtttttaatcccttctgtaatcagagcaaac

SEQ ID NO: 467424 - DNA, 965 bp, Homo sapiens
tgcctggcggcccatcactgccccctgggctgggcagtaacagcaagtatgaggctgcggtcatcagggctggaggagttagaggagggcaggaaggaccttgccattctcttatcaaggaactgtcaggacctctgtgaagctgaggccttcagcgagctcctcccaggacctgttgacacaggaatgtcccagtgccctggctttgaggaaagctacctggatatcattcagcccatgacagtgaacatgtggctgacaccgcaggccacctccgttttaactggacgctttcaggaccaaacctatgaatccatctctgaaattgccaggaaacattcaccaaaagaatcaaaccttctcgtgttttacaaaacacagtgcagacccagaatctctttaaaagttgcctgagctccctgtgttgttcataggacgggagcttggagatggcgttgtaaaacccatgttcctcctaaaaacctgtgagacgaactccttgcctttcgtctgcaatgttactcctcctcctgcctgcgtggaggttaatcatccccttgcttctcagggcattccacctgtccacactgatttgcttttgtgtttagatagaagtgcatccatttgaagacatacctgtattctgttcgaatatacagctatggagaaagtgggtcaagcctgagggaggccatctgtcagagcgtgttttggcaaaaggaaaacatgagaaggaaacttgtaacagaggctgaagtattgtagcctgagggcaccaagagagttctgtggactccaactgtcagccccaatcccggttatgtaactgttcaggagtgcagagctttgcaagatgtggaatggacatggcccacaaaagggaaaggcagaagtgcaaacctcactttcaatttttgaaataaggacagactcaaagtgctcgatttatgtatttttaatagcct

SEQ ID NO: 467425 - DNA, 2828 bp, Homo sapiens
gctaagatacacctcggtggaccctatatggtggcattaccattatgctgttgactgtaaatgtaactgaatgtgcaattatggtatcatttgacaattcatctgcatctcgttattgggcagagagaaatagcagcccaaccctcagtttggtccgggaacaagggcacttgggctcacagcttcgttgggggaagattcagatcctcaaaaaattgaagcacagcacggacctgggtcccctgggaggccgtggagcacgagggagggcacagaacccaccctggcccgaggccggctgtgcctccaatgagaggtgtccccgggctgtggatgcccaggttacggggaaggtggtgctggctggggggctgggagcagatgaacggcaggagctcagacaggtgttggtgagacaagagcggggctcaggcctgcttccaagccgatgcttttgcataaaatgaactcaagggagggtgtgaagctttcctcccctcagtgttactcctggtggagaaagcttgttaaagatgttctaatctctgctgtggtaaaagacaggaccattaactcagggggcctgtgttccttccgcttgagggcagagcctttgctgccccgggctgagcctccttctgcgcaaggaccattaacgagggggcctgtgttccttctgtctgagggcggagccttcacagccctggactgagcctgcctctgcaccatcctgcagtgtcctctcatccaaactgtggccgccctgccaggcccctctctctccttccacttcctgggcgagacttcagggttcacagcatcgttccaaaacctgcacgggagaatttaaactcaggcctgcctgcgtccagctcgggtcctgtcttgtccctggctgccacctgcctccctgctggccaccccagcaggcaacgtgaggctggaaggatgtggcctccgggaaggttttagtccacatgtcactcataatacgacattcagcaaaatgagtaaaaacgtttcgaagggaaaatgattttatagaaagggatgggtaacctttatgataaaattgctttgctagagcgtgttgcttgtgacagcaccacctttctgttcttgacaatgtttgtcttcttaactaaacaaacgttagctgagttgaatgaaattatgtacgaaccagagaagtcgggaggatgtttgaggctcgagcccccgtcatcaccttttgtaatataacttcattttgtaatggaagtggctcttgcgaggctgtgtgtgtgtgtacgtgatatgtgtttgcatgtgcgtgtgtgcatgcttgtgtgtgggtgtacaatgaacacctctattcaaatagagcagctcttcagaagccacttggattgatctgttaattttccagaattttacaatatggagaatcatcacaagggaaacctatactaccctagcagctactttttaaaaattctttttgtaattagcctaggtctctttttgttttaaagaaagtcttcactgatttttaacgatcacacttacttctcgtgagcaaaagccgataatgtctgcagtttgaaaggtaattatgcctggcttctcatccagcagctactctgatattccaaaataataatgttaccattggaactgggttattcttcatacgatactttgtagtattgtaaccatctttataataataaaaaggcatttatattatgaacacttaattttttgttttctaagatttcccacctctcaaagcttttaggaaagagaacattaaaagatgttaatgcacacagatacatctcaatttccctcggggagaagctaccttaactgccatttcaagttttacatttttgctttaaacgagtgatttcatttaaataaaaaagtcttattttctgtgatgaaaattcagctgctccttgtaaccctgaagcatcttgatttattattgactatatcctctttcaaggagaatattcttctcaaagacattatgcaggaattcttatattgcttactgtttggcattttctattaatctcaccacatctgttttcatgctatttggataaaaaaatcagaaaagtatagtagttacatgttttgataaatacaattgcaagaatcaacacattctgttcacctgaaggagcctgtctaatgtatgctgttagttgcattaaggaactcttagaaatttaaaaagcatttttaacagggcaaaggttttcttcagttcttttgtaaaaaaatgtacaaacttcactaaaataaattttagaaattactttgtaaaagacgtaaatgggaaaaaacattttatatgaatttgtcttccaaaaataatttggtatacatatatatatatacacacacacacatatatatacacacacacacacatgcacatatatatatatagctaactttccatatgtgtgtgtgtgtatatatgtggatgaacgtaaagttagttgtagcttattatgtcgtttctatgtatagttgcaattcatacatatttatagtacatatccatagagtcacaggacacacatgcttatggtacaaagactaagaagcgactccagccaggacgcttacagcagacacgcagccacgggtttattaggagcccgagtcaggtctcttatttgcacagcagttgtgtgcctggctgtgcgctgatctaaaaggcatctcctgccctaagagagttgagtgactcacctgagccgattgggaaattattaaggcaagaaatatgggaagaagggagggatccaagtgcatctgagccctga

SEQ ID NO: 467426 - DNA, 3549 bp, Homo sapiens
caggctgcctaaagctatttgacgaggatctgagtgcaggtggatttattctgaaggtcatggcagggaacatgggtgatgccatggaatactatgcagccataaaaaaggttgagttcatgtcctttgcagagacatggatgaagctggaaaccatcattttcagcaaactaacacaagaacagaaaaccaaacactgcatgttctcactctgtgtgacagtcaccaggctttgtcacaatgcatcctggtgggccgcgcagagcctgggcctcagtggggttgggccgggcctgacaatctgcatttccagcacgtcccaggtgccactgctgctgtcattggggccacactttgaggaccctgggaagtacctgcccgtgagagctaagcctaggaaccaaccaaccaagtcacttccttctcaacaccagcaacggctcctggaggctcctgcccggaagacccctaagactgagttctgtggaatctcaccctgacaatgtcaatgaccagctcgtcttcataggtagagggcaaagactggaacaaaaatcatccctccacccaacccgaggcgaatgcatcattggccttttcctgcaccccttctctttgcacgtaaaatgtagattcacatcaaagcctccaagaacgtaaccatttgcctcattgcttaccctccctcctttctctcctgctctttcccctttaaatatcgaagttccccaaacgctctttagaaaagtcgcaggtgatggacactcatgtgacttttggttcttttcccagacgcatcgtcacactcaggccaaacaaacctctctcaatggaggtgtcactgtggtgaaccctctctaggcacgtgtccatctgtctgaacctctggaggtctccgcaggaagaacagcgtgcacccacatttaaatttcttgcgaatacttcccatctgcaaaataggatcttctgaagcttgcagttgctgtcaatctcctggccctaatgagctgccaggagaagaaggaaaggtcccacttgagagtgaaaacttggggtctcacagcttctctttctctgatgaaacaattgaggcttttctatgaaattaagcttctttgcattttaatatatattataagttttattgatcactaaaaacaatgaaaaaaagaaagtcaagaagccctgctcaagaactgacaatgcccctcttagccctatcctgggagaggctcacctatgcagagggaggccccgcagaccccttcttccttctccacttgggggtccaccgctatggcttccacggtgccctctggtctggcctctttgcttttacatttttctgcctgcccctcactccaggagctaaaaatcaattagttcttaaataacgagggcggtagccacctacatgaacctcatggggaaggcttctgtaaaatgaagacccatccagcagcgaacgtagttttttcctcatgtgtacatttctaagtttaacactagatttgctacaagtgtgacggaacaaacactcgacggaacaaacactcaaagaacaaacatatttaaaaaggtacttttcaaaagaagacacttatgcaggcaacaatcatatgaaaaaaagctcaacatcactgatcattagagaaatgcaaataaaaactgtaatgaggaaaaataacgaatgtgcatgaggcttaacacctggctgacataatctgtgcagcaaacctgcctgtgacctgagtttacctgcgttacgaacctgcctgtgacctgagtttacctgtgtagcaaacctgcctgtgacctgagtttacctgcgtaacaaacctgcctgtgacctgagtttacctgtgtagcaaacctgcctgtgacctgagtttacctgcgtaacgaacctgcctgtgacctgagtttacctgcgttacgaacctgcctgtgacctgagtttacctgtgtaacgaacctgcctgtgacctgagtttacctgcgtaacaaacctgcctgtgacctgagtttacctgtgtaacgaacctgcctgtgacctgagtttacctgtgtaacaaacctgcctgtgacctgaatttacctgcgtaacgaacctgcctgtgacctgagtttacctgcgtaacaaacctgcctgtgacctgagtttacctgtgtaacgaacctgcctgtgacctgagtttacctgcataacaaacctgcctgtgacctgagtttacctgtgtaacgaacctgcctgtgacctgagtttacctgtgtaacaaacctgcctgtgacctgaatttacctgcgtaacaaacctgcctgtgacctgagtttacctgcgtaacgaacctgcctgtgacctgagtttacctgcgttacgaacctgcctgtgacctgagtttacctgcgtaacgaacctgcctgtgacctgagtttacctgcgtaacgaacctgcctgtgacctgagtttacctgcgttacgaacctgcctgtgacctgagtttacctgcgtagcaaacctgcctgtgacctgagtttacctgtgtaacgaacctgcctgtgacctgagtttacctgtgtaacaaacctgcctgtgacctgaatttacctgtgtagcaaacctgcctgtgacctgagtttacctgcgtaacaaacctgcctgtgacctgagtttacctgtgtagcaaacctgtctgtgacctgagtttacctgtgtagcaaacctgcctgtgacctgagtttacctgtgtaacgaacctgcctgtgacctgagtttacctgcgttacgaacctgcctgtgacctgagtttacctgcgtaacaaacctgcacatggacccctgaacttaaaagttaaaaaaaacaattttatgtgcaataccgtgacaggttttgtggctaaatttaaatgttaatttggacattatatattctgttgtttttgattgtctactcagatgagaaaagtagtcaacgcaatcaacttccttaaaatcagtatctgctgcacgccagggacagcaacagaagaaatcatttcagcaacaacgtgacacttcgaacctccagaagaagtgccatatcaatgacatcatgacaaacgccccagaccgaattatttctgtgtcagagtcactcattatggctctggctcttgcaggtcatctcccatttaggagaacttgtcctattgtcttcatcagaacacgtgtacttgtcaggcctgcagtcctgatgtttggttcagaaaatatggtcactgtaattatagcccttcccgggtgaggaaatgagaatctgactcgtaatccttttatcattgacttggatgacttatttctcaccaaatgagaatggagaaatttcaagggcaatttatctaattctttccctgtgcatatatatttttttttttaaagaaatttgccctggtcagaaaaagcacattttccagagggattctttaatgatattgatctcttgtgcattacctggcctctggtagaccttacatgattgtcccaattaagctgccaggtgagtttcttaa

SEQ ID NO: 467427 - DNA, 774 bp, Homo sapiens
ggcgtcttatgggggtttgcgtttgcgctttcctaatgactgatggtgctggctgtcctttgtgttcttctgtctctcatatgtcttcttcggcaaacccgggttaaccactttagcggaaaagctgacggcatcaaacctgctgcctcttctacccgtgtctgcatctgcatcatggaccaggacacgctcctctttgccaacgacacacggaggtttctgagcagggaccagggacacaggagggcgggaggcagcttcatcagcgagggccacacgcagggattctgtgtgacaagtgctggaatagcggcctccaccaaatgctgtgaacgccccagagaggaaacactgctgaacaccacaggcatctgcccccacacaccacccaggcaccgtgggctgacttcctgtgcccccgctgcagcccccaatcccactcatcacgtggagagcacgtccttctcaatggcccacaaacccaccatgaccctggttactatgctccgctcacttaggcatccctaaatggacacacatcccacctgccccaccagctgcgtcccaccccacccaaccccagaaacgtactttccctactgcatccggagtggaggacgtgttttgaggctgtttcttgttttaaataacatttctatttatcagttatctccttcacaatggtatataaatgcctatgcctacactcatgcacatacattcacatacacatgcatacacacatgtacatacacacatgcacactacacacag

SEQ ID NO: 467428 - DNA, 791 bp, Homo sapiens
gcttctcacaggtgcactgggaggttccctcctgccctgacatgcatcccagggaagagcccctctgctggaggactaagagggtccatgtgggatcctgtgatgcccaggtaaactgtcccactgtgtgcctgtgcttgggttctctccctgtgaaaaacccgactgcagcaaacctccccgagcctttactgagcttaaaactctgagctgcacagatgtgatggaagccctgggaacagcatgggagtgcgccaaaacaaggaccctcggacgggagagcaccaaaacaaggaccctcggacgggagagcaccaaaacaaggaccctcggacgggagagcgccaaaacaaggaccctcggacgggagagcgccaaaacaaggaccctcggatgggagagcgccaaaataaggacccttggacgggagagcaccaaaataaggaccttcggacgggagagcaccaaaataaggaccctccgacaggagtgccaaaataaggaccctcagatgggagagtgccaaaatgggaaccctcaggtgggagagaaccaagatggggacccttggaggaggaggggcctgcaaacagatgggtcttcaccaacgaatccaatagctggtagcaccctcccaaaaggtgacctgatatcatatgtagaaaaactaaaagcattgttagaactaataaatgaattcaacaaagttgcagaatataaaatcaacacttaaaattagttgcatttctatgtacaaacaatgatcaatctgaaaaggaaattaagaaaaa

SEQ ID NO: 467429 - DNA, 713 bp, Homo sapiens
aggcagaagacaccacggttatttcaacctgcctggtctttagtcatcatggttgtcattattaacatgattgtcaccatacttattaatataatcatcaccatcatcatagtcatcatcaccatcatcatcatcattatcattgttatcatcatcatcattggtataaacatcatcaccatcatcatcactgtcatcatcaccaccattatcattgtcatcaacattaccatcatcttcatcaccatcattattatcataatcaccttcattagtatcaacattatcaccaccatcatcatcattgtcatcaccatcaccatcattattgtgatcatcaccatcattgccatgattatcatttctattgtcatcatcatagtcatcatcatcaccatcattagtatcaacctcatcactgacatcattatcttcatcatcaccatcactattatcatcgtcatcaccatcatcatcgtcatcaccatcatcatcattatcgttatcttagtgatcattattaccaacattatcatcctatcttcatcatcatttagtatcaacattatcattagtatcaacattatcaccaccatcatcatcattgtcatcaccatcaccatatcattgtcatgatcaccaacatcaccatgatcttcattgctatcatcatcatcatagtcatcatcataaccatcattagtgtcaacatt

SEQ ID NO: 467430 - DNA, 600 bp, Homo sapiens
gtgaattatccagcagcacacggccagcgagaccttgacactggtgttggcgttggatgaataggatgcgtttgagggccccttggtggttgagagccctcactgtcaccgacctccatccatccccaggacaggcatcttgcagaacctcaatggacgtcagtgctgtccccgcagctggtgaagacacacgctatggtcagaggctgcgtctggacctcggcttggccaagctatgtgtgagcatgaagcttgtttccttctctcaaacatggggagaacccagtaaacctgcctggcagagtcgttgggagactcccaggaggcccttggagtcacttgcctacattattgttttcacgctggcttctaaagaagtgagaagtcgtctggcccagcggtccctgggcctcagcatgaaggctggggagctaagcgaggagtttggtgcctttcttgaagaggagtctatgaatagatcctattttgtagcatccgggaggagccggtccatctataaaaacctcgataatcgtgcctcgtttcctgctttcactgcgtgccatgccctcggtgattagcgtgtttttcagactaaca

SEQ ID NO: 467431 - DNA, 1144 bp, Homo sapiens
agcactgcacactccatgttgacatgaggagacagcaagaatttggagaggtgatagtggcactgcaagaagaggatcctgagccacggaggacggccgtcatcgctagccacacactccagagtgccctcctgccagagtcggctgcagggcgctgccggcttcaggaaacaggcctgatggtggcggtcatccctgtggatgtggtaggagcactagaatctactctcttggcagattttcagtatgcaatgtcatcagctgtagtcttcattcttcacgttcgctctccagacatcgtcactctccctgagtgtaaatgtgtcagtatccagtgtagaagcatcaacgtcttggtgtccagtgtagacagcatcaacaccttggtatgcagtgtagacaccatccatatgttggtatccagtgtagacagtatcaaagtcttggtatctagtgtggacagcatcgatgtcttgttgtccagtgtagacagcattgacatcttggtgtccagtgtagacagcatcaacatcttggtatacagtgtagacagcatccatgtcttgacatccagtgtagacagcattgacctcttggtatccaatgtagacagcatccatgtcttagtatccaatgtagacagcatcaaagtcttggtatctagtatagacagcataaacttcttggtatccagtgtagacagcatccatgtcttggtatccagtgtagacagtatcaaagtcttggtatctaatgtagacagcatcgatgtcttagtatccagtgtagacagcattgacgtcttggtgtccagtgtagacagcattaacatcttggtatgcaatgtagacagcatccatgtcttggtatccagtgtagacagtatcaaagtcttggtatctagtgtggacagtatcgacgtcttggtgtccatgcactccagcctgggtgacagcgtcaagaaagaaagagagagagacagagagagctttggaattgagagttccatctataatggtatttgatgattactggttttgtggcaaaagctttcagtgttctagcctggctttgggctagattccagtgaagaagggactgtagggggtgggggagtcattagtctgagattcacagtaattac

SEQ ID NO: 467432 - DNA, 721 bp, Homo sapiens
gtaagagaagtgggggctaatgaagtttcagggaactcatgtcctgtggtttcttgaagtgtgagaagtttgactgcagggaccgtgagtgagtgtgctcttgataaaaatgaaggatggaccggggcttcattaagaaactgtgtccctgtgtcagagtcctgccagcaaaaatgctctacgtcttcctccttgtctctaaatattcccttccctcttactccctgctggtgcttcgcaaactttgctctgtcgaggatgccctgatgtctgttctcacatcacattgcgctccaagtaccccggctgcaaccagagctcagcaaaccgggaccagagggcacatccaccctgcctgcccatgtcaacagagttgtgtgggagccagccggcccccaggaagaccccagatcttcctgcccctgaccacagctctgtccctggaagcatatgctgcagacacttgctctgctgcagattttctgcacaacccctcctcatgggggaaggtttggtacctgaatgaggcctcttttgacctctattcctatcactatttttggtgacctcaatatttatgaaggtaataacttggtctttaatccagacaattttcacctccaggaatcttgtcctgcatctcacttttcttcttgagtcctgtggtcatcaccaaaacctgtccctccttggaaacctcagtttaagcatcccactgtcc

SEQ ID NO: 467433 - DNA, 581 bp, Homo sapiens
atgccttgcgatgataccacatgggcacccaagacatggaggtgctgggagcaaccatggaggcgatgctgccagcaagccaggccaacctcacacagcccacaggggcctggacactctctcaggcccattccccaaatccagcaaggccagcccacagctcacagcctggctcccagaggagcacctgctgaagccagaaggaccatttaaaaaccacttgacactttgggaggccaaggcgggtgcatcacctgaggccaaagaggcggggcccatggttctgatggagctggatgcccagactgtggacgcctggaccatggacgccccgaccgtggatgtcctgaccatggatgccccacttggacaccctaccatggatgccctgatcgtggatgccccgaccatggatgccctgaccgtggcagggagctctgtcttgatctgtatcgatcttgtcatctgcgaagctctccacatctttttctcatgaatttgtgtcaaagcagatcccacaccccattgcctccagaattgagtgtgaaccccaaggcaggggctggcgtccatccagggtc

SEQ ID NO: 467434 - DNA, 1104 bp, Homo sapiens
gaatctgccctgcaggagggaatgggcgtgttcctcaaatagaacacgggaagccaggaggaaagagcagagcggccatggccgccctccccagccaggacccgaggcctgagctccagagggaggggctggacataaggaggcggtcacaacgccggttcactctccactgcctgccccaccttggagccaatgccatggccttgccttcccgccctgccatgctgtgctcacagcagccttccagattgaagtgtgcctgcccctccccagagaagctgggcatcccctccagcccatgctggggaggcagcacagccctggatgtggcccaggactcactgccatcgccagttacccaccacccagaggcccaggatgcgcggtatggtggatgtgtcagggtgcacagctgtccgggtggggcattgtccacccgggagagtgtgtcttacaccaatgttgacaccacttggcagggcagggactgttgtcctgaataccacagtccctcccttcggaaagtgggtgctcctacccagtggggcagcaacactgtgttgtaaacacgccgaattcaccagcctatgatgttcattgcatttgtcaatgggaaacttctgtttgacagttgctgtgtttctcttaagctcaaaacttttgttggacggctcttcccctccaactacagatttccctgagttcagtgaattgctgtccacttttttcccctaaggctgcatctccccgggagcttcatcatgccctttagtttctgtgacattctctgcacctttaagacgacttcctttattaaatttcttacttaaccctctgagtgtgccatctgctgcctgcccaaacaggtgtacctaagttccagcctttactctaacagaatgcctttaggtgagtcacagaattgctctgtaaattagaagagcaggcttgtttatgaacttttcttatttaagatcctataagtccagctttactttaaaaaatccaccaccatgactataacctctttactgccattcaacaaccccaaattataactgtttagtggatattgtaaaagtatgtatagcttatcaccttttt

SEQ ID NO: 467435 - DNA, 596 bp, Homo sapiens
gtgacgaagtccacatgggacatcagtgttgggctcccaggagaatgggagggccatggtcccatgggcatgagtgctctcctgctgcctgccaagcctgtcctggaactgagccaggaggctgactgcatccaggaagctgaccgcatccaggaggctgaccgcatccaggaggttgaccgcatccaggaggctgactgcatggttcttcctagagcagggcttagagcctgctctgtggtcagtcatgtggccctggaagagaagtccccagagccttcaggaatgtcccagggtcttggaatcagagaagaccaagaaacgccaccagctttggaactgggtgagctttatctgggtgtttctccctggctggcccacagtaccagaccattcacgagcagcctgatgatcacagctgatccttaccctaagaaagctttgggctccaacatgacttccctatgagaatcactagtgttgttgaaagaaagtgacaaataaacagaactaattctaccttttttaaagcaggttaaaagcaagtgtcagagcttgcagtttgctgccattagaggggctccaggggcccattt

SEQ ID NO: 467436 - DNA, 509 bp, Homo sapiens
ctgacttaagattggatagacctttgtccatccatgatgcaggtcttcagaaatcaaaaacatgtttccacaccctctcatatgtactttctactgaactgtattttcctggttaattatgaattcttttataaatttaaaaacctattaaacaaatattgtgtgcttgaccctgtgctaggcaccttgggtaaagaaataataaaggcaggcatggtccctggtttttatagaacccgtggtctagtgcagaagtcaaatattgaatggaaagtacacaatagcagtgaagaaatgagctttggtgacttgcgacagcaggacttaaggtgtcccaaaacctcaaaagtaggaaagctgacagtgcatccttcactctgtggccgaaggcctgagagcccttggcaaaccattggtgtaaggccaagagcccaaaagctgaagaacttggagtctgatgttcgagggcaggaagcatccagcatgggagaaagatgaagaccaaaata

SEQ ID NO: 467437 - DNA, 638 bp, Homo sapiens
agcacaattgtaagggaacacctttcagagaagtactcatgtgtcccaagcaatgggtttgagtcatggactgctcagtgttctaggtcccacatgctgtcttgaaggcaggagagaagctggctgggtggagctgtactggacaagcctgcactcaggccccctaatgttgggcgcaagaatcaaccttgatgggggtctgaagaaagtttctgggccctggagaaatgtccatctgaggagtggagcaaccgctggtgtgctgaggtttcagcatgagaagggagagttggtcttgacaccacagccagaagacaggaagatgtgggaaagttcggaacttcctaaagacttgttgaatggctttgatcaaaattctgatggtgatatgaacactgaagtcaaggctgaggtggtctcagatggagttgtggaacttcttgggaactggagcaatggtgactctagctatgctttagcaaagagatggcagcacttttcccctgtgctagagatctctggaactttgaacttgagagaaaccatttagggtaactggcagaagaaatttctaagtggcaaagtgttcaagagaaagcagagagtaaaagtttggaaaatttgtaacctgtgagtgc

SEQ ID NO: 467438 - DNA, 910 bp, Homo sapiens
tgagatctgagcgaatactctaaggaagagagagaaaactatttggatttggaggagacttccaggaagagtgaacagtcagtgcaaagaacgtaagcaatgatgaacgtcctgactctccaacaggactcttctgaaagctcaataacagaaataggaaggagtatatttctggttggggtgaaaggacggattcctcatgtagtttctgctacaccattaagggaacagggtgtatgcttgttactggctagtgaagaagaagtaggcatctcttctagcctttatagattggatttggcaaggaaagcacttcattggtcaactaatccagagattctgggtgggctggctggtggttgctgctggagtctttgggcaggctggcctggttcctgggtgagcaggtgggtgggcctggtgcctgggtccaccaagataggactggagcctgagtgcaaagtggtgggcctggatcttgggttgttaagccacagcatctggcctgatgctaaggtgggcatggagactgggttcacagagctgagcctggagcttgggtctgcacaggcaagcctaggtcctggggccagaggggctattctggctttggtgtgcctggagcctggggatttgagggtcaacctgctactggggcagcctggcactggtacaggcctggggcctaagtctgcaggggctggcctggtgctagtgtgggcctggaggctgagtccacagatgcctgcctggagcttgggaccactggggctggcctagtaccagggttgactggggtggtcctggagctgggatccctggagaagtataatcaatagtctctgtccccctcacctgataattctactagctttcattttcaagtctcttaaagccttaggggagaaat

SEQ ID NO: 467439 - DNA, 815 bp, Homo sapiens
agcagggtcagggatccacgtggaaaacagtcttgctacttttccatatggcagcggcagcatgctagaggcccctgacagttctcaggctcttcactcccttcccatcctgaaggcagcaggggcaaggataatagcagaggcaattgttgtgggcctggggattacctctgggagttctgtgacctgccagagtgctcaggcagaagtggggtggctgcactggggtcccaggccagtgggctttgcttgcttggcttccctcactggtggggctacagcagctgacaatggggtgttcaaggatctaagacccatagggctccccatgggcctgagtgtggctcttcccagattccaggcaactcgctgtgtcagtctgcaggccccggggatgcctcaggctggacagaagggattcctggcctgctgggtacctgtccttttagaatcttaccatcatcctgaggattccatttgcttctgttgcattggatcctctatttcttggattccttattgttctccttgatttactccatcgatttggcaggacatatcctgtagtggtttcccgagaaagagcgtgttataggacttccaccccagctacctcccaggtcctgaggatttggtgtgcaaacttagagctacatcatcagctttcctggttctgaggccttcagacttggactgagccactcaactggcatctcaaggtctccagcttgctgacagcctgctgtgggacatctcagcctccataactgtgtaagccaattcccctaataaacctcctctgatatatctatcta

SEQ ID NO: 467440 - DNA, 506 bp, Homo sapiens
cccagaagacggcgttggtgcagcagggctctctgcctatggcatcgtgctgcctgctgctcaagagatgggcacaggaagtgctagaagcggccatgggtccagctccccagccttgctgagccagggaagaagatgcagagaaaaagcttccaaagacacggtcaaggaacaagcatcgaagccctttgcattcatatctttccagttatacatgctgggtcttctgattttgacttccctgtaccttctagcacctcaacccttccttcaagtctttgacagcaaagagtcacctacacctatgtgtgtggattctccaccttactcatgcagacccctccaccagacttctgccagtatcccctactttaccagccattccatctctgctttcccagtcacttctacccctgcagccagcgcatctgcaaatttgacccaccagtcagctttggacattgctgcttcttcgggtctccttcaggctctgggatgaacttggg

SEQ ID NO: 467441 - DNA, 679 bp, Homo sapiens
gagcccaggcggcagagtaacatgaatatcacggatattaattatattaagtatgattacttttacattaaaaagaaacttgagagaggtgaggaagctgcagaagaaaagctagaagctaacagaagatggtttatgatgtttgaggagagaagccatttccataacataaaagttcaaggtgaatcagtaagtgcttctgtggaagctgcagtaaattatccagaagatctggctaaggtaatggatgaaggtggctacacaaaacagcagattttcaatgtacacaaaacagccttctactggaagaagatgccatgtaggactttcatagctagagaagagaaatcactgactagtttcaaagcttcaaaggactttctgactttcttgttaggggctaatgcagccggtgactttaagttgaatcaatgctcatctaccattctgatgatctaagggcctttaagaaatatgctaaatgtactctgcatgagatctatacatgaaacaacatagcctgggggatggcacatctgtttatagcctggtttactgaatattttatgcctgctattaagacctactgctcagaaaaaaaaacttttaaaaaatattactgctctttgacaacacatctggttaccctcaagttctgatggagatgtacagagagact

SEQ ID NO: 467442 - DNA, 3512 bp, Homo sapiens
tctgctttatcaactaagtctatataattttctaaatcctttgttggcttgtgggtcaaatttgtcccaatggcttaggatgcatttcaaggatgagcctgtcgaggcctgagtgtttcccatctgaaagacaaaaccacccacagttttggtttgtttgtttctccccctgcccaagaacccaaaacagtccctggaccctgctgatcagaatagttgcactcaccaatgcagcagcaggagtgttacagctcttaaaggtggtgcatccagagttgtttgtttctcctggtgggttcgtggtctcactaacttcaggagtgaagccgcagaccctcacggtgagtgttacagctcataaaggtagtgtggacccaaagagtgagcagcagcaagatttattgcaaagagcaaaagaacaaaacttccacagcatggaaggggacccgagtggggcgggcgatgggggtgtggctcgcttcttcggtgccctgctgctcaaaactcctagcgggagtatgcagacaaacaggcaggtcttggggagcctgggttccgaccccacagcagcatctaggggtgtatgtttacagctccccagtgggcatgtgagtcgggctgctcagcatgcaggctctccttcaactgcccctgtcaaactccatgtcattccactggttgatggcccaccggtttgccagtgtctgtcggtgtgctcttacgctggtgtgttcctctcgacgacgactgagttcagccgtaatctaggtacacagatgagaggtgttgcgggctttccatctacgtgcatttgttattccagaggagcagctcgagtcctggaccttgttagagaaagaggcaagctgaaaaaagaccttggatgtgaatcatggcattccccctcagcttattaaagccatgtctattcctgtttggcctccaatgatgttttgtcactatcagtcagggagacttttgagaggaaaatgaacaggcagatattttgccatttattgctccgtatggacacgggccatttgtcagagagccaacgaacagccacctcaaacaatgctctcttttaaaagatcaaacggaattattgaaatggacaattctagcagtggaagaaaaatatattttggtttcgggtagacttcacctgaaacaccataatagaacttggaaacaaataagttttaaacagaattcagaattactgacacttattattttttaataaagttaattcatacttctttaacgttagtgtgccatccattacaatcaataatttatcgcttagatgcttttcatgtaatcattttgctttaatttatataatagttggaaatatactatacatactgtattcttatattcatagttaacccactagattgtgaggcttaactatggtccttaaaaaaattttagaaaagaagtctgctgacaaataaaaaatttaccaatataaaaataaaattaagccaggcatggtggctcatgactgtaatctcagcactttgggaagccaaggcaggaggattgcttgaaatcaagagtttgagaccagcctgagcaaaagaacaagaccttgttactacaaaaaataaaagttaaaataaaaagatattcaatttgaatactcagaaaaccttttctcaaatttcttgtccttgactatatcaattatgttgctctccacagttacttctgctcaggaaaacacttccttaggattagtaattctataggcccaatctactgagtatgtaaaaagtttaaattttctgttaagtgttaaagagaggagcatgaattgtcttaagtgatcatgaagctaagcagcaaacacatttaactggatagtgaaagccaagttacaaacaacactttttccagtttcttgggattagcaaagaaaggaagtatataccatggcttccataccttgaattcttaattttaattaatttctcagacaattggaataaatcaaattataggaaaattatctttattttatgtatctatttctgtaattttagatttttttcagcaagtattcattgcttttaaatatactttaaaacgtgtagtttataacatttttgaaaagaactagaacattttcgtgctgcaccaagtggttgtctaacatactgaaacagattcgttgcatgaaaactataacccccacaactaaattattttatgtatatattttttcattctaaaacaaactttaacctctaaactattaaaagttactttttctttaacaaaagcaatactcttatttttttcttacaaccttcttcaccaaaaacatatcttgcttttctgtacactttacatacaaaattatttctctgagttttagtagttttaattatgtatattaattagacttttaactcttagtatcattaatatccagggaaaacctagaaagtaagcaatttcatttgtcttttacatatcagtattttatgaatccatactttgtaatttctaaaaatacttttcccacaaattttaaaaaatgtgaaacagaacatactaattaacagaccaaaatatattttgtttctttataataagaagccaaaatagataaaccttttgttataaatttagtattttatcttatttgaaaatgatctaaaatttggttgaatacctatcacttaatttaacttagtaaaacctgaagggtgtacttgtcaaagagatttgagaaagctttaagtaaacatattatgcaacataattgttgttaaaatggagtacctttgtagtctttgattctacttatatttatttgatttattcatccttagcaattatgcttggaaaaaatacagtagaaattagataaagcttagtctaatgactacgttatttttctattaatcaatgatatagcacatgatatagtcaattaccatcaaagcaagtaccctaaagttaaatacatgggtattttgtttataacttagaaaagaaaccctttctattcaaccagcaatatttaactagtcatatttactaaagatttatccaggtcatttgaacttgaaaaacattttggttagttatttaatttgtgagtattaatttatttttaagtcaatttggtaccatgaggacaatatgcaaacacatgtacagacatatacatacatttagacacaacacaaaacatacacatgtgcacatgtatatattcaaaagccaaagatttcagagagattaatttaaaagagagcagagctttagtttagacatgagaagaacctgccaatgaacctgaggatttcgtgagaaacatagaattctccgaaaattagtcaatggtgcctttcctgtgttcctctgggggtctcagggacattagcaacctccccccaggccttttcatgaggttgccaaactctaatgtttccttttaattatttttagctattggccaccaaatggaaaagatagagtatcaaagggaa

SEQ ID NO: 467443 - DNA, 644 bp, Homo sapiens
ttttgtttgattatagtgatcctacgttctgacaaaattcattctgagtttctggttgtttatcaatgttcttgtggaaggatgagagcttggggccgcctaatctaccactttgctgacattactcccagtgatgatgaatgctgccagcactgggtcctttccttcaaagcagtgggttcccttctggcccagggtgtgtctagaaatgtctgggaggtagggtctgaaacaggggcttcacaactctggccagtgccctatcttgctgtggctgagctggtatccaagatgcaagacaaaatcctctcctctcttccatctcctctcctcaagcagaaagatgaggtctgttttggagccatcagctttgcagcgtggggtagaggagggacaatgccagcactcccttggctgccccagctggtgtctcaatccaaggcaaattctgtggccccagatatcagtttatcagagaacatagctagctgaatgcatcatactaggcaatcaaaatggaaggctttgctgtgcatgcatttgggggtgtgtgtaagccgatcctttgaaataggccttgagggatactctcatagattctaaagaacacactgatggatacaatgtgggtggagaaggaaaat

SEQ ID NO: 467444 - DNA, 699 bp, Homo sapiens
cctgatatggcataagcaccaatacttaagtgttgatgaaaatggtctatgaacagatgcacacctacaaccatctgatctttgaaaaagctgacgaaagcaagcaatggggaaaggatgccatatttaataaatggtgctgggataattggctagacatatgcagaagattgaaacaagaccctttccttataccatttacaaaaatcaactcaagatgcattaaagacttaaatgtaagaccccaaactataaaaatcctggaagacaaactaggcaataccattctggacacaggaacgggagaagatttcatgatgaagatgccaaaagcaatcacaacaaaagcaaaaactgacaaatggcatgtaagtaaacaaaagaggttctgcacagcaaaagaaactatcaacagagtaaacagacaaccttttaactatcaacagagtaaacagacaacctacagaattgaaactatcaacagggtaaacagacaacttacagaattgaagaaaatatttgcaaataatgcatctgacagaggtctaatatccagtgtctataggaacttaaataaacttacaattaaaaaaaattttttttaaaagtcagcaaagaacatgagcagacattttcaaaaggacacctttacttatgtaacaaacaagcatatatacccctgaacttgaaataaaagtt

SEQ ID NO: 467445 - DNA, 662 bp, Homo sapiens
attccatctccccaggaagcaatgagccatcctggacttgctctgtgtggagccatcctctgcccctgcccattagctcccacttacaagcggactgtgaggactttcacctgtctggaagcattcacccatggcctgaataaaactaaacaatgtactaaagccagctgtaacggcaatgctgtcttgtatctctacaagaataattctaaatgcaagagaccgtactgtgaaaccatttcttgccctaaaaaaattctgaactacaagagggaacaattcaagaagaaaacagtgttaaggatgacggcgtcccttctggtcgactgctgccacaacatgagagaaatgcccagcttaggactgcttccagtgactgaggttgcagttccaaccacgcacatgagctgccccaaaggagctactcacctgagtgacagcacagcagtgctgacttttgtcactgagattcagaaatatgatttttctcagtgttctcagtggagatcaaaagctgaacagaaggtgttcttgaccttaataaaccttgcctacaacccttgaagctgtgcaaaatttgactaatgagacagctaaatgggcaccaggaccttgaattgtttgtggtgccttatttagttcatttggtgaggctgtgtttt

SEQ ID NO: 467446 - DNA, 740 bp, Homo sapiens
gctgatactaccgctatcatctccgcagcagcagcagcagcagtggtagcacagtagggtgcatgatcatggactgtgccagggtgtctgcctctgtgcagacattcacagcagcagtggagtcagcatggctacaggggtcagcattggcaactgtgcatacagtcatgctggtggtgttgttaacacggggcaaggtgctgatgggcacaggaggtttaatctgctcacagttctttatggccgaggaagtcttggcaaacttacaatcatggcagaaagtgaaggggaagcaagacacgtcttacacggcggcagggacatggatgaagctggaaacgatcatcctcagcaaactaacacaggaacagaaagtcaggcccctctgctgcaggtctgctggagtttgctggatgtccactccagaccctgtttgcctgggtctcactggcagaggctgcagaccagcaaagattgctgcctgttccttcttctggaagcttcgtcccagaggggcacccaccagatgccagccagagctctcctatatgaggtgtctgtcagcccctactgggaggtgtctcctagttaggatacaggggaattatagatatatactgctgcttctcaatgcatgaaaatagttgtttcatgttttctcccattttatagtgttcgtgacagaactgcaggtttggtaccagttactttgcagctagaggttaaagtctttgccaagc

SEQ ID NO: 467447 - DNA, 975 bp, Homo sapiens
tctggtcagcagggacctggtcaatgtgggctgctgagcactgcttggataagccaggtgcaatgtgcattattgaaggccctgtggacagctgggatagcccagtgatgcccaagggcctagtcagaagtggacaaagcacttatttggatggacctgggagatcctgctcagagattctgacaggacaaaggattccagaacactgctacaaggctctgagtgtttgtccctcacataggattccagaacactgctgccattgtctgaatgtttgtccccgacataggattccagaagcctgctgctggggtctgaatgtttgtcccccatctaggattccagaacactgctgcgagggtctgaattcacatagaattccagaacactgctacaagggtgtgaatatttttccctcacctagtattccagaacactgttgcaagggtctgcatgttggtccatcatataggattccagaacactgctgctgtggtctgaatgtttgtccctcacatagaattccggaacactgctacaagggtctgaatgtttgtccttcacataccattccagaacactgctaccgtggtctgaatgtatgtccctcacataggattccagaacactgctactaggttctgaatgtttttcccacacctaggattccagaacacttctgctggtgtctgaatggttgtccctcacatatgattccaggacactgctatgagagtcttaatgtttgtccttcacatagaattccagaacactgctcccgtggtctgaatgtttgtccctcacatagcattccagaacactgctacaagggtttgaaagtttgtccctcacataggattccacaacactactgctggggtctgaatgtttggccctcacataggattctagaacactccagctggcttctgagtgtttgtccctcacataggattcctgaacactgctgctgtc

SEQ ID NO: 467448 - DNA, 3878 bp, Homo sapiens
tgcaacctctttcctcaccccgtgaagtggaatggaatggaagggaatgcaatggaatggaatggaatagaattaacacgagtggcatggaatggaaaggaatggaatagaattgaatggaatggaatcaacccgattggaatggaatggaatggtacggaatggaatggaatggaacggaatcaactcgagtggaaaggaatggaatggaaaagaatggaatgtaatagaaaggaatggaatgcaatggaatgcaatggcatggaatggagtcaacccgagtggaatggaatggaatgcaatggaagggaaaacaggaatggaatggaatggaatgaaaccaacactatggaatggaatgggatggaatggaatggaaaggaatcaactcgaatggaatggaatggaatggaatgcaatggaatggaatggaatggaattaacccgtgtggaatggaaagtgaaatggaatggaaaggaatggaatggaatcaaaccgagaggaatggaatggaatggaatggaatggaatggaacagaatggaacggaacgcaattgaatggaatggaatcaacccaagtggaaaggaatggaatggaatggaatggaatggaataacatgcaatcaactttggtggaatggattggaatggaaaggaatggaatggaatggaataaaagggcatggaatggaacggaatcaacccgaatggaacggaacggaatggagtggaatggtatggaatggaatggaatggaaaggaatcaacctgaaggtggaatggaatggaatggaatttaatggaatggaatggaatagaatagtatggaatcaacccgagtggaatggtatagaatggaacggaatggaacggaatggaagggaatggaatggaatggatacaacccgagaggaatggaatggaaaggaatggagtaaccggagcggaatggaatggaaaggatggaatgcaatggaatggaatggaatggagtggaatggaatggaatggaatcaacccgagttgaatggaatggaatggaatggaacggaatataatggaatggaacgaaatcatcccgagtggaatggaatggtatcaaatgcaatagaatggaatggaacagaactgaatgaaatgaaatggaatagattgaatgcgagtggaatggaatggaatggaatggactggaatggaatggaatggattggagtggaatggaatggaatcaacacgaatgggatggaacggaatggaatggaatggaatggaatggaaaggaaaagaaccgaatggaatccacccgattggaatggaatggaaaggaatggaatccacccgatggaaatgaatggaatggaatggattggaaaggaatggaatggattggaatggattggaatggaaaggaatggaatggaatggtatggaatgaaatggaaaggaacggaatataatcaacaaaagtggaatggaatggaatggaatggaagggaatcaacacgagtggaattgaatggaaaggaatgcaatggaatggaatggaatggaatcaacccgagtggagtagaatggaatggaatggaaacaaccccagtggaatggaatggaatggaatgcaatagaatggaatggaatggaatggaatggaattcaatggaatcaacccgagtggaatggaatggtttggaatgcaatggaatggagtttaacagaacagaatggaatggaatggaattgattgaatccgagaatggaaaggattcaacccgagtggaatgtaatggattggaatggagtggaatggaatggaatggaatggaatggaatcaacagaaatggaatggaatggaatgcaatggaatagaatggaacggaatggaatgcaatggaacagaatggaatgcaatgaaatggaataaacccgaatggaatgtaattggaacggaatgttatggaatggagtggaatggaatggaatggaatgaaatggaatggaacagaatcgaaaccaatggaatcaactggaatggaatggaatggaatcgaatggaatcaatctgggtggaatggaatggtatggaatacaatagaatggaatggaatggaatggaatggaatggaattcaatggaatcaaccccagtggaatagaatggtatggaatgcaattgaatggagtggaacagaacggaatggaatccgaatggaatggaatggaatggaatggaatggaatggaatggaatggagtggaatggaataaacaccagtggaatgaaatggaatggaatggaatggaatggaaaggaatggaaaggaatggaatggaaaagaatgaaatcaacccgagtagaatggaacagaatggaatggaatggaatggaatggaatggaatggaatggaatggaatggaatggaaaggaatggaatcaactggaatggaatgaaatggactggaatggagtggaatggaatagaatgcagtggaatcaacaagagtgaaatgcaatggaatggaatggaatggaatcaacccgagtggagtgaaataaaatggaatggaatggaatggaatggaatagcatgcaatcaactttggtggaatggtatggaatggtatggaatggaatggaatggagtgaggaatggaatggaatggaatggaatggaatggaatggaatggaaatgaatcaaaccgagtggaatggaatggaatggagtggaatggaaacaatgcaatgcaatggtatcaacgggaatggaatgcattggaatggaatggaatggaatcaccctgagtggataggaatggaatggaagggaatggaaaggaatggaatggaatggaacctaatggaacggaatttaaacaacccgaagtggaatgcaatggaatggaatagaatggaatggaatcaacccgagttgaatggaatggaatggaatggaacggaatttaatggaatggagcagaatcatcccgagtggaatgaaatggtatggaatgcaagagaatggaatggaacagaacggaatgaaatggaatggaatacattgaatgcgaatggaattgaatggaatggaatggattggaatggaatggaatggattggagtggaatggaatagaatcaacacgaaggggatggaacggaatggaatggaatggaatggaatggaatggaatggaacggaagggaatcaacccgaggggaatggaatggaatggaatggaatggaatccacccgattggaatggaatggaatggaatgaaacggaattgaacggaatgtaatggaattaaatggaatcatcccgagtggaatggaatggtatctaatgcaatggaatggaatgcaacagaacagaatggaatggaaagaatacattgaatccaagtggaattgaatggaatggaatggattggaaaggaatggaatggattggaatggattggaatggaaaggaatggattcaacccgagtggaatgtaatggattggaatggaatggaatggaatggaatcaacgcgaatggaatggaacggaatgaaatggaatggaatggaatggaatggaatggaatggaatggaatagaatggaatggaatggaatggaatgcaatggaacggaatagaatcaacccaagtggaatggaatggaatggaatggaagggaatcaacacgagtggaatggaatggaaaggaatgcaatggaatggaatggaatggaatggaatggaatggaacggaattcaatggaatcaactgcagtggagtagaatggaatggaatgcaatcaaccccagtggaatggattggaatggtatgcaatagaatggaatggaatggaatggaatggaatggaattc

SEQ ID NO: 467449 - DNA, 1892 bp, Homo sapiens
tcagcctcctcctcacatggagcttttgagggacctgtctctgtctctgtcacacacagagtgtcacaacgtctggctctggacagccatgggtgatcagctgcccggccctctcctctcccttcgccccatgccccggagtcggtaccctgccccacggctggcccccagccccaggaccactcaccctccatgatgcccccagttgcgggctccggcggtctccgatggcgggaggcagcgggccccttcgggccagcgggcagagggacggtctccgggcacttggttgcgggctgcgcccctgcctccgcgctccgcaggtccggtcggtccgggcagaggtgagcagggggcgtgcgctcccaggccccgggccctggccggtttccctcccctcgggctgactggctcccgcgcagcgctgctgcccgcagggctcagccgcccgccgcccctcgcctcccgaccaggggaaggagggggctcgtgaggcgcagtcgtcatggcacccgcgcacctgtgcccgccgagcgagggcgccccgggcccgcctcccgcatggcgctctctccacagagcccgagcgcccctccgaagtaggggacacacccctcctcccactgcagccctggcagcggcgtcccgtaattccccacctctctcccgtgcctcatatgccagcctctgtccccactcctcatccttgcccaccctagcctggggtccagcactctgggccttcctgagaaggggatgagagacatttttcttctaccattaaaaccttcctatagtgtcaagtccacgtggtaccagacaaaacaaatttcatcagcagcagcattagattctcctgggagcgcaaatcctgttgtgaactgcacatgcacaggatctagggtgcgcactccttatgagagtctaatgcctgatcatctgatgtggaacagtttcatccccaaaccatcagcccccacccccgagtccgtggaaaaatcgtgttccacaaaaccagtccctggtgccaaaaacacttccaggtacttcctggttaaacccaatctcttccacaggccacccaagatgcccacggcccagtccttgtccatttccccaccctgcaatcctaccgcttctccctcccacctgacccgctcctcactgagcaccttgctgttccactaactgctccgcgccttggcatgtgctatgccctctgcctggctatcttttggtgctccctctcctgtccccctcctcacctgcccatcagcctgtctcttgtcccatcctctctgctcccacatctagaatagctcttagatcagtgattcccaaactgctgcactttagaatctcctggggagacttgaagtcatcacaccccataccaataaaatcagaatgtctcagtattcttcatctatataattgaaataatagtagctgcctcctgtgttgctgtgggggttaaacgaggtgagaagtggagagcacttagtgtggtcacagacacctggtgagctgctggtgatgcttttcacttcctctactcttttttgacacctctggttttttcctttcacgtcaagctttgggtggctcttgcctttctctaagagaaacacggagcagctgataaatttggtcccaggaatgttaacgctcaagataccctcccaggggaatctgttacaaggaaatatgacccaaaatctagaaaagagacaaagatgataactgcattgttcaacaggcctgcctgtgagaatgtaccactgtaactttgttagttactattaattaaaggcacagactctgtgaggttacttgttaacttatggattcctgtccggcagaaaaaaataaccccaagttgactttatcag

SEQ ID NO: 467450 - DNA, 3277 bp, Homo sapiens
ggaggcaaacagaggtggagagtgactgagtcctgaagacatcaccgaaacccttcaatcaaattgtgccagaagcccggtgacaggagtcctttcagctccagccagtttgagttgggtttcctttcttgggctactctcctggtttgaagtgtggggcacccccaccccttgcccagaaggacctttgtcaatcctccaaggctccactagtatgtggcatctgcagaaactgaatacagagaggtcagaatgtggtccaagaaaaagagtgatgatggtggcggtggtggtggtggtggttatagtggtggtgatggtggtggtgatggcagtagtggtgataatgatgctggtggtggtgtggcagtgatggtgggtggtggtggtggtggtgatagtgatgatgatagtaatgatagtagtggtaatggtggtggaggcggtgatggcagtagtggagataatggtggtggtgatggtggtagtggtggtgatggtggtggagatggtggtgacggtggtggtggtggtgatgatagtgatgatgatggtaatggtggtagtgatgatggtggtggtagcagtgatggcaacagtggagataatggtggtggtggtgatggtggtagtggtgataatggtgaggtggtgatggcagtggcagtgagggcggtggtggtgatggcagcggtgctggtggtggtgctggtgatggtggtgaatgggatgtatgtcaacgtaaagtagagtactcacctgttcaccaagtttcccccagttgccatgtttttactaggcacacgaccaagcagggtcaatcacagaaccacacatttctagccactatgattggcccaaaggatggccaagtgaaaccaaccagggacttccattagaatttttcaatcagagcttgggagatagaaattcttttgcttttgagtcactatgcagctgtgtataaatccatgaagctcacatagacaagagtttgtctgcagaagagaataaaattgactctggagagaagtggagatgagagatggagaaaatgaaagctttctgttggtgtttgagtcccttgggcacagtcatccctcggacagtctcaccctttctagtttagatctgtgaactacaatcctttccatctcttttcttaagtcagtggacttggatttccgttacttactaccaaagggttctgtctggccctgagcataggtgatcttgaaagtgcaaagatgatcatgtaagagagatcctaacagtgacaatggctgagaggaagatgaaaaaggtgaaggcaacatcagtgatggaggtggttgtgggatgggatggtgttgctgctaacagaagtgatggtaatcatggtttagattaaatggtggcattgatggatgacattggtgatgatgtcacattggtggtgtgattggtagtgaggatcatgaagatgccaaggctttgccagcctagaaacacaggcccaaacgacccaagaaaggaccacctagaaagagagaacaaattcttccaagatggcaggtgctggttcttttttaagctgggtaactcctagctaaacctggacctggaggggtagaaggaccacaggtggtatcccatagagcttcagaattatattgaaaccttccggaacagagagacctggggtccctaaccccatcaggtccttttgagaattccaagtgcctctagtcaagaggagtagccaggttcaaacaacaggcaagatgaacttgggtgtaggggttgcatttttggtcagtgggagaacaatcataaaaaagcactgtgtcttatgtctgaccatttacacttcagctgtgtatatctgtgaatatttgttcaccgtggtctacttggtgaaaatgagtcacttctggagaataataataactaatttttgttaagcgttactatggactgttctaagtgctttactatacacatcatctcgcaagatgaaatctgcacgagagtaggtatttctatttccccatttaacagatgagaaaaaccaggacttcagcctggcttgctgaatttgaccctgggaggtatagcctggagctgctgacagccatcttaccccaacttgaaaatgaagacaacaggaagagagtagggctgagaaatggaccaagactgctccctagtgacaatttgaaatcctggaacaagctgcacctgaagctagagctatgttgggctttttaggagtatggtctaatgaattctcttttggctcaagcctgatgagttgggttttcagtcactggcaaccccaagagtcctaacaatagggtgggcagtcgacttacctccacccccaccttgcctgacctaaaaactcctgatgtgttttgtgtgaggctcggactttcaacgagaaagctgtttccctgccaaatgcttctgcttgggggtgctgaaacatggggcctgttaagaaggaaaaaccagttgtccataatgggtcaaagtcatactgtcaggcaatctcttcctcctaggtaggaacatggtcattaccatgaaatgctggagaaggaggtgctccaaagggaggcagaagagaacggcaggcaaggtccccccttatgaaggcatcagcggggagctatgtatgggtcattccctggggaaactggcctggctgttgggaatgtttcccaggagaatgcacagctctgctgcacattcccactcaggcccttcctcaaatggctaaataaaccgaagggctttgctacgtatttttcattccacatactatttgctctgcctgcctgccccagacagccaagtttaacccaacagagacgttcttcttacagaattcaaatgtatcccgtaactcgaggcaccacatgtcaactgtcacactgtgtagctttgtgcccaattcagcagatatttctgaacatcttcagccaggcccaggtttggtcaggccctctgtgagcaatgatgtgagttagatgcagctcctgtttctcaaggagctcagagttgggggaagtaggatgtgaaagaaacgaactgttacacaaggtggagagaagtaagggcaagtgagaattggggtgggagccctgtgttttcagaatctcggggaaaggggtgtgtggggaggtagggctgacaggattcacggtgaggggtggcttggggcttacccttcgagggtgagagtttcactctggggagagggtggaagacttctgggctgagaggcagtggg

SEQ ID NO: 467451 - DNA, 1252 bp, Homo sapiens
cctggatctgaagccggcctttcaccacgagcagtaagcagagagtgcctaatgactccaagctgtcctggaacgttctcttggccctggggagctgctgggggagtctggctgctgtgcacagcagctgtgtgagctgcctgccggcagcaagcccagccaccagagaccaccagtggccacaaccaggggccgccggcagatggggccaggagagggcagctccttcttttctcggcttgggatctagggtcagccgggttagcaaggagcagggctgtgtggccaagcgggctcaggccctggctcttcctcccttcctgtgagctgatagaaagggcccagaatctcagactccctcctttctccagaagcatccagctctcccattatctccctcctcctccctcccagaattcttccgaattgacccttcactcgtcatctatatactcagttgatgactaattgccatcacctgtcaggaggggacgggagagggtgtctccacaaacaggcggtcccagcagccggaatggaacatgaggctctccttgcctgcactggcgaggatgccacgcagaatgcgctgacaggccttcgaaagccagagcagaggctgccaagatggggccaggcaggaagcagggagggacagaccccacagagggagacgagaggaggtcaaggaggcggggaaagaagcagagaggagggggcaggaccagagcagacacagacttggggagcttgcttccgaggctccaagctcatccgtcaactcagcagccccagtagcagtgccggcagcagttactgggtcctgagccagcctcagcagatgccctcctactggaaacacagggcctggttcctgttagccaagggctttaccagccagcgccaggccacacccagccactctgagaagaccaagaaagaaagagagttgcttcagggtggccccagtgactccaagtgccccagggagctctttcatggctctgctgagcctgtgcagccagtgccccatcaatcccggccaccccttgcacccctggccaccccttgcacccctgagtgccttgtaagcagttttaaggacaccagctgcatttgtgggtagttgacaggtggtttaatcagagactgcagtttctgtttgaagaacaagggaaaatcccagaaggaggcctgagaatttgcaaggaaatactggcgggctgactttctgtctgtcaaagacagtccc

SEQ ID NO: 467452 - DNA, 540 bp, Homo sapiens
tgccaaagcaaagggcaagcaggacacttcctggccttgataacatgacaagtgagtttcctcataggcaaaacgggggtcttgggttattctggggacaaggaagcacagtgcatgtaaagcacaccactcagcgcctgccccgttcttcctgccctggcgatatgctaaacaacagggtctccactaggccagatggggaggggaaggggaggagaagagacccatttcccaaaaatattgacttcgaccttgaacccaagcagctggccatgaaagactgttactgctgctctgcctatgtggaagctggcccagagaggttaagtgactcatcttgggtcacacagcctttcaagaccagctgcacattcatcatgtctgccatctgaatagaaacctggagatggcatgggcctgaagtctacagaaggctgccctgtaggagtaatagggcactctgcacaagtgtctaggctctggcgtcagggctgcccagacccaaatcttgtccctaccaccctcaagttgtaggagctt

SEQ ID NO: 467453 - DNA, 916 bp, Homo sapiens
ccaggtctccctgatgctcagccggcagctgtcctggtgtgtggatggccctggctggcgtccttctcagagaggaccattgttgcccaatcacaaaatcaacctcttggtgtcaggagtcagcacttcccaaacttttatgtgccgtgaatcacctggagatcttgtgaagctgcagctcccgggcgatgctgtgtcctggggccacacttggagcacaagggctgagccatccggcagagcctctgtcccttggttctcagccctgggacctgagaaaaatacttctcctgggccctacctccagaatctctgcttattggtggagagcgaaccagcaccgatccacctgcactggctcaggcttcgaggcaacaggattgaaaacacagcttttgttctgtgtctccaagaaggctcagctgctctgagcacccacagttcctgatctggactcccttgtggtttgtaacgcacttgagtcaatgtggggtcagtgttaggagcagtggtgatgagagttagaattcagtctggggctaggaccaacgggcattcttacaaagtcagggatcagactgcatccagagtccaatcaccagcccctggtaaccaccattctgctttctatctctgtgaatttggctcctctagttacctcacgtaaatggaatcatacagtattttttctatttgtgactggcttatttcacttagcgtaatgtcctccaggttcatccgtgttttagcatgtgtcagaatttccttgctttttaaggctggataggattccattgtatggatagcccacattttgtttatccatttatgtttgatgggtggttgggttccttccaccttttggctgctgattcttgaagggaatcctgactagttcggggagtttaagaaactc

SEQ ID NO: 467454 - DNA, 573 bp, Homo sapiens
gtgtgtgcacagagctgctgtcctttaggccaaaacatgctggctggctgcccagtggctggacaggggtgactctatgtcaacctcctcgccaaagatgcccatgcctctcactcaaagcgaaggaatcttgcattattttgagagctactcagagggtaaactgctcccaaagcaggatgtgaagttccaggaggcaaacacaaggcagcgtttgcagacccttggatttctctcccaagttgtgaggaggtggggcaagtcctggggaatccccagggccgtgggtccttgccccttttccactgggggtcccatcttccaggctggtctccttgagccgctgcccagaaatgaacggattcctggtgtgctgttcctgctctggaagcaaaaggcgattgtcgggagcaatgtcctgggatggctagaacggcagcccgagccccactctggggagacaaaggggctgtcaggctattggagggtaatttgcttgacttctggagatgaggcctgactgcaaaagttttcctgtacctcccggtgttaatagaaaggccagggtcattg

SEQ ID NO: 467455 - DNA, 632 bp, Homo sapiens
ttgtcaggtctaatgagcgtgatgtccagatgctggggctggggacagcttcttcatttattccagctaacccttctctactctgctttcctggcttgggctaaaagctggatctttggcctggcgctgaagccatttgatccagcggctgcaaagggtgtttccatcttttactgtcagctgttgcttctgagccaccagcatgtgtgggagacccttacatctgcagtcatggtgctccatggtgctggtgagggacatgaggtcccagaggagctgtggtttgctggacgtcagctggagggtgggagagtgggattcaaacccagcccatgctcttttgataacatcctgaaagaaagcagggcatctgacaaggatggacagagactggctctaagagaagtgtgcacgtctttggaggtgagctgggacaatgaggtcggtcttgacccttccgaccattacacctctctgcgcagcactgtggtgctgctcaatgagatgccatctgacgtataacattttgaaagatcaactggtattttcccctctggatttccttccccacccttctcggggtctgcagccaggctcctcagcggtggtgttcctcccttctgggaaaggac

SEQ ID NO: 467456 - DNA, 1169 bp, Homo sapiens
cagtcttgtaggtatttctaaagatgagggatcggaggctcagagaggctcgcttcgcaatcttgtttgcagcgaaggggcatagtggtctgtgcggcgcggtgcccagtcccgcccgccccgccgcgcctggccgggcgcctggcacagcccaggcgctcagcggaggccccaggcatggcaggacctacggagcccggtgaggtgagcgcgccaggccggccggctgggctggaggcagaggcccaggcgcccgccctcgtgggaaagcgcgcggagggcgacccgggtgagtcagccgaagagcagacgggctgcggagcaagaagaccgaggctggaggcggcagtgaacgccactctgccctgtgccctcatcttcacagccagccctctcccctccagctgccgcaccttctccacagcagttgtccgtggtgcctacactccccgcttcacggtcacccttcacccgccctgcctggccgcacagcagcctttgacacgattgaaatgctccccacctcttagctttcgtgcggctaagcttcccttccgccgtctgggcccctgctcagtcctctttgtcttctgagcctcttccccctgccccaggcctcccctcccctcgaagcccgccctccaaggctgtgcttcgacttctcttctcccctgcggttacttgcctctcctggagggtctcacccatcctggggcttaaaagccaccaatgcccatggtgcccggcctttgtctaccccagaccagtcctcagaactctggacccctgcacccaccggcctaccgtgcgtctcccgtgggctccctcacagtcatctccggctccattcatcaagactgaactcctctgcgccttctccagcgttctgtctgcagccaagcccctgattcctgattccttcctccctcaacaccacaacatccaacctcataccagccatgtggatcccacttccaaaatggctctctagaatccacctgctcctccccatctcttctgtcaccacctggtcccagccaccatcatctctctcctggacaactgtggaggcctccctgcctccaccctggccccccagaatccactcctctcaggagctagatgggatggcatcactcccctcactgaaacccttcagtgcctctcat

SEQ ID NO: 467457 - DNA, 2380 bp, Homo sapiens
gcaatgcttcccagagtctgggagcgcctctgctagttggctccacattgcaaaccagaaagccatggggtgggctgtctttctcgcccccacctggggttggctctcattcccctcgctgctcctcctcagtgtgcaggcccttgtgagctggcacagcagcctcaaggtcctgttgggcagctcttccctgccccagagacatcagatctcgatgctggtgcacagcagacttgtctgtggctttttggtctcctgtgccaaacacctgtccttgccccgggggctgctcttgactggctggatgatagaggaagccgaggctcaagttggggaggagatccagggtcatggaatagcaggtgagtgtcaggtgtcagggcacgcaaggaccaaggttcctgactcccaggcaatgttcctctcgcagttccaggcagcctctcctgtcagtggaaaggccaagcgtatgtgaacagaaactcaaggtcgtaaactgtgtgctgtcccgtgatatggtagctgtggcaacagcttcagaatgattaatgctaaaagtgattggtctaatggtggtgggaggtgaaggggcctgggggtactgagtagaggtgtttatgaggctcccactatgagggggagggctgcttaacttctgcgtgtcattgtcttctctgaaactgggaggccaactaagaaaaacagatgtcaatggcccagttagtgggatttgatgctcaaacggaaccttctggtgtttctcagactcaagtcaccagtgctgctgttttatccattttcaaaatattggagagggagagggctgctgttatgtacacattacttgtcatggaacattgaaaaaccctgcagtctaattttcttctgctttcagtagcatggctgatggggcagtagaacaggcccctttttagagaaatgtctggaggtgagatcgtttgttaggaccaagttggtctgaatgcaaactctgttcccaacgggtggctgaaggcctttgtcagcctttgctttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaagacagaggaatttttcttagtgcagaacaaaatgaaaagtctcccatgtctacttctttctacacagacacggcaaccatccgatttctcaatcttttccccgcctttcccgcctttctattccacaaagcctccattgtcattctgtcccgttctcaatgagctgttgggcacacctcccagacagtgtggtggctgggcatatgcgcccctcacctccctgacggtgcggctggctgggcagtgttttcttcatttcaacctttcttaattctcaccattatctctttttttacttactcttttatttctctccctttccttttttctctatttttcctatttttaatattcccccttcttccttttcttttctttttctcctctttctttccctcttttttctttctctcttttctcctttctttccttctctcttcttttctcctttcttctctttttcttcttttttctctttctttcttttttcctttattttttttttcttcttttttttcctctcttttctcctatctttatctcttcacttttttttcttattttttatccttccattccttcttattctttttttcccctcttctcttttccccttttcacatccttgtcccttctctcttcttacttttcctttcccacttctcatttatctcctttcttctatttcatccttcccacctccttttttcttattcctctttattcttctattctacctcttatctcattttttttatctcttttatatctcttttatattatatccttccacccttcatatcttttctattattctcacattttaatacatctttttctcatccctatttctcactctcgctatctcaaactcttcattttattctctcattactatcatcattacatcaacatgatcttcttattcatctctttttgattatacctttctctcctatatctattttaaccacttcattgattatctccccc

SEQ ID NO: 467458 - DNA, 1002 bp, Homo sapiens
aaagtgtcccattggcacctcatgatgatctgtggaggtggaggttctgccaagagaggtacagccacctggctgctgcctttggccaagttccttccactttggcctgagcttcccaaccagccagaaaagcagacggaaaaccagagaaacctagccctggcggctcaggaccagaggctgcctgggagcatgactgaggacctactagaggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaggggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttggtctcaggctctagaaacttcttttccacaggtcaatc

SEQ ID NO: 467459 - DNA, 752 bp, Homo sapiens
catgtgaccgagtgaatgcagggtccagccagctgcactgagccatgacacaggaacaggctctgtgtggggcccacagccagatcagcctgatggacagcggcatgttggcagctcaggcggcccctttctccactctggcccgtggctcctggaccagcttggccctgctgcagcttctgttctgtggggcagctgccctccaccaccccgggcagcagagagcctacacttacctcctcaccacaaacctggtagtgggcagccagcctggtagtcaccaccgggagaagggcaagagtatggaaaatatgaagaaagacacctccttcctgtggggccactggggatatggcaattactatcacaatgagagaccgctgagcacattcttcactgaaatcattctctgctgcagcttttggaatccggtcactcttgaaaacaccaaaggccactggagcctacagctgcccatcatgtcaagatctgctggtatcacggtagcactcagcagtggcagcccattgcttcagctcctggaagaacaaaaggccatctgctgagtcagaggtcccaccagaagccaagtcagccacttctgaaaaccatttggcaatttcaatttcttatgaagtagaacagacacttacctatgtatcagcaaccccactccaagagaaatgaagacacgtccacacaaaagcctgtgtgctaatgttcatgtttgtggcagctgtgcttgaaaacaa

SEQ ID NO: 467460 - DNA, 1100 bp, Homo sapiens
ccccaccctcctgcatccctgccacgttgttcctcacaagtggtcatccacccctagtgtgacatggtcaccgataggtataaactgctcacattcaaaatacatacatatatatatacacacttgacggactttcacacgtgtatacagccatgtaaaaggctcatagatcaagatatagaacaattgcaacagcccaggagtttgattgtgccttttccagtcagtaacctgcccagagggattgcttttcaagaccccaatcaaaccccacctcctctagaaagtcagcccttctgctcacagccctggttgatattccctggctttggaggcactggtgcatatagcccgttcaatgccgtgaaagaacgcatcttggcttctgcatacaccttgtgggcagggacggtgtcttctctttcacatctgccccgtgtctcaggtgatgctggagctcgatcagctcttgtggactttcgaaggtagggtcgaggtgtggcccagtttgcctgagacagtcccaattgccacttactgacatggcatggttaataacagcccctcctgaggcccagaggagaggggagctgagatggaagccaaggggccgatcgggaagagaacacttgtttcagggacagaactgggtctagtactgacggcctcctgtgtgccatgtgctctcagatgaatccctcatcctctgcacctcagtttcttcttctgtacaatagagaaaataaatcttcacctgtctcaccgggcagttataagggtaaatgagccatcagatgaggctgtgacaggagacagtgcagacgtacagagaagctgctcctgtcttcccaaggccctgcttgcgacagggaatgtggtcacctgccctgtggcagtcccatgggccctgggagagggacattcagcatgctcagaggagggactggcatgccccagtgggggaagcctggccgagtgttaacatcagttcagtccaggtagtggctaaatgttcttttttgaatgttcaaaatatttcgtgaataatttttttctttattgagctataattgaaaaataaaattgtatatatttattcc

SEQ ID NO: 467461 - DNA, 805 bp, Homo sapiens
gatggctgcaaatcagccacttggtgcagtggaacaaacacagccaagcagctcagacctgcaggcctgtccctgacagtctccgtgaccttgcgaagagacaccgtcattcattcaggacacatttattagggagctggcctgacagctgggagatggatcaggctgtcccctgccctcaaggggctcaccactgagtgggagaggtggccccatgaacagtaagccccacaatgggtcacagggatggggatagcacatgcacccccccaaggaacgagggagcaaggggcaagttcagcaaagaggacccagcagtcaaagtcctcaggcaaagaaataaagatggcagttggcggttgggccagtgtgccctgaaatgggaaggaagaggggatataggtggagaaccaacagtgtttgctacagtggctgagtttttccaccaccaggggtatgtccaggcccatggggaacacatgcatgcttcctaccatatgacagcaggctggccctcggttctcacactccagtgtggcctgcgccaaggcaggcacctgaaagacctgggagatgtaagcactggcagttctcggaccctcacaagccccctcccctggaccccagggcgggatgagaaggggcagaggcataacagggcctgtgacctgtggcctgctcaaggtccacccaccctgcccaagcggcacgctggagctgcaggctgacagcaggcaggctgggggagaatggccctggagtagtggcctgcaggctcctgatgagctcctaccaaggaggctct

SEQ ID NO: 467462 - DNA, 794 bp, Homo sapiens
acgtatccctggttaagtattcaatgtggcaccatagtacgagtgcaggtgttttgaatttacacctatcctagctttcacttctgatccaactcatgggtttggagatggacgccgcacacggctgcctctccttgcaggcatgagggtgaaggggccttcagtggagcccgtggggatgggggtcctagtcccagccaggcagtggccaccgcagcatgtgtttccatgacaacactggacaccggcatttctctcacgagaacacaggtcttgcagaggatggctgggaagcagagcaggttacggggctgtcattgcagagccagcatctgtacctggctacaagactcagccacactccagcccatagtctccatcatgaggtgaagctttgtcccctcacattgatggccagacacacggggcgcagcagaagtgactcggggcctgttgctttgggaaataggggttttcacctcctacttctagagtcatttgctgttgagatccagcctccattctgggagccagcttgggctgcctgcctgtgtctgagccatcttggaagtgaaccccttcgaacccagcacccttgcttgtgccatggagcacacacaagctgccatttctatccctgacccaatggcagattcccgaggaaatcaaatgagtggtgacttccagccactaagttaccgtagcagttaactgatacacaaccgttagactgttcctaaagctgtgtttaaaataaaactttaagctggtagcgctatagaaataactgttga

SEQ ID NO: 467463 - DNA, 685 bp, Homo sapiens
cttaggtctgtgagcttctaagggaagggactgacttccatctccacatcccgttgccactatggggcatgcagaagtggacagagttgatagcttgagtcagaaatgcaactcatttaacttcctgcagaacagtgcttgggagtttttctcatttctggttcttttatgctggcgatacatcggtgtctatggtttcctaggcttcatcctgactgacctcttcatggtaggaattctatccaggactcttatttcaagaggaacccaaaatgagattcctttcaccagaagtcccaccagaagtacaaattctgacaaatttgtacatgggcccaatttttgtggtgcttctgttgaaaaccgaaatcccctcctgaataaaagggatatcccacttagacaattcagaagatcttatcttcttccatgcaactttctcatttccattagcacatccagatgactagtctattgttcctatatagaaatgctgcagatttttgtgtattaattttgtatcttgcaacattatttgtcagttataacggttttatttttgtgacatctttaggtttttctctatgtaagattacatcgtctgcaaacagaaacaatttaactttctcctttccaatttgaatgtgctttactaatttctcttgcctgattgctgtggttagga

SEQ ID NO: 467464 - DNA, 1505 bp, Homo sapiens
aataaaggtggttttggaaggataagctccatactggagccagctcctgcccagaggaagcagtgtgaccagtgtgatggccacagaagcagaggccaagaagccccaggaagcaaacatgaaggacccagagcccttcttcctcctccagcttgtgggcccatctggtgccctgtactgcaggcagcttgcaggtcccagctttggcatcctagatcccaagatgcaaagccaaagcggcagcaagccccattccctagacactcaagagctgttctctgtgctgcagctgaagctggcttcagaccccttgggcgggctcccaggcaacctacagtgcaatgacagcgtccatcgccccctctcctgcagaaggccacctgcgcgggaagaaggaagcaatgctgacttgaccttctgcagccgcggagggggagatggatgctgtcctggtgctgtaggctgcctgggagccccgccccgcggatctgaagagccctcctcccctcgggagctgtttaggcagcttcgggtagagatggaggcctaatcgttttcattatcttctgcatatccactctttattttctgaaatgcttacgaatttttttctttcatatttatcaccttagaatttggtagcagtattttggaaaaatgttaacgcctgtcattgttcggaaatttcaaagaacttctgacattgcctttttctactgatgacagcagtgcggccccaagctgcctgcctttgggagacagaggagccacacttgtacatgctttgaaagtgagaaacttacagaaacctagaaaaaggattttggacctcaggatctgaatggttcttggagttctttgcagatgaggcatttatctgatttcttactttcctaagagcccctccctgccttttctctcacttagcccttctcctcaaagccctcagtattgatgtgggattgaggagacgggatcagcgatgggatcggagagggctggaatctgtttctggtggagggaaggttgcatcagccacttccctcggctcccgtagaggccattcctagcgaagcacagtctttgcctctggctggaatgttctccccttgaagacacctccaggtctttgcagacatctgcttcccttgtctggccctgctatgcagctctgtgctttatctacagccatggcataggaagcagcctgagacatgacacggctgcctcatgcccagcttgttgagtaccacgtgacctccctgcaggtaaggacatttgtctgcattattttctgcttgctcaggacctggcatgaaagaggcattagatacatatttgctcttcttgcatttttttcatgattaggcatattctgttttggctccttgtagagctcttggattaggttcaatttgctaaacgtgtaaacctataaattttaggatgcttttatccagagctgtttcatttcatcatctttccaaccctgggaagtaagggct

SEQ ID NO: 467465 - DNA, 592 bp, Homo sapiens
gtgcattcccactggccacaggtgctttctgttgcaattacctctgactgcaaatgttacgttttgattatttccctttgcagtgaatattgccagaccctcagagatcatctgcatgtttggcggtgtgagcagaggttgccaccactgttctttttgccctaactgttctgagtcagctgataggaattctgattctatgctcttttgccaagatgggaagctggtttggaagacttttggatctatacatcccagaatacttcttccctatttaggtatatcagtcattttatttcctactaagaattatttgtatcattcagagttgccaagcacagaacataactgtgaaatcccaaggtttctggaaatttttcagataggaaagggggacaaaatgaaccaggcagccaaatttcactctttgctctttgaaaagcaagaatgtttctgccctctttgcttctttttcctctcttgcagccctttcttctatctctaacctgttgatgtttcatagagtatgatttttctctgataagcatacacatgaccagggcactggttgaaagagtaaggtcttaacaaa

SEQ ID NO: 467466 - DNA, 602 bp, Homo sapiens
ccgaggcatatccattacaccgtctaaagaatctggacctagggattcccgtagtaggtttctaggaaaggaagaccagggcgcagcactgacaaccgggatggttttgcacgtcacctgagaccgtgagaaatcatcaagagtcctgcggagccaccctcagttggtagctcatgggctatgagtctggaaattaagggaaaaaatgttaggacaaaaataacaaagcataagatcctggtgaaaatattgagcttcccagaggttaaaagcgtagtcattgccactgtgactgtggctaaagagaaagaggtctgtagcgaggaaaggccttgcctggggcagtcagatgttagtagtagtagtagtagtagtagacgagaaaatagaggaagccctagaaaccagccaaggtcattttatcttacagacaaaattatgaatgaaagctggagtccacacacactcacactcacacgcacatccacaactcttcctaaagaaaattggaaaggaagatctctaaacccagcaactctagatgagatagaaatggaaccaaagagaaaaataaaacaagaccatctacgttaatggtcagc

SEQ ID NO: 467467 - DNA, 1597 bp, Homo sapiens
aagccgccagcagctgcagttactgcaacaggatttctgctatttagaaacacttcactacatttctttagaaattttgataaagaccaatttgttctccatgtgtgatgtcgttgatgtattcttcttaaagttatgtgagatgcatgggacagacacaaggagccccattcagcagcaagacataaacagatttggtagtttcctaaaggtgcatccctcgctggtggcagatctgggtgtgaatgcgtcctcggtgaagctgggtcggctcctgggaagcttagcaactcagacacaaagatatgagtctgctggtgccgtgatgtggacgtccggcctccagaacagtgagacatcagtgtctgctgttgataagccacccagctgtggtattttgttacagcagcccaaagagactaagaccacagcaaatggaaggagaggctcctcagtgtacactgagcgttcttcttccgtggccaccaagctcgaactgggaagggccggtgtccctaggacccatgactggtatccaacattcataccccagcacacaggtctccttgtggtcttcaggccctccaaaaaggttccaccttcagggtcttctcctgcgacgtgagtgccaataatcctatctggcaggaagcatcagggataatcaccttgatttctattattattgctgaatcttagaatcataatgttagaaggaaatttcatgctcatcaattttaacatccttattcagagaagggaattgtgtcactcccattgagcagctgtggggccctctcccacatggcccaggtccaccactctgtcaaaggtcgcacagcccagacaaaaacaggacacagcagtgtgtgaatgagccgggctttctccttccctccacgtaatagaaggtgcctgaggttgttgaaacacagtccatttctcctgggaatgacaagaatttgagggatgctgactttcaaggaatactgcatgacaggcatcaagataaacctgatgaagaaaacataggccagaatctgggaatcgggagcaaagtaatacagcttcggggacaggcacgtaatgaggtcatgatgtaggagactccctgcaggactggcggcccctgttccctgggttgttctggctctttcagaacctgaccctggaacaggactgagcaggtgcctgtgtgcacagaagaccttgtgtgagtcctttggtaccacgtttgctgcacgaatgtctgagacacctcacagtcgcttggttcagcctctccctcctctctccgctggggaacatcatccctcatcactggaagaaattacaaggattgtgtaaacaattacaagtattctacaaacatattttacttaaaaatccaagtaatagtattctactgtattgccttgaagaagtaaattgagaaaagtcagaacacttatgtatttttatttaaaaacgaacgttttagtcagcacccaatgcaacaaaagcaaactagaaattgcatgtcagcaataaaataaccaggttcttagaagggcggcctaagtcagctctacagattctcacctttgctgatttagcc

SEQ ID NO: 467468 - DNA, 592 bp, Homo sapiens
gaggaactggatgtggttttccataatgggtgtgtgttacatgggtgtattgtatgatgctgagatttcggatacagatcctgtgacccaggtagtgagcactttacccaacaggaccagttctgcaccagtgtcagtgacagaccagagtaaaaacctcagcagaatttgggaatctggtgccctgcacctgatgagcagctctccctgtgaacgtgcacgagaggcaacctcaggacttcatgagggtctcgcgggagtagaacctggagaggaaagaagagcattctccggaaaaatgagaggaggcaatggggatgtgtgtgtccttattggcttgttcagaaaaatgatgatgtcggcaatacaagctcagcaccctgagttcctgtgggaatatcaaggtcaaggctacttccctcatggtgctgtgagggtggagagtgctcccatctctgtttctttccgtgtgcccgctccaccccctctctcagcattcttccctaatatcttgacaagcgtccgatgatgttcccataagagttgacttggctttattagcccattattaattgaaatagtttagatattc

SEQ ID NO: 467469 - DNA, 460 bp, Homo sapiens
ccaacagctggcactgtgtccctggaaaagccacagacactcaatgccagcccatgaaagcagccaggaggggtgtatactccacaaagccacagaagtggagctgcccaagaccatgggaacccacctcttgcttcagcgtgacctggatgtgagacatggagtcaaaggagatcattttggagctttaagatttgacttccctgctggattttggacttgcataggccctcaaagtgttgaaagtgtgccttggttcctcctgactgcttatagtaaacatgtgaaagaacagagagaatttgaaggagaaattgttactcaaatggatccaagtcttaaaaatttgaaaggttctcagcctgttcatattgggaaacatcagaaagcatatttagaagataaaaccaagggtgtggtaaattatgacttggaaaaaagcttatgagattatataagc

SEQ ID NO: 467470 - DNA, 564 bp, Homo sapiens
ggactcgaacggaatggactctaatggaacagaatcgaatggaatggcatcgaatggaatcgaatgtaatagaatggaatggaatggtcccaaaaaatcgactggaatggaatcgaatggaaaggaatcaaatggaatggaatcgaatggaatggactggaatggaatggactcgaatggaattgattggaacataatggattcgaacagattggaattcaacagaatggaatggaatggaatggacgcgaatggaatggaaaaggaatgtactggatggaatggactcgaatggaatggactggaacaaaatggcatcgaagggattggaattgaacagaacgtaatggaattgcatggaatggactcgaatggaatggagttgaacggaatggaaccaaaaggaatggaaacgaatgggattgaaccgaatgttatggaattgaatggaatggcacttaatggaattgaaaggaatagaatggaatggagggtaatggaaagatatcaaaccgaatggaactgaatggactcgaacggattggactggaatgcaatggactc

SEQ ID NO: 467471 - DNA, 502 bp, Homo sapiens
tcgggacttgtttctcctaaatctttttttttttttttttttgagacagaatgactttcactggaaccgtttgggccacatgcccatgccggagccaatcaccacatccagcctggccagacctggctttcatgaagccccttcaggaagcgagtcaaaaagacctgggttgggtcccagctctgccatttaccagctgcacgacatcagaaaagttattttcatcctggacaagagcagccaaggagactgtagacctgtatctttatgagggcaaggatgagaatataacctggcctgtttttatgcaccaaggtacctgctgttctcatgaagatgtcagcagccagccagccagtctctacaaactccacccccaacctcactatgctcctttccctggaactttccaaggggcccttagaatttgtattcagctctcacaggctgagaccagggtgacatcctggaaaacctgcctagtgatagccaaggtgtagct

SEQ ID NO: 467472 - DNA, 780 bp, Homo sapiens
accccagcaaactccaacagacctgcagctgagggtcctgattgttagaaggaaaactagcaaacagaaaggaacagcatcaacaaaaaggacatccacaccaaaaccacatctgtaggtcaccatcattaaagaccaaaggtagataaaaccacaaagatggggggaaaccagagcagacaagctgaaaattcaaaaaatcagagcgccgcttctcctccaaaggattgcagctccttgccagcaatggaacacagctggatggagaatgactttgatgagttgacagaagtaggctttagaaggtcagtaataacaaacttctctgggctaaaggaggatgttcgaactcattgcaaggaagctaaaaaccttgaacaaagattagatgaatggctaactagaataaacagcatagagaagaccttaaatgacctgacggagctgaaaaccatggcacaagaactacatgatgcatgcacaagcttctgtagccgattcaatcaagtggaagaaagggtatcagtgatggaagatcaaatgaatgaaatgaagtgagaagtgaagtttagagaaaaagagtaaaaagaaatgaacaaagcctccaagaaatatgggactatgtgaaaagaccaaatctaagtttgattggtgtacttgaaagtgatggggagaatggtttagacatgaaatccttgcacatgcctatgtcctgaatggtattgcctaggttttcttctagggtttttatgattttaggtctaacatgattgacttggc

SEQ ID NO: 467473 - DNA, 3748 bp, Homo sapiens
gccgcagcaggcaggggcaaaagccgcgacgggtaaaaagtcgcggcggcagggggcaaaaagccgcggcggggggcaaaaagccgcgtcaacggaggacaaaaagccgcgtcggcggggggcaaaaagccacggcgggcaaaaagccgcggccgggaggggggcacaaagccgaggcggggtgggggcaaaaagacaccgtggcgggggctaaaaagccgggtgaggaaaaagccgcggcgacggggagcaaaaagccgtggcggacaaaaagccaaggcagggtgggggcaaaaagccgcagcgggtaaaaagccacggaggcaggggggaaaaagccacggcggggaaaatgccgcggcggctgtggggcaaaaagctgcggcggcaggggggcaaaaacccagggcgggcaaaaagccgaggcggggtggggggaaaaagccacggcggcggggggggcaaaaacctgcggcggcaggggcaaaatgccgcggcggcggggggcgaaaagccgcggcaggtaaaaagccgcggcggcgagggggcaaaaagccggggcaggcaaaaagctgcggcggcggaggacaaaatattcattcgatgagtccactcgatgatgattccattccacaatccattccattccattcaattcgagtctattccattccaatccattccattcgggtccaatccattcaattccactcgagtcaattccattgcactgcattccattcgaatccattccattccattcgttttgagtccattcaattcgattcgagtgcattccattccattccgttccattggagtccattccattgcattccattccattcaagtctattccattctattccattcgagtccattcctttcaattccattagagtccattctattaaattccgttgtattccattcgagtccattccattccattcccttccatttgtgtccattccattccattcgagtccattccactcgagtccattccataccattacattctgttcgactcgaatccattcaattccattccattccattcaaatccattccactccattccattcgagtgccttctactctattcctttccactcgaatcctttccattccattctagtccattccattctggtcaattcctttccattccattccattctataacagtccattccattccattctataacaatccattccattccattccattccattccattccattccattccattccagtccattgcattccattccacttgagtccattccattccattccattagagaccattccattccaatccaatctattcgagtccattccattacattcgagtccattccaatccatttcgtttgagtcccttccattcaattccattcatttccactcgagtccattcccgtccattccattccattccattctatttcattcaagtccattccattccgtacttttccattccattccagtccattccaatccattgcattccattccaatcggttccattccatttcattctatttgagtccattccattccattccactccattcgagtccattccattccattccactccattcgagtccattcaattccattccattccattccattccattccactccattcaattcctctccattccattccattccatttcattccattccattccgttccattaatttcagatccattccattccattccattcaagtccactccattccatttgattcgtgtctattccattacattgcatgccattcgagttcattcctctgcattccatttcattcgagtcttttccattgcattccattccattccactccaatctattccattccattccattccattcgagtccattccagttcattcaagtccattgcatccattccatttcattcgagtccacttcattccattaagttccattccattccattccattccattccattccattccattcctttccattcttctcgggtccattcaattcaaatgcattccattcgattccataaccttccattccattccattccgttccattcccttccattccatctgaatccattccattccattccattccatcgagtccatttcattccattactttccattcctttcgagttcattccattccattccattccattaaattcgagtcaattcaattccgttccattccattagagtccattccactccattccgttcgagtccattccattccattggagtccattccattccaatgcattcgagtccattccattccatgctattccatttaagtccattccattgcattcgaggccattccattccatgctattccatttgagtccattccattccattccatttgaatccattccattccattcgagcccaaaccattccattccattcaatttgagtccattccattccaatccataccactcgggttcactccattcaaatcctttcgagtcaataccattccattccattcgagtccattccactgcattccattccattcgagtccattccattccattctattctagtccattccattccattcgagtccattccattccattctattctagtccattccattccattccattcccttcgagtccattcaattccaatggattccattccattccgttgcattccattccatctgagtctattccattctattacattgaagtccattccattccattccattagaggccattacattaaattccattgtattccattcgagtgcattccattccattccgttccatttgtgaccattccattcgattggagtccattccgttcgagtcctttccataccattacattccttttgactcaaatccattccagtccattcgattcgagtccattccattcttttccattttgtaccattcgagtccattccattccattccagtccattccattctattccattttataccattctagtccattccattccattctattcgagtccattcaatttcgttcgagtccattccattccattccattccattccattctaatccattccattccattccattccattccattccattccattccattcgggtccattacatttcatgccattcgagtccattccattccattccactccattctggtacattccattcaattccattccattcgagtccatttctttcattccattccatccaattcgggtccattccattgcattccattcaagtgcattctattccattccactccattctagtacattccattccattcgagttatttccattccattccattctattcgagaccattccattccattagagtccattccactccattccattcgagtccattccattcaattccattccattccttcaatccattccattccattccagtccagtccattccattccattcccttcaattctattccatttatttcctttccattccattccaagctattccattccattacattacattcgagtcaattccattacattccattctatttgagtccgttccattccattccactccattccagtcctttccattccattccattccattcccttccattccattccattccattccagtccattccattccattggagtccatttcattcgtttccattc

SEQ ID NO: 467474 - DNA, 704 bp, Homo sapiens
tgaaatgctgagctatttgccttcaattcgaccaggaaaaacagaagctttattatttctttggacaccacaatggcctctcaagtttttgccctaccaggctcttcacaagatccgttgtgtctgaagaaggagcggcgactttttgtctacatttttacttggttggaacaatcttctgagatatcttcaaggactgtattagtctgtttgcatgctgctgataaaggcatacccaagactgggcaatttacaaaagatagtggtcgagtgtacttacagttccacgtggctggcttcacaatcatggtggaaggcaaggaggggcaagtcatgtcttacatggatggcagcaggcaaaaagagagcttgtgcagaggggaagagaatttatctggaggtggtaaggagaacattcagttatctgactacaccctcaaggagcacaccaaatgcatggtacttttgcaccatcataaagtggaaaaatcataaagtaaacaatagaagaataggttgtatctatggtagattgtatctgccaaaattgcacacaatcttatctcatctcacatgctcttctgtagtgtgaccttgccactctcccatgaagaagtggaatctgcttctctatcctggaatttgggtggtccttgtgacttatttgactgacaaaatataatggtaattatcctgtgccattt

SEQ ID NO: 467475 - DNA, 565 bp, Homo sapiens
acaaattgatcaccatggcaatcatcacagactctcgccctgtggaggggcaaggtaaaattcacagagccgtggaggaagcagatctgattatctcagaagggttacctccttcgagtaggctgcagctgtccattaggctgctcctacacacacgcgcggagcccgtgccaaaacgtggaacgaggcatatggttagaaaccgagtggggaaggcatgccaactgctgatgcgcccagctggctgcctctgcttcattggtccgagtgagcactctgcaaataagacctgctcagaccctggaaagggtcctgacagatatccgaagaattgcagctgggttgaaatcagtgaaccactagcaacacaaggggctcagtactgcgagatgcagaaaagggagccttatgatgctgggtaatataattctaaataccatcaagcccataaaatggggagatttacccagccaccctccttaagaaccaattttttcctcagtatcttctccctgactgtcccttaccaaccaaccccttttctaaatgacttcttgtactttta

SEQ ID NO: 467476 - DNA, 462 bp, Homo sapiens
acccgaatatttggttactatgccgttatttgcaaaagcaaaacaacacatccactttaagagacaccaagttgtagaaggaagggctttattccgctgggagcatccacaagctactgccttaaaatccgagctccccgaatgcacaacttctggaaagagacctgcagttaaatttgaaatgatggacaacttgaccccaaaaagaccttgctgtaatttgaattcctgttggctgtctgaaagcttgactgggctaaaagatgcccagatagctggtaaaacattatgtatgggtatgtttgtgagagcttttctggaagagattagcattagaatcagtagactgagtaaagaagaacaacttcaccaatatgtgtggacatcgtccagtccattgagagcccaaatagaacaaacggtggaggaagggtgaatcattctgtttaaattgggtcattc

SEQ ID NO: 467477 - DNA, 506 bp, Homo sapiens
ctttcagagaaagagaaacagaatgctctggtgtatttcaaaatggttcctttctcccttctcctgcaggaagcacaaggggatttttctagcatattcacctatgaacctggtagaactctaggagataaaacacaaaattgtgcacctcttccacaacgacttggttaccctcaagtttttctctctgagacttgtctacacaatgcttccaacagtttgttaattatagttcagcactgggtacatgtgcacaacatgcagaaccatggtgattttcatggggtccagcaatttaccccactcatcttaagacagcttctgcccttcctggaatgcagtgtggctgccgccctggttttgcatcttcaagatagaagcccagagagaggacctgtgcatgatttgattggaaattagtccatttctctttttggttctatgagcttttgttttccatggtatcaaataaacaactatttataatatttctaatacatgctgag

SEQ ID NO: 467478 - DNA, 611 bp, Homo sapiens
agagtaacttttaaatgtgtttactggttatttatccagtccagcgttgcacccctgtactactgatctgccatcccggtttaccaccagcgaaagtttctgggagcacctgtgttctgcctaaccctacggatgtggtccttactgcagccagtggcaggtgctatcttcaaaaccccatcttatctcctgctttcacagaatacttctgggatcaactgtcgcaggctctagggcagaatttagggtgcacttggaggagacccatggcagagcggggaacaatgaggaggaaccctcgctggaatccaggctttggacaggaatgtgagcagcagctgaagaagtttagtgtactgaagagtatttcctttggagaaatgctcccaaagtggtccaataagaaccactcggggccaattgtttcaactgaagattgctaagccgctcttgcagtgctcatttccatgggtttgggatgaaagcagtatttctacaggctcacagagtcctcaacagattgaatgatgctcccctgaattggtgagggtgatcttctatactcagtgtactgattcaaatgctaatctctttcagagacacctttgtgt

SEQ ID NO: 467479 - DNA, 913 bp, Homo sapiens
tattgttttggtccttttttttttgccatgaataaaaaccatgaagtgaaaaaccaagccaaaaacactgtgaaaatggagaagtgcgtccagatgaaagcctgtgctcctttatatcactggagaactcttaaaccgacaccagaaaaggacccagttggcacctgctatgtagcaattcagaacttcagcgcctatgccgagttctctccttgccggaacagtaagcaacttttattccttgaaactgacattagctcaagtgcttttctatcatcatccaagaagcagacttcccgtcatggccaagaagttcacagatcattaacacaaagccagcttgttcatgagcatatgaatggagaccttattgtgggaggacctgggagtttctactggcaagcgatggtggtactgactgtaaaagaagagaaatttgagaaatactttggaggcaaaataagcagcctaaatgatgggttggatatatgctgggaatgtgggtctgctcatggagggcctgcctcttgctttcattcagttaacgtattaatttgtttaaacacaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaaggtgagaggcactgttgagtttaaatcacttataaagcatggggaaatggtaaaatggcatataaagttttttctatcaatgtgattttatttgctataccaaagggatattaatggagtcccagagtgcctatactttgtagaaaaaatactttgatacagcattttaagtctg

SEQ ID NO: 467480 - DNA, 1393 bp, Homo sapiens
cacgcagagctaactggccctcgtcatatggtcagcttttgtggaagcatggatcatttcatattcttcctgaatgcctgtgactgggcccttagtggcttcgcagtaattacctgtataaaccgagtgttcattgctcccaggagaggtccatgcagctcagatttagaaactccagaatcggatgaagataacactagtcagtgtaggagctccatggacgaagcgttcctgtggctctggatccttactccttccagtcgaagaacgggagaattcctaaggttaaaagccatagtatcccagagggagggttctggaggaactttgagctgtctagattacccgatgaaaacttgttcttttatcaacggccacttccggagctcgcgcaggggccgctcactagaccactgctccctgcccgtgtgccccagttcagaattcacactcagcatttttgtttccatagtggtgccaccgaacatcgcagaactgaagaatttggaggtgctcaacttttttaataaccaaatcgaggagctgcccacacagatcagtagccttcagaaactcaaacacctgaaccttggtgctttcattgtatacagaggaagccaagccttttcaaaggggctaagggcctggctcctggtcacccctgaggttagcggccaagctgggaagatggttctgggtctgaaggctccttcagaccccattgttatgtaccggggagccaaggtgaaggttatggtccctgaccttacctattggggcaaggctggttataaacaggaacagaccaatgaggtcacagatatgctggcggttgtggaccaacagggggaacagcaagaccggggagcactttacattggcttctctgaggaggtgacatgtcaggtgagggcccatgacagggagtccttagctgtgtgggttcagcttcacctgaggaaggaagagcagcaggaacagggctgtggacaggagtcctcctgggatgaaggaagtgcagctagcagtgaggtgtgggcagcctgggaaggaggcacaggccagagcagctggggcttgcagactgtgggagggagctggaattttactttaggtgcaatggggatctgccgaagcattttagacagagcaggagcatcacctcattggagtttgcagacatgcaggcagttcagtggagaacactatggctgctccggaattaggcctattaagaagatgtttcagtgggaacaggtgaaggacgatggagatcacctggagatggagccctctgggatatattttgaaggtagattggagtagttgtggagtgaagagagagagagaggaatcagagatgactaaagttgtaggcttgaaacattgaggt

SEQ ID NO: 467481 - DNA, 838 bp, Homo sapiens
tatcccagcagctcaggatgcaaggtggaaactactgctgggcaagatggcaacctgtctcaggacagactcaaacaaatacctacactcactcggactgggaccatatagacaagccaatgaccccattgtgacccagagcagagaagatgagcagcaaaaccaggagcttgtgagggcagaagtcggattacagggcacacagggctgcagcttcagagaaagcatcaaggagaaaaatccctgtcctcgtgggagaaatagcagggaaatgactgtgactgcgagcggtgagagtcgcacccatcatcattgtgtccccaggaagccctgggccatagattcactctggaagaccacaagccaggaattttctgctaaaaggacatcagcagaagcaggtataattgctctctggaggaccgaaccctcaacccattttgacactcaggaaaccacaatctgagattttattttaaaaacaggttacctcactagaatggattgggtcttccatgtggcctgaactgtggtaggcctcctttggccaaaattgaccaccctagatatcctgggaaaacacagaaaccagagacaactaggctcccaactggagtggattttcttaattccttgatttctagacttgccggtggcaactgtcattttacatgatcctttctttatccttgacctttgggagtttgattattaaatgccttaaggtagtcttctttgggttaaatctgcttggtgttctataaccttcttgtacttgaatcctgatatctttttctaggtttgagaagttctctgttattgtccctttgaataaaat

SEQ ID NO: 467482 - DNA, 614 bp, Homo sapiens
gtcgtgttctaacccccctgtctcgcgtggtaccagtgcccagctgcggaccaaggctggctttcctcctcgtgtttcctttacgcgatgtcaccaatcccccgtgcttgttctacttacacccctaagccggccccccacaccctcatgccaggattccaggcccagaacctacagctgccagaacaaaatgccttcaacagcaagtgtcaattctgctgtgacctgcacttcaggctgtccagcaatgacccgctcccctccaccaccccgactcatctctcagtaattccccaaacagagcttctagtgctgatagaaggggctgtctttctctcttgtaactatagtttgcttgctttccattttgcacctttgccctcgtttccgtattctatccttggaatattctttattttaccttctgtaaaagctacgagatgcactatctactcaagatctgtctctgttaaaatcatctttcctgacagtcatattgtttagattacgggctggaaccgtgtaggctctcagtgcctaagtggctaaaaagaaaagccctggccccagaaacaccaacaagtaacttatctctcttggcttgtgtaccctaa

SEQ ID NO: 467483 - DNA, 1671 bp, Homo sapiens
gtggtagtgaatacatctcatgagatctgatggtttgataaggggttccccttttcgcttcgttctcattcactcttgtcgccattttttgttcctgctccaatatccacatgtttttatcagcacaggcacagcaaaagcctctccgtcatggacggctcctcctaactgggaaagaaacagtgagaaagcgccagtgtaacactagatatgaacaccaaggtcatgaacaccagggacgtgaacaccaagaacatgaaaaccagggtcatgaacaccagggacatgaacaccaggaacatgaacaccaaggtcatgaacaccagggacatgaacaccagcgacatgaacaccagcgtcatgaagaccagcgacatgaacaccagggacatgaacaccaggaacatgaacaccaaggtcatgaacaccaggcacatgaacaccagggtcatgaacaccagggacatgaacaccagcgacatgaacaccagggacatgaacaccagcgtcatgaagaccagcgacatgaacaccagggacatgaacaccagcgacatgaacaccagggacatgaacaccagcgacatgaacaccagggacatgaacaccagcgtcatgaacaccagcgacatgaacaccagcgtcatgaacaccagggacatgaacaccagcgtcatgaacaccagggacatgaacaccaggaacatgaacaccaaggtcatgaacacgaggcacatgaacaccagggtcatgaacaccagggacatgaacaccagcgacatgaacaccagggacatgaacaccagcgtcatgaagaccagcgacatgaacaccagggacatgaacaccagcgtcatgaacaccagcgacatgaacaccagcgtcatgaacaccagggacatgaacaccagcgtcatgaacaccagcgacatgaacaccaacgttacgaacaccagcgtcacgaacaccagcgacatgaacaccagcgtcatgaacaccagggacatgaacaccagcgttacgaacaccagcgttacaaacgccagggtcctgaacaccattgtcatgaacaacagggacacaaacaccagggtcatgaacaccagcgtcatgaacaccagcgacatgaacaccagcgacatgaacaccagcgtcatgaacaccagggacatgaacaccagcgtcatgaacaccagcgacatgaacaccagcgacatgaacaccagcgtcacgaacaccagggacatgaacaccagcgtcatgaacaccagcgacatgaacaccaacgttacgaacaccagcgtcacgaacaccagggacatgaacaccagcgttacgaacgccagggtcctgaacaccattgtcatgaacaacagggacacaaacaccagggtcatgaacaccaagtatcatgagagacctaggagggatttttaccatatatattttactttcttttatttcttagtgccaagaccccccagaagcttcctttggttattaaaaaatactctatgcctacctagaattttatattctgaataaaatactagaaaaatataacttattgcttaaaaacacagattctgaagacagatatgagttagaattgagacttgcccactttctgtagaaccttgatcaagttattgtgcatccgttggtgagttg

SEQ ID NO: 467484 - DNA, 573 bp, Homo sapiens
tgctgagagtgagcgagggctgctagcacgttgtcatctctcaccatgacgatttacaaatgccatggcaacatcaggaagttaccctatagctgtcagagaagtgagggcacagggtacactgcggcccccaaaatcggagaaagagacaggacccagagaatcacaacttacccaagccgaaatctaccagcagaagcctctgcaggaacagagccaggatgggaaaacctgagctctccctggcaccattggggtggacctgttgattgggtccacagggatgggtctggagcctatagcctggcactatggcagacttgcagtctgaatccatggcggcaggcaggcctgggtcctgagtccatggaggctggcttggtgcctgtgtctgcaggagtggtcctgggatcttggtttgtcagggctggcttattactagagtttattgaagtaggactagaccctgggtctgccagaatacacctggaccctgggtcctctagagcctgaggccccaaggactggcctggagctagacagtggaatattatgtagcactgaaaagtaatg

SEQ ID NO: 467485 - DNA, 1068 bp, Homo sapiens
tccacaaccccaatttaccctctcccagaaacttgcaattgattcaaacttcagagacttaacacaaagcatgaggggtctctcagcatcgacacttgggccagctctatattcaaacttttccttgcattggaaaacagtcatccccagtggtcagacccacatctctgggtgtcagccatcttctcctagatctaagcttggaaaacagtttccagatttccttggtaggaggactatccattttcatgctgctaatatagacatacccaagactgggcaatttgcaaaaggaaaaggtttaattgaacttacagttccacatgactgggacagcctcacaatcatggcagaaggcaaggaggagcaagtcatgtcttacatggatgacagcaggcaaagagataatgaggaagatgcaaaagcagaaacccctgataaaaccatcagatctcatgagactcattcactaccacaagaacagtatgggggaaaccaccaccatgattcaattatctcccactgggtccctcccacaacatgtcagaatgacaggagtacaattcaagaactggaagttgccctggatgagtcagtgagtgagtggtgagtgaatgggaaggcctaaggtattatatatactaccatagactttataaacactgtaaacttaggctacactcaattgctaaacattttttaaaatttgagtcatccttagttttatgttacaactcttaaaaatgaaagtgaggacactattctatttttcttaatatttattttgaaatatgcatagattcacagaagttacaaagatagtacacaggtatctgagcacaatttatcctaatttttccaatgtttctatcttacctaattaaagtacaagatctaaactaggagtttagcatctgtgcaatgtgtgcagatccttatgctgcttctatttttctatactcaaaaacctgaaaatcctttttcagagtgagacactaaaaatcgaattggaatttacttgtgatgaacctagagaggtctttgttcattttcatcaagagacatatt

SEQ ID NO: 467486 - DNA, 888 bp, Homo sapiens
cgggtctttatttagaagtttggtgatgtttttgcaaccagaaatatgctagcaaaagaaattgttgacttacccggccagcagccctgtccgggaggtggggggcagcccccgcccggccagccgccctgtccgggaggtggggggcagcccctgcccggccgccaccccgtctgggaggtggggggtgcctctgcccggccgcccggtctgggaagtggggagcccctctgcccgaccgccaccccttctgggaggtggggggcccctctgcccggcagccccgactgggaggtggggagcccctctgcctggccgccaccccgtctggggggtgtacccaacagctcattgagaacgggccgtgatgatgatggcggttttgggtgttgaagggaaggtttcagatttaaattgtaaattggggaaagcctcactgagaagctgttactggagcaaagtcctaaagcatcagagagatgacagtgtgagccttgtggacatgtcagggaggaattttctaggaagaggtagcaagaacaccagtataaaggccttggggtgggagtgtggctgtggtgtttatgacagagctggtgatacaggagctagaaagaaattatttaggcagatagtgagggtaaaagagtccttggcaaggcttcccttctaccaaaaagcagtcctccagaatcatttcttttctaataaagagcagcctgaaaaatcaagctgcatagataagcaagctggaagcttgcacaggggaatgctggcagctgtgccaatagaaaagggctacctggggcccaggcatgtctaacatggaggctccatcttcccttttgctgttgtcatgtgcacagtaaaagaatgggcagtgtgaca

SEQ ID NO: 467487 - DNA, 666 bp, Homo sapiens
gaagcaggcaccatggcacccaccagcaccctgctgcagccaataagtatggacaccaccaagctcctgctgctgctgacacatgcaaaccaggatggatcccgctgccaactcactatgaaagatttggctgatgccacccatggaagtgtagtgactggcaatctgggagcccctcagctccctcagtgcagtggattcctaaccttgaggtgccagagaacaaagtcagggctcaatacgagtccccaagaaactcaccaagtggtgctgagaaaaagtggttgtataaaattggacacaaaagaaatccttgcctggtggtgcaggcttcaagaaagggagaaaagaccacagtggaaaaagcttaagcccacagccatttctgtatctcctatgaaacaagagtcttcattcactccaaaaatggcagaaaatcctctgacttatggagcaaagatattgccagaagcctgctctcaaagaagcatacaggagtgtggagaatctgaaaggagtggggtggggtagaaaaaagaaggatgaatgttttgtaatagcagaaagattttatatctttacattctccaatgaagtcatcacaaacaacagatgactattgataatttttcaatatggctagtgtgaatgaatttttaaatttca

SEQ ID NO: 467488 - DNA, 1201 bp, Homo sapiens
gcggcattagagaactcaagctggaggccattagtgcttctgtagtttgaaagtcacatgcaatagtgcaggagtgggaaaataagtcatgctcatatgtgctacaatgctcttatagaagatcaaaccagcctcaaccttcctttaagccaaaacctaacccagagcaagactctaactctctttaattctgtgaagggtgagagaggtgagaaagctgcaggagaaaagtttgaagctagcagatgctggttcatggggtttaaggaaagaagctgtctctgtaacataaaagggcaagatgaagcagcaagtgctgatggagacgctgcagcaagctatccagaagatcaagctaagatctttgatgaaggtggctactctaaacaacagattttcaatgccaaggaggctccttcctccttcccccttgtgaagatacagctagaaattgccatctatgaaatagaaagcaggctttcaccagacaccaaatcggtgggcaccttgaatttggatgtcccagacttcagaagtgtctttgttatggagaatgcctggggcataaccacagtgattattcttctcctcttctgcaagatccatgaaataaacattcttggatctttaccattagaacctggttgggtttctcaaaataaaacctatgaaagtgtggaatcttcctatgaccttgtcctgccaggagcttctccttcttatcagttaaccgtcgccctgcagtaattcatcaaaactatcatcttagtgttcctacccattcgtgggtgcaatgaaatctgtcccaggcaacttgtgtgactgttcatttggtggatttttcggagctccgattttctttctgccatttgataaattctctgtaaaagaggtataaacattttgacagtggctctgtgccagtgactctgtgccaatgactctgtgtgtaaatctgtctattttagaagtaaagtaatagaaatgcattgttactgtgcgtgtaagctacatacagccatacctcattttattgtactttgctttgttgtgcttcatagatgttgcatgttttacaaactgaagatttgtaggaaccctgcattgagcacatctgtgagcaccatgttttcaacagcatgttttcacttcatatcgctggtcccattttggtaattcttaccatatttcaaactttttc

SEQ ID NO: 467489 - DNA, 663 bp, Homo sapiens
ggcatagaaaaaatgtatttgccaactaaatggctgtatactgcttatctgaggccaaataaactacacagcaaagatgtcagatctggcacagtagttgtgcctgaagttatcatgaagaacgaaggtttgggtcactccactaggaaaacaacaaaaaacaaaaaaaaaaacaaaaacactcgacttgctgaggtgcttgctgaaggcaaagggaatagagaacgggtagtagaagaagatgatcaagccagcggcaacgttcctttcagtcaaagtccggtccagagcaaagccctaactctcttccattctatgaaggctgagagagaagacgattgccatcagaaggtttattactcacagttcctaagaggagagaacatgccacaccatggggggccacctgggggagcaccagggtgggtcaggaggcagagggagcggggatgctgcagacaagaacctttattgtgttttcagtgggaagaatcaggaaagggtgactttgaagatgtgatcaaggttgaggaccatgaaatgagagaagtcagccaagattattcaggtgaatttaatatgactacataaatcctcaaaagtaaagaacctatactaaccgcaaagagtaagaaagatgggagcacaggtggaaggagacac

SEQ ID NO: 467490 - DNA, 1029 bp, Homo sapiens
agaaaggggctcccacagtgcagcagcgggctgaagggctcctcaagtgccaccaaagtgggagcccaggcagaggaggcgttgagagcgagcgagagctgtgaggactgccagcacgctgtcacctctcaatatgatctaagtctcggttatgtctttaaagcagcatgagaacgaactaatacactccatgatgacttgccgctgcatgcgttactcttttcacactctagggaaggtgagattccagaatggctgcaaatgtgagcatttaatcatcagcaccaagacagatatactcaccacaatggacagtagaaccagagtgccaaacaaggttttaacccacaacgaaatatggtcacagttaacagactgtggtattcccatggtgagcagtgaccttgcaatttcctaccaagtatatgcaataaatatcccaattgttcctctaaagaatcatgttgctcttgccaaggcaactttttactggagaatgaaaaaatatgcagattttcaaaaggatgttaagtatggggttctagatgacttgatatttggagatttgaaaggctactatggttcaccagctagaatgggggtaaagatcaagtgataaatacaattctggttgaggtcattttacagacttgggtgaaatgtcccaccagacggtgtgatatttagtagcccagaaagctgccaaggggttgaatgacactatctgaagatatgaaccagtttgctctccatagggaggatttcatcaacaggaaacagatgcctggaaggcattggaaaatgaatattcaaagattgctgggcttagttcaagaaataaaacagcaacatattcttatgaaaagtttacatttttttctatttcataaacttagaaagttacttaaaaatatgagaaatactgttccatttaggttggtgcaaaagtaattacagttttgccattattgtcaatgggaaaagccccaattacttttgcaccaatctaatagctaaattgtcctaaga

SEQ ID NO: 467491 - DNA, 620 bp, Homo sapiens
ctgcagccagtgggatgaagcttccagaggaaggaacaggcagcaatctttgctgttctgcagcctctgacagtgatacccaggcaaacagggtctggagtggacctccagcaaactccagcacacttgcagcagaggggcctgttagaaggaatactaacaatcagaaaggaatagtatcaacatcaacaaaaaggatgtccactcaaagaccccagccgaaggtcaccgacttcaaagaccaaagaataaccagtatagagaagaacatatatgacctgatggagctgaaaaacacagcacgagaacttcgtgaagcatacacaagtatcaatagccgaatcaatcaagtggaagaaaggatatcagagattgaagatcaactcaatgaaataaagtgagaagacaagattagagaaaaaaagagggaaaagaaatgaacaaagcctccaagaaatatggtaatatgtgaaaagaccaaatgtacattgattggtatacctgaaagtaacggggaggatggaaccaagttggaaaacagtattcaggatattatccaggagaacttctccaacctagtaaggcaggccaacattcaattcggaaatacagagaacacc

SEQ ID NO: 467492 - DNA, 1562 bp, Homo sapiens
ggccgaataggaacagctccggtctacagctcccagcgtgagcgacgcagaagatgggtgatttctgcatttccatctgaggtaccaggttcatctcactagggagtgccagacagtgggtgcaggacagtgggtgcagcgcaccatgcgcgcgctgaagcaggatgaggcattgcctcactcgggaagcgcaaggggtcagggagttccctttcctagtcaaagaaaggggtgaaagacggcacctggaaaattgggtcactcccaccctaatactgcgcttttccaaagggcttaaaaaacggcacaccaggagattatatcccacacctggctcagagggtcctatgcccacagagtctcgatgattgccagcacagcagtctgagatcaagctgcaaggcgtcagcgaggctgggggaggggcgcccaccattgcccaggcttgcttaggtaaacaaagcagccgggaagctccaactgggtgcagcccaccacaactcaagtagacctgcctgcttctgtaggctccacctctaggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccttgacccctgagcagcctaactgggaggcaccttccagtaggggcagactgacacctcacacggccgggtactcctctgagacaaaacttccagaggaacgatcagacagcagcattcgcagttcacgaaaatccgctgttctgcagccaccgctgctgatacccaggaaaacagggtctggagtggatctctagcaaactccaacagacctgcagctgagggtcctgtctgttagaaggaaaactaacaaacagaaagcacatccacaccaaaaatccatctgtacatcaccatcatcaaagaccaaaagtagataaaaccacaaagatggggaaaaaacagaacagtaaaactggaaactctaaaaagcagagcgcctctcctcctccaaagcaactcagttcctcaccagcaacggaacaaagctggacggagaatgactttgacgagttgagagaaaaaggcttcagaagatcaaactactccgagctacaggaggaaattcaaaccaaaggcaaagaagatattatccaggaaaacttccccaacctaccaaggcaggccaacattcaaattcgggaaatacagagaacaccacaaagatactcctcaagaagaacaacctcaagacacataattgtcagattcaccaaggttgaaatgaaggaaaaaatgttaagggcagccagagagaaagaactgccttacagagctcctgaaggaagcactaaacctggaaaggaacaaccggtaccagccactgcaaaaacatgccaaatttaaagaccatggatgctatgaagaaattgcatcaattaacgggcaaaataaccagctaatgtcataatgacaggatcaaattcacacata

SEQ ID NO: 467493 - DNA, 985 bp, Homo sapiens
cactacacagtgggacctctaaggattgtgggagtaaggcaggaagttgctgtctgggtctttagcccctttgaaatgaagttaacactggaaggagagaatgctctggtaaacctgaatatcaatttgcagataattgacatctctcttttactgactcaatccataaacacagaaatattcaatccagctgcagaaactaaagaggaactgaatattaatcaccaagacaatggggaaaatgtctccagggcatgtcagagacctttgtgtaagccccttccatcacaggcccagaggcctaggagaaacaagcggttttatgggccaggcccagggtccccatgctgtgtgcagcctagggacttggtgccctgtgtcccagctgctccagctgtggctgaaagaggccattgtagagctcaagccatggcttcagagggtgcaaccctcaagccttgccatcttccatgtggtattgagcctgtgagtgtacagaagtcaagaattgaggtttgggaacctccacctacatttcagaagatgtatggaaatgtctggatgcccaggcagaagtttgctataggggcagggtcctcatggagaacctctgctacggcagtgcagaagggaaatgagggttgggagtccccacacagagtccctactggggcactgcctagtggagttgtgagaagagggccactgtcctccagacgccagaatggtagatctactgacagcttgcaccatgattgatgcctggtggcttatttagttcatttggtaaggtcatgttttcctaaacgctgttgatgctagtagacgttcttcagtgtctggatattgaagagttaggtatttattttagtcttcactgtctgggcttatttttgtatctgtccttcttgggctttctggatatttgaaaagacttgagtgttgtaaaaacttgagtgtctaagctgtatctgctttagggggt

SEQ ID NO: 467494 - DNA, 566 bp, Homo sapiens
ttttctgtttttgaaatatagatcatggaaccctcagatatttctcacttttgctatctcttctttccctcttttatgatgttcagaactctctccatgggctacttgagtccagggacattatttaatcatataggcttcctttcagtctacattgacaagggactgtcctgtggagcctgcagcagcagtccacctcctgcaaagggtctgtggattctctcagctttcctggtatgttcctgtgatagctcttggagcaaaagtttaagatgtgggtctccacatgctgctctgtctgtccgagtggagggagcactgactgcctgtgagtccctgctcaggctcttccttccctacatagacatctgtggtagaactgtgatttttgctcatctctttcggactcgtactcaaaactggctggctataacaagctgatagttgtgaagatgaggatgggggtggggagaaatccagcactatcatggaaacttagagctaggaggtgatatttttcccctttcagcctttgctatctgagtgaccttttccaggtctcttaa

SEQ ID NO: 467495 - DNA, 866 bp, Homo sapiens
gtcctagcttctggtggaggccatcaatccatggtgtttggcttatagaagcatcaccccagcctctgcctctccttaaaccacaagccagaaatgtctattagttccactagatcacagattccaaccccgggacacgatctagatctcaggatagaagacatggaacatttggtgcaagtgtatgaagaatcaactaaaagccccacagctattgctagaaaactagagaacacttttgaacattctcctgaaaccagagagatgcttccccagagggatggtcatggggtcatgggtacccccaacccccaccccactggtcatcaccctcaccccagcaactcctgtgcctcttctgagtatgcactgatgcttataggaaggtgccagagccagagaggaaacaatagacattttgatgccaaccagagccctcacttgcactccttgttgctaagatgtgtgggtgtcctgtgggaattgggcaaggatggatgaaattcagggcagctgtttttcttttctctgccatgcagttcccactataaattaagcctttttcaattttcttagtcttgagtttcaatggcattagcatcttcctcctccatgttcattatcatccctgacaaacgtttccagagaaaagtgtttcactgtggttcttgcaacattttctctaaaaataccttttgaggaaactgacactccaaaaggaataaagtttcatcatgaggtttgaaaggtcatatattcaaattgttgcaaggcctttaataaatagggcaaagaaagcattcagctttcaattatttaatttatgaatagcaggcatagctggaaggtagaacacttaaaaggat

SEQ ID NO: 467496 - DNA, 663 bp, Homo sapiens
cttctgcaggatgactaactgtggatagaagaggcagctttcgactgaggttgcattgtcaaagcctggcccctcttctgcatggctgctgcagtttgctggaggtccactccagaccctgtttgcctggtatcaccagcggatgctgcagaacagcaaagattgctgcctgctcattcttctggaagcttgtcccagaggggcaccagcctcatgccagttggagctctcctgtatgaggtagatgccctgcccagtgaagaggaatctagagaggcagtctggctgcagccgctttgtcgcgctgtgttgagttctgcccggcactttgatgaaatttctgtaggaaagaaaggggagaagagtgtatcaaacaacaaaccagaatgcagagagctgcagcccagaacacacagagaatgccaatggtacttttctattctgctgacaacccctccgagtctccaactggtgatcaagataaatggaggagtgcttatgggacacctgggatatatcgtctgcaccacacacatacaaagtgactggcagcagttcaaacctgtcccctgctgaagtctaaaatctcttcttcagtgaaaatgcatgatctgcctgaagggagccagtgttctgggtgttggtgcacagggtaaagccctt

SEQ ID NO: 467497 - DNA, 702 bp, Homo sapiens
cagccatgtagatttttggcttttctcctaacaagagaaagaaattgagtgatgaggtcaaggaagttttgtttgctttttaaactgggagaaataacagcatgttgctgcatttataggaatgacccagaagaaagagggaagatgatgcaggagagagatgggaaaattcctagagggatgtggacactgaaattactgaagccaagtactaaaagggatgagcaggaaagctggtgggagagttgtaaagtgcttgaagtcacagttttagaggggatgaagttttggggcaagatcgtggcttaccacgaaagtgaataccaatgtagggaaaaggacaagatcactaaagaaaaggttagtgaacgggtagcctgcccctccacacctgtgggtatttatagtcgggtgggacgagagactgagaaaagaaataagacacagagacaaagtatagagaaacaacagtgggcccaggggaccggcgctcagcataccaaggacctgcaccggcggcaccagcctctgaagacccagcacaatttgtaattacatattttcttgtgtatttgttcatgtcttacttagaatacaaattgcatgaaaatacagaatatgtctattttttactgctgtatcccttacgtcttggaacactcaataaatattgaatgaatgaaatgtataaatcaagaacta

SEQ ID NO: 467498 - DNA, 736 bp, Homo sapiens
tttattcctgaagctgggactaatctattaggaagggacttaatgttaaggctagtccgtggtcccaccccaccaaattgtaagccattacacggtaaccccttgttgctgattataaataatccccagacaaaggcccaagaaccctctatattcgaacggtctgggttaggagcagatgctgcaggacaggaccctgtaggaatcttctcgctgaggttagttaaaccactggttaacagtaataaaggaattcagacccagagtctgggagacacgtggaacccaacgctgtccccaagtatagcgagtccaacgtcctcctcccatctccaaaatgacccaaccggttgtggaagtagaaaacttaaggcaaacaatagctctagagacaggatatcaagatgcaaatgcttggctggaatggattaaatattccatccgcactttaaacaaaagtgaatgttacgcttatgtagttctatttgtttgtttttgcattatcccctaagcacttccacaagtggggtttgccattatcttaagatgccagagcttgagactcagacataggtgttcctttggctcattccctttaacagttaattgttttaggacatctctgctagtcccgtgtattattcttgggcatagcagctgagattatgtactcgtatttaaatgttaagtgatttataatcttcaaaaggaagatggaagccttcatttcagaaat

SEQ ID NO: 467499 - DNA, 577 bp, Homo sapiens
gcataatctcacttataggtagaatctgaaatagtcgaactcatagagtcagggagtagaatggtggttgggagtgagccacaggccctcatcaccacctcacgggggatgcgactccgccggggagggtgtgagtgtagggggtcaagacagccttcccctgggctggcctgggtgcttaccgtgtccaccttttatcgtgaatgcactgagttttcatcccctcctgctcataggacttctccaaagtgggaacaacgcaaaccactcggtttctgctcaggaaactacaatcactgctgcttctccttgaggctgtacgcagggcaccttggggagagtttggcggtttgcatattctctgatcaaatttgcctggttcgttcccacatggcctgccttcagcactggcagctccctctgcatggagagttcttcacgtgtttaggtctgtctcattctgcagatttgctcaaatgtcctttcttcagataaacctttcttcttctaaatgcgaatatactttagtcatttttgtttatagtggaaactctggaaattcacaattaacaccttt

SEQ ID NO: 467500 - DNA, 670 bp, Homo sapiens
agaactaaaatggttgggagccttagacatgaggatattattgaaatccagggcatttcttctaatccctccctcccacctccacatttcacaattgccagagccacaggtccctggagcacttgattgtccccgtgtgagcagccagtaccgcgcaggagagaactttggcaggaacaccgtgcacatctgcagcacagcaggaaggttaccagcttggctgaggctggggttcagccatctagagaaatgtgaaggggaactagccttgcctcttccctcccagggcctcagagaaattgccgcagccaccccagccctcagcaactacctcactaatgagtcagcagccatcaacatggaggactgtgtggaggtggaatttgaccctggagttgattcagtggagaacattgggatccctctgaacatgaactcatcaagaagggagatgacatcatggcgcatatgcctcgcttcaagccaaagcaccactgtgggagagatgcctgagccctaaagtaagtgggtctaactgggctgtatatttatggtctcctgcaacctagcagcaaatctgacactctcagttaccagaccctcagtagttattctgaatgcatgaatgtgttgagtgtgtctctgtgggacacagaaaagaccaggcacc

SEQ ID NO: 467501 - DNA, 1364 bp, Homo sapiens
tccaggtgaagtccaggagactggagtcgaaggccgtgagtcagccatgatggcagctgaagaaattaatgactctccagtagaaattcacgattatttgtcagcatttgcgaattccattgatgctgtggatgagatgctgaagaacatgatgtctgtttctagaaatgagttgttgcagaagttggacccacttgaacaagcaaaagacactggagtcgaaggccgtgagtcagccatgatggcagctgaagaaattaatgaggactatccagtagaaattcacgattatttgtcagcatttgcgaattccattgatgctgtggatgagatgctgaagaacatgatgtctgtttctagaaatgagttgttgcagaagttggacccacttgaacaagcaaaagtggatttggtttctgcatacacattaaattcaatgttttgggtttatttggcaactcaaggagtgaatcctaaggaacatccagtaaagcaggaattggaaagaatcagagtatatatgaacagagtcaaggaaataacagacaagaaaaaggctggcaagctggacagaggtgcagcttcaagatttgtaagaaatgccctctgggaaccaaaaccgaaaaatacatccaaagagactggagtcaaaggccgtgcttcagccataagggcagctgaagaaattaatgaggactatccagtagaaattcacgattatttgtcagcatttgcgaattccattgatgctgtggatgagatgctgaagaacatgatgtctgtttctagaaatgagttgttgcagaagttggacccacttgaacaagcaaaagtggatttggtttctgcatacatattaaattcaatgttttgggcttatttggcaactcaaggagtgaatcctaaggaacattcagtaaagcaggaattggaaagaatcagagtatatatgaacagagtcaaggaaatagcagacaagaaaaaggctggcaagctggacagaggtgcagcttcaagatttgtaagaaatgccctctgggaaccaaaaccgaaaaatgcatccaaaatgcacctcggtcccacactcagtgcaagacgaagcgtcttcggaaatcagcgtttatggttgtgttttgctaccacggcacagctcagtgaagccttctgtgctttgctcaggttcaagctgtgcctctgcttgttctccaggcggctctccctggaagtcaaaatgtctatggggatcgtgggaactcctgtagctaggatcacaggggtccatggagggaatgtgatgtctgaagttccttcatcaccacctccttagatctggtccagagctttgtaaatttcctggaaaatat

SEQ ID NO: 467502 - DNA, 784 bp, Homo sapiens
acttgtaccggccaccgcagcggctgcggacctcccagtcgtcatggcgactgtgaaatgtggggtggagggcgtgcagtcaaaccatttcgcccgggcagtccctgcatgtcccccaacgtgctctccagcggcgcgcagcaccccagcctccgcgcgtccccgagcgtgcagccttcctccccaagcccgcacgtgcagttcccacattgcgcgcagctccacctacagccccccacactctcccagccccactggcgcagaacccatcaccgctcgcccttcatgcgcttcactgggcatgcagccccgggagcacgcagctccacgcagcctctccgcatgctccccagcgcctgcggcctcctcttaacaacttttgccaggaccatacatacctgcccgtgggctgagtggattggcaatgacaatgattcctccccagtaagagtgggatgttaatagtacctcctttggcttgatatgaaaattcaataagttgatatatgcagaacatcttagaacagcgactaccttagagtaaatcttcagtaagtataaactaattatactatgtttttggcactgaagccacgtcgcagggaataactagtgcaagctgactccaagcacatccaggaatgcacttactgataagatattgaggcaagctgtaccagcagctgctggggatgtgctcagtggatggtacccaagcccctgcatttatctctttgtgatagtttaagcccctgcacctggaactgtttatatttctgtaact

SEQ ID NO: 467503 - DNA, 526 bp, Homo sapiens
tcagactttatcatcacaaccaaaagtcacatgctgatgagaggctccaaacaacacctggagcccatgccccagcaacttccagatgttgagttgggacagggaacaggcttgtctgctccaaatgaataccctggccagaaagagcatattcttgatcagaaaggagggaagaagtgcgtaggcatggggaggaggggcagggaagaagtcacaggaatgcccacagcagaggtctgtggagatgctgggctatccctggtggcaacactcttggggctggcgctgggtgaggatggcctccaaagcaccctatgctgtgactccagcccccaggatcctcctcagggtacagagaaggagctcaggtgtgttgtgtgcatacatgctcatatgtgtaatgagttagtgtgcatgtacctatgtgtgtattgagcatgtgtgtaattctatgtgtttgtgggtgcacatatatgtgtatttgtgtgtgcttaggtcagggtgactaaccaggacatccagagaa

SEQ ID NO: 467504 - DNA, 617 bp, Homo sapiens
gctgagaaagcttcacgttatgcttagtgtacaggagaaatgctcatgggaatcctgtccattatcacagagcaggtcgtgaaggtgttgattgtcctgaccccacagtttctgtcccgtgacaaggaccagctgaccaaggagctgcagaagcatgtaaagtcagtgacagtctcatgcaagtccccaaggaagatggagtttgtcccggagctgccgaaaactgtcactggaaagattaaacaagagggaccaccagggggccaccagaggctcagaaaagcaggagcagaaaaggccctgccgggggatgagagaagcacatgctgtccccttctcagccacccctggaggtcagcactggagaggcctctctgtgactgccaacttccgaggtgcacaaacccagaaactcacagggagataaacagataccgcaagcacagagacacagaggcacagaaccgccccagcttcacctgggcactcaggagtatggcccacggacaggcacataaacacacacaccaggaggacacagatacacacacagaaccatgagacacagccccacagggctgactctacacacagtggacacccacgtgtgtgcacac

SEQ ID NO: 467505 - DNA, 609 bp, Homo sapiens
gccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtaccagaggaccttcgtctccctgagggagaccttggcaaggagattgagcagaagtacgactgtggagaagagatcctgatcacgctgctccctttaccctgagcaccacccaacagactggggaccagccccctcgcctgcctgtgtctctccccaaacccctttagatggggagggaagaagaggagaggggaggggacctgccccctcctcaggcatctgggaagggcctgcccccatgggctttacccttccctgc

SEQ ID NO: 467506 - DNA, 921 bp, Homo sapiens
ccttctggggacttgtgaccgcatgacattagaggcaggggcaggagtaagtcatttcttctggcttccctggcaaccacacagcctcacaggggtccaccccagggccagtgctgacggctgggccttcggaaaggctagtgtgaccaaggcaaggctgtgactcaagctacagctcaggcccctgctgcttggctgggtctagaaccttcccagctctggccctgctccctctctatgggctggcccagctgccaaagcttcccagttccaggttggagatttgcatgcagggacagacccccctgaggctgaagcagggcacacatttgctccttccccaggattgctcactcctgcagcccccccagccagggcttgcttgctggacttggtcccctggcactggaatcgtagccttggttgtgaccctgatcagggaggcaggctccagggccacagcaggccaaccctggccacttcccagtctttcccatccttcgggggggcaggccgtcagtgggacgttatattgccaggaagttcggcatctggcctatgccagtccacctgccctggggaagtgcccacccatgctgcgctttgctgtcctctcagcccctggtgcagggagggcaggagaagagccagaatgcagagctccttccctggcggagctggagacagatgggcactgggaaggtgagatactcacacaagaaagttcagagtgctgtggcgtgggtgcagctcaggcggggatgggcagcactcatgtggatgcgacgtatatggggtcctttgtgatacagcccagtggtggtaccgcggtctagggtggacagacaactgacagcaagttctgctgaattcttgggggagacagtgtctggagcagtggtctctgcaaggccacagctt

SEQ ID NO: 467507 - DNA, 4024 bp, Homo sapiens
ggctaggctaagctatgtaagatgttcagcaggttgaggattgacatcatgttttgccagaagtcaatgaaacgccctagtagaacagaacagtttaattccctcctcagatacaaggctgagaaagttcaaacaggcttccgcccgtgcctgctgtcccaatcggcctgcaagatgcccatattggaggcctgctggactgagcccttaatcaactgtccaccctcagaggatggcaggagtctcatgcttgcatttctgaattctctgggaaagccccaggcagccaccattgcagacctgctctcagtgattagggagcatacaccctctgctcacagtaacccactgactgctccccaaccctactggctgacatatcccaccctcaactactatctcttcactctgtctctttcctctttcagggtcacaacccttttcttaaagggccagacagtaactactttagaatttgcaagccacacgttctttgttgcaactactcaactctacccttttgacacaaaggcagccatagatatcacatggacagtgggcatgagctggagtttgaaaaaaatgttccctatcgattaagcacgttttgtgttaaatatatttctaggcattttatctttttaaatttttactgatgatgggatctttgattttctaattggttattgttttatataggaaagctagtgatttttatatgaattaattcttactagattcttaatgttttaacagtttttaaaaactggggtttcctcctgtgttttagaagtatacaatcagatgattaataaatgataattttgcatcctcattgcaatattgaaacttctcatttgttttctcatcttgcattggttagtaggtgggaaacaacatttaataatatttgttacaatgggtattactgccgcaataatgctgcataataatcatcaaagttcagagttcaaagcaatcatttatcctcatttaagtgtctgcaggtcgactgagggttgactgatgcaggttggcctcggctgggcttggttccaagctgcaggttgggtccaggtctgctccatgcattcctcagcaccctcggaccgtcttgcaacctctagcctctacttttcatggtaaggatggaaatgtaagagtagtaaatgggaacagaggatgcttctcaaatcttagactcaaaattggcactctcatttataccactttccaccacaatccacatggccaaattcaacatcagggggattggaggaatactctgtctttaggaagagaaactgcaaaatcacatggcaaatgacacagatacagcagggtgaagacttgcacaatgatgtaagggacaccattgggcaccctttacttgtccctgactgatgggaatgattctactgatatgtcattagaaatgatcctgggttttagcttgagttgtgatatctcaatccataagatcctattttgttaaaagttcttaaatcatgaaacaaagttggatttttgtcaacttatcttttagtatatatagagaattgtatggttttcttattgatattttaataccatgagttatattgattccttcattaaaaaaccatccttgcattatttaaataaaccccacatggtgttagcatatacccttttaaaatatatgttctgcttgctaatattttatttaaaaattttgcatttatgctgtcttaaagatcatactatagtcttttgtctcacccttttggcttttgtttttactgttttgttggattcttagatttaagttctcttctccctctctacaatattcaggagcagtttaaatagcattgagttatctgcttcttgaaattctgatggatttttacctgtaaagctttctacaagtagtgctttaatggatagtggctttttgacaacactctcaatttcttctctggtaattggactctttagatttcctatcttttctaaggctagttttcaccatttatgttttttcttgaaaatcacccattttgtccatgtgttcaaatttattttcaaagcattgagctcagtaatctattacaattcttttaatttcctctatacggggtaatttccccattctcatttctagttatgcatatttgtgcttattttcttgattagtttagctagtggtttttctattttccaaacccattctctgcttctcagaaacttgctccatgctttatcctctctgtgtcctgttcttttcaagtgtttccccttcatctttcctaatagctcataatcattctccagcttcttctatctcaaaggcctccaagtccaagttgccccctctagcagatgactgatagctttattttccaaggcttcctgggagtgctttcctgatgtccataccgtagagtatttcctgagtgttttccagagtaatttcatagaattactcctcaatgacaacatctacttttgtcttcatgactccaattaaactgctctagttgaggtcatctgtgatcttcctcacagccaaagtcatgggcattcacatctagttacttttcctgattttctgtgacatttgccaatactgactattctctccttcttgaaattcactctgccttgtttcctgattttccctactgggccacagatgatttattaaaaggttgcctggaccagagtccttaagggaattaagaagttggggagtaatgaccacatcaagtgttgtcagagcataattactgaaaagcatttttgactgaattttagatgagcattttgacaaaatataatattggaaacaatctttatcaaacattcatgtgtagtgtgagagataaagcccggaatccataattcatacggcgtgtgtattaccaagtgtgcatgagaggctgaatttcaatgaggctgcctgaacaatattttctgccagacgtgggctttcatcatttacattattcactaggttttccagaacagtaaatcttaaatatatatttgtgttgggaagagcttgtgtgcatgtctgtatacacacagagggacgcacacccgtttgggcacagaattggcggatacatgttccagctggaggggcaggcagtgacagcagggagcctcagcgtggcggatgcccagggctccttctggaggacggcccacgtcaccacggactccacagctcactgcacaggcattaaatccgcccaccctgtggtctccatcttcagacccacccagcacctcaagtggagtcctaaaataaaataggaccgagtgcgggcattgctccggatgctgaagagcagagctcctccaagttcaccctctgcaccgttcaggcggtcattgtaccgagtctccaagggctaacgttggaagggacgcttataaagattgttgaattttgtctcattgtgatatgagttggacagctcgtggaatagcctctgcttgtatacagtagagacaggagcacagggcctccggcattttccccactccatctctggagggtcacactgctcagaggtcttccttggaggtgagattgagcttcttctcatgatcactcactgttgctgtgccggtccgtgaggtcccgcagcacaagtctgcttcctggagcacaggcccatccttcagatctccgagtgtggcatcgcattgtgggatcatccttttccaggcctttgttccttcagcctttcctcacatcgcttttgtagtggatgctggggtgcactgcccagataccctctggggaccgaggagctcattctgctgcccagagtgtgggccgctgctggcttgaggctgagtccctcctcaggagttcccctgagcagggggcactggctcccccaaggtcttgcccctccccacatgtaggggaggaggacacagcccaattgaatgactggtagacacattctctgaaaagtcattcccagctctagagcccctggggcttggctgaggcctgtgctgc

SEQ ID NO: 467508 - DNA, 819 bp, Homo sapiens
agtctccgagcagcaggaaggcttgaaactcctctcttattctggcacatcctctgccgcatccctgaaacttggccatcggcactggtgctgccttccggggctgtgcagagccagtctgccatttgtcagagattggagagcaatgttatgtccccaagtcttctcttttgcagaggtcaaggtgtctgagatgcaggactgccaggtgggagtagcctgggtccccaagtcaccacttgtggaaggaccatgcacaaccactgccaggccttcctcacacaatgacaggagccaggtgcagctctgttgggttacaccgctgagatttgggggtttctcgatggcattgtctaccctctccttagggcccaggcctcatccttgtctgttattttttaactcacaaattcttaaagaagatacagaccccggagacataggcttcaaaggtgcttgtcacttgctgtcgggacttgccctcacctctcctgggcttgctcagccacagtggcctctaatgggcagagtcaagggtgcttctcggcttgcggtccctctggttcttcctgagctttaggactccatagccttagtttcttgaactctgtcctcttctaatcctcttctctttcctctggatcacattctcctatagccttacccatcgaaaggcatggacttagggtcaggcatccctgatctctcctgaacaaattgtacaatcctttaactgaggcatgggctgtccatctcctcagggcaccaagagctggggctcagggctattgccaagggtaacgagatcattctcatacc

SEQ ID NO: 467509 - DNA, 584 bp, Homo sapiens
catgtggctggcagggccagcttcgggccctacgcccatctgacttcaaagctagggctttgcccagagcctcacacacctcccgatgacctggcagggctctcacaggccgctggctgacaccaacaccatgcggcagtgcaggcccaagcagcagcacccagggacactcaggacagggcttcctgagttatttctgtcttggggaccctccttggaggacaaacctttggtggcccaaccctgctacgaagtggaccatgggcagtgtctacagcacctaaaagcccctggcagtgggcagggtgtgccgataattgatcagaaagagcagggacccagagaggagccccagttggcagagctactgccttgcatcagggacttgcctctgatcttggatcacgtgcacaaaggttctgcgggcgctggcagccacgtttgccagacccttaaacctgcctcctccattctgcctctcgggcctcgggcctctctcctgaacagggctggggtgacctggtccagccccagcattcaggtgcaggaaggccagatacctgccacatgcagcgagtgaggcc

SEQ ID NO: 467510 - DNA, 629 bp, Homo sapiens
cctcctgaggcttttccatgctccgcccctgcccccttcccacccatgaatcctgatagcatgttcttcgtgctttccttacacctctcatttacctgctcttccctgctgctgaactctggctggagtgctggggcctcccatgccaagcctggcactgacagcaggcgccatggagggcagacgactagctgggggatgaaaacctccattcacgacaatatcaaatccctggctccagagagggagacaggtttgctcccagttggagacatcgcggtgtatcctgtaaagcgggtacaaaggaatcatagactatcagtggtgagggccttgagcaattttttcattctgttttcaacttttgagggtaacccccgtaaagaagaggaaagggaagcacaaaaactggccaaggtcacatctctagaaggcttctgattgtctgcaaagaagtcacaaagaaatgagtcgaggtgagggccagggcaatagaggggcaggtttggaagccatttgtacattatgagacctgaatagaagttttggagtcaaaataaataagtaagcagctgatttccctggaggagactcaagccaccttttattatttcattggctcaggagcc

SEQ ID NO: 467511 - DNA, 5026 bp, Homo sapiens
gtgggtcccatcacccagtgttccaacagagccctgagttcacagagctgggaatgccagagatgagtggtcagacagaagtatgaggagcagtctggcagacagacggccctcacagcagaggagctcacagcctgcagagccatgaggattggagccagggtcctccatgagggccaggtcagcctcccatcccacatccagcctacagaggtggagccagcccacatcctaatggggctggaggacgcaggcctgctgaaagcaggaaacaacaaacccattgcaaagaagagcccacatctgctcctttggcgcaagaagctcagccttctaacagggtcccctcctcagcaatgtcccaggctcaccctgcgtgagcagcttaagcagcttacagctaatcctgtgccggctctcaggcaccttcccaaacaccgtggtggccagcaccaggtgggcagagctaggcttctgcacgaggactctaacatctttctcagaccttctcggggccaccattggcctctgtacagccccgagcctgctgcatcaggccccagagcattctcaacccctttccagcaagctggagtgcagggctggcaacattctccccaagatggcctccctggctctcaggcccaaattgattaatcatcacttgattccagctatcagctctgctgcaattggcatatttatttctaatcagctcttaaaaatggcatcattcaaaagtgcttaaccacattacttaattctcagcctgtattgctattgatttcaaatattctcctcaagatatggctcatcattcaatgcagaagtctgtttatataataatcttatctggttactaaaatctgtgaaatctcttcaattgcttctaatgcaagatcggaggctggttgctaaatgagtcaattttactttaatttggtttatttacagtacatgttttaatgttccgcattcccgtctttcgcagcaatgctgagaataaaggcaaacaggatgtgagaggagcgggaaccccagggtactgtctgcatctccccttcaccaaggcagatctaagcagcccccctgcatgcaggagaggctcagcctgccccctgatgctgcagctctctcttggtcagataacctcctctagctcatttgagaattttcatgctctcagtttgaaagttaagagtgactgcatgtgacccacttgcctgcaaggggagcctcttcccgtcactgtgcaggctccaccccagcccctttctcgtcccctccccacccaagccttgaaggaggagggaggaggactgtgtcttgttccctacacaatttacaacagcatcatcacattccgcagtgaataaaggatgcgcagtgggacctgctattcccttccagtttcttctcatccttcagttattggtgaaacccttagcccagtgtggctaaagaaactcttccccttcccccttcccccttcctccttccccctttcctcttcccccttccctattccccctcccctcccttcccttcccctccccttcctttcctttcccttcccttctctctccatcatttcctccctccctatttcctttcttccttctctccctccttccttcctcccatcttccttccccctccttcatccctccctcattccttcctttcatccctcctttcctgcttccttccctccttttcctgtctcctcctccctccctttccttccttccttcctccctttccttccttccttccttccttccttcctccctccctccctccctccttccttccttccttccttccttccttccttctttccttacttcatccctcactcccttccaccttccctctttccctccttcctatggggcttcttagatgctgtatcctagggaagatactgaggatgcaaaacgaggtccaggaaggaagccaactagaattcagatcattacccaaccacatgagggctcctaggcattaagggagctcagaaaaggggcctcaccccacaccgggacatgagggtcagttctgcagggaggcgatgccaggctcctccttcctgctggctgagcacctgtcatgttccagatgccatgctggggccctggcatggagtggtgagggcaggtcagacccctccctgcagggacctttctgcctgggggcttgcctggatctgcttggtcccagttggctgtctccactcacattgtacaggctcttggagcctcccctctgggcccctggcctctcttacccttcctggtctgggctgggccatctcatcttcttcagtggtcttctttactaatgggagaaggcactcattgtctgttcctatcattgctcagaattcagagtgaagagttcagtcttcaccttccgcatttcttgtgttctgctgagagtgtggagccaagaaggactgtgagcctgcccctgcacgtgccttgcagagggtctgtcctcagtgacccactgccaagacagccctgcagggatcctctctgttcctctcagagccacctctgtgtcctgccatatttcaagggcagttggggacccactttgaagaggaagagtaacttctgggttgagtccaagggaaacattttctccactgtacagaggtcttccctgcagctgtccctgtgcacacctttgttaaagtgccctgaactgggtggcactggggttctaaatcatatgagctcagctgagctcagcatgccattagtgcaacacagaagggaaatcaacgaacctactattcaaataaaattcaggtgtggggtggtttaaataatacaagcaacatggccactgttcttagcataggtatttgatcttttaaaataagaccttattattcgaaaccaaatttcaatgaaaaaaaacctgaaaaattaccaatttcgtgattatcagcttccatgttgttcaaatagaaagacaggatcaaaattaaaacttgggtttcagaccccaagaggcagtgtctggtatgtgaagggccaatattatccactgtgaatttgttgtgtgaccctgagcaagtcagcccaccttctgccccagtctccttgtgtacaaaataggggtgatgtcacctgcattgtgaggtgtggcaaaggaagtaagaaaagtgagggagtgtggtttttacatggtgtcatttgatcccttgtttgtttgttttctttatttttagcctttttcgaaccactcagtattggagactccaatgaaagtgaatgttgcccagatatgaggggtcacttccttttgcctctaactcatagggagacccaattttgaagaactgagaaatgatgacccctataaggagttcaaagggaagcagaggaagtttctatacttcaggctcaagatttcgacgcctcctacattcaaggctaagtgcaatttttgagggtcccagagcgtgttccctggtttagaattaaagaaacaataggtaggtttgccttcaaaagccaaccctggcttctgtagcctcctcactccatccggagccattgctttgaattatacatgaggcacttgtgggagctgtgatgctttttcaaatatttctctaattgatgagtgggcctttgataaattgctgtagaaccaagagcatctgatcacaagaaattctgtcttgttcctccttgacagatgtttgtttgacttaaagggggtgcaagatccaaggaactacttctccctcctggaactttcattgtaaacagaaaattctatggttttgtttttaaagccaaacaaagacagttctctgagatctgaagtctggtgcctgccctcattcagatgaagaacttggggacagagagctgaagtgcaaggtcttatccaccctgaattcttgctttatcccccatgtcttcctccctgctgcttaagggtactttctaaacctcagctccatggagagagacaaaatatttaataaccaggatatccaggcaccaactagccagaacatcagaacgaacaccagccacaggccaacaccagggcttgctgggtcaggcactaacctttacttgctgggaccccaggtcggggaaccacagtgctgaaatgtgtgaggaagatgggcagtgactcagaggcgcttgaacagtgtctttttcctaattggtatggaaatatttcaatattttcaaaattagtatgcctatcccagtatagtttttgatgaactccctactgtcctcccatcccccaaagaatacatccaaatatgtacatgacatttaaaatcctccaactccctccaaactgtctctcccacgtcttctccctcagtttcttcccatgcccatacccctgagttcagccacataggtctcctattcattatctgtacaagtcagaagcttccatgaagtcttgcctgaccccactctaattttggcccctgcctccagcacttcatcaccacttccttcatattgtcacaacattgtcacaaatgtttaatctagtgtttaatatatttcattgtgatttttctaatctgtgttagataataacctatgtaggacactggcctaataaattagatttattgggctctcattcccacctgttactgcaggaccatcaggccaccttccctccaatacttccctagtaatttctgaagtcatcagagtatagctcatgtgcagtcaccaaaaacatttattggagaggaatctcctttctctgacccctgcttccatgcagagggacctccgctagcataataagcttatcatctcttcatcttatgagtgagtgagaaggaactgggcatgcagggaatctccttttacttcccttttcttctgctgccttgacatctgctatatacagagagcacattttctcctccaagcaacatgacctgcagaggctggcttgtataaggaggactgtatttttcaggactgctatgattaggtgaataagcacaatt

SEQ ID NO: 467512 - DNA, 1319 bp, Homo sapiens
gggtatgatgatatcaagggtgaatggcccttccccaggaccacctccatgggagccacttcctccatcgcgtctaacctctgttatctttgcacacatgagaacagaattgcacccccaggaaggaacagccgggagattcaaatccagatcttgtcatccaaggtctggttccaagtctgcccctcagaacctgagcctcctggttgctcctccaaattatctcatcacagcgaattccacctgttcaattccacctgttctgaggaaatacccaggcaaaagggacagcagtgtcattagcagaaataagcaacagtggatgtggttgagcttggcccgttcttctgaaggcactggaaacagtggctgtgctgagaggcttccgtggagcttctgggacaaggattcctgtggaaagggacaagatgggaaggactggcaaaagatagaactaatgcagctgtcacagactggcggagacgactgctggttttgtttgtgtgtgtgcgcgctcatgcataacaacacctcagtcaacgacggaccacatacacaactgtttccataagattacaatgcagctggaaaacttctatggtctagggacatcctagccattgtaacatcatagcacaaggcattactcaggtgtttgtgctgatgctgatgtaaacaaacctagtgctctgccagtcatatcagagtacagatcatacagttatgtacagtacataatacttcatagtgataataagtgactacgttactggtttatgtatttactatactatacttttaattattttagattatatatatatattttatatatatatatatatatgcaagttaactgtgaaagagcctcaggcatgtccttcaggtattctgaatgaaagtattgctatcataaaagatgacagctccatgagtattactgccctgaaacccttccagtgggacaagacgtggcagtggaagacagtgacatggatgatcctgaccctctgtagacctaggctaatgtgtgtatttgtgtcttagttgttaacaaaaacttttaaaaagtaaaaaaccaataataataaaatttttttaaattaaaaaagcttatagagtaaggatataaagaaagaatacttttgtacagctgaacaatgtttgagttttgagctaagtgttattacagaagagtcaaaaagttttgaaaaggttatatagtaaaaaagttacaataagctaaggttaatttattattacagaaagaaaattttaaaataaattaaaataaatgtatttaaataaatttttaaaaa

SEQ ID NO: 467513 - DNA, 876 bp, Homo sapiens
aggtgtccggctggggtataaggtcagcgtccttttgctcctattttatggagaccacagtcataaatttagggatgcagggctgggagatgcagtgtgggaacagttcccgtgaagacaactctgagatctgggtggacccaggatcctttgtgtggtcagggttctgcagctctaaagaatgcttaggagagagagatgccggaaacgacaggctctgtgtacccctgtggaccagccagattcttgagcagattttcctgatctgtttaccaggaaaatggtatacccagcagtttcggcaattccagagtccttggtggcctggcagtaatggtgtctctccagtcacccagatgtccctatacagctctctacatcagggtttggccatgggccaaatccagccaccacctgtttttgtaaataaaagtgtattggcacaaacctgcatatttgtttatgtaatgtctagggctccttttgtgctacagcggcactgttgagtagttgtaagagagtctgaatggcctgcaaagcctaaaatgcttactatctggtcctttacagaaaaagtttgccaactcctgctctagattgatggttacaaagtctgacagaggatacagttacagggacatggcaaagccagaaaaacgaggaccgggagtccagctttcaacaaagccaatctattcaatctccagactaccctttgtaccaaggttagatccatccttcctttcccattaaaatatcttaacttttatgaaataaacgggatagtagacttgtagttttatttttaatgtccttactccaccagttaaaaagttggccactctatgtagagccccaaaataatttgaaaatgtt

SEQ ID NO: 467514 - DNA, 757 bp, Homo sapiens
agctgagaacaattgcccactctgaacctgaaagccggtggaggcccgctctaatgagtgtgcagctttcgctgccctcagaaatcaggcgctggctctgggcactcggcagccagatgattgaaagcccaattagagttaattcactttacgttatatatgggaggcacataatcttttcaaggcaaagtgcttttaaatgccttcacctggccctggtgatcccatcagtgatgcataaattgcatctggtcagtgattaccccatgctgcactggggcatctgtgcagtgaggggtccctggctgctaagggctccctgtcccattggatcctcactacaaccctgccaggtggctgggctgtgtgtcaccaagcacatgggcaacacagcttactgtaagggaaatgagggccaaatgggtcagtcatcgagaagcctctgcaggtggggctgtggcaatatccataccgagtctaattaaagggaagcaaaatcttccatgcggatatgactaacaaaaatgtcggccaccagtgttttacaaggcggaagcttagattattcattttagatcttttttcttttctaatatatgcatttaatgccgtttatttccctctaagcactgatttcactgcattccacaaattttgtttatctgtgtgtctctgtgtgtgtgtgtggggggggtgccaaccccctgtgcagtaaaaaatgtgcatataatttttactcccacactacttaactcct

SEQ ID NO: 467515 - DNA, 2070 bp, Homo sapiens
tccagttcttagaggaaaagctttcagcttttccccatttagtatgttaggttagggtttgtcatgtgtggccttttttatgttgagctcagagtgtgtcccgccatggtgcggcaactcgcatttcatcagcagccaggacacagagatcacaagagagggctgtgcattggaaagttgatattcctgtgtatcttggaggaggaaaggatggaccctgtgaactggcaaagactagttggagacataatcacagacaccttcagttgggctcatttaattgccacggatagagacctgctcaagcacctggagaatacaaggctatcatggggttccagatgcaggacttgcaccctagtggggcctcacaggattgagcccagtgaggaattacagtgctgtgtggagcagcttctttctgttcagaggaaccaaagatggataccacatgtggctttggggaggactagtgtaaagtctaccaatgtccaaggcatggccttggtagaaagaggaccactactgctactcactgaccaagtagtcctctggagtggaccaggatcttctagccttcaaaaaccctttataacccccaaacagcaccttcatcctgtcatccaggctcaaggagaaaccacagagcttgcaggaagaagaggccatgtgagtagagagtgagaactcggctgcctatgagcccatacgaagaagcctcaggatgaaagctacctgaccaacaccttgattttggactcttctagaacatgggaaataaatttttgttgttttataagctacccagtctgtagtatttttttaatggcagcttgagctgactaatacaggaactaccattcaacccactatggagtgggccagtggtggtggaggtcaggggcagccaatgctcctcttctcttccccatgggagcctttgagagcctttctgactttccagcatggacgccacttccccaggaggcattgagttcttatgcgggcgttcaatgggctccacagatctgggacaatgtggtggggtccccttgaattctgtgattgcatggtagcccctgaccatgccccttacgttttgtccactggcagcaagcttaaaccaactggcagtggaactgaaggcaagtgtctaacatttatggaggatgacaccttctatgggagcctgactcgtgacctctgtgggtatttttggcccagagaaagggctggtctgagctgtggctatcagtctaatagtattagagggtcactacagagaaggcagttataaatcacccagagtgggctgggaagtgagtggaacctttctgcctcttttggaagactcaacctggggaaaacatttcatgtcaagggtgggagggggaggtttcttagatccctgggctcggccaaatgtgaagtcagcactcccctcccaacctccccgcaatccagccttcctcctgtcctcccctggcttctataattccgtttgttgtgctcgcaaacaccgtgttggaagatttcatgctaatgaaagggtttcttgattaggttacgctgttactgtaaatgttccctcattatctatgttatggtaggaatttgaaaaagtataaattgagcgtcttgcataatttataaaacctgaatgtttcctaattagttcggttaggttaatgatggtgcagcgtcacttcttcctggtcccgttaatgacctttccactcttcattttgaacactttctgttatttacaagccccctcccaacccaaatccaacaaccagcttccggagtgtggccccatctagcctctgatgggaggatgaaatgccttgcagaatgtgaatggctccttttttctctgcatgtcccccgcccagctttgaggccaagaggcagcctgtttaaaggttggccagcccaaatttggctcaggccaatcccctgaagaatgccggtgaagtgcattctttcggcatttgtatagagattggtgctgtcccccattagcagccagagatgtgaaaatgccggaggaggtgggggagggaaaaa

SEQ ID NO: 467516 - DNA, 812 bp, Homo sapiens
gtgcaggtgcaggatagtgtaggaatggaagacttgaagttcaaggtgttggggaaagagaccaggtcgccaatagccagccctggattccgtgctagcttgtttgatcctagagcctttggagaatggcataattccaaccgtgggccactcctgcagcaagctaggaagaaattccagggaggagatgtaagactgggtagtcacctaggggacttctcagtcaatggtgtggagatcagcccatggcggtggagtctcagagagaaagcggaagagagctgcactggaggagcccaccaaggaaaacatctcaagaaggaggtaggatcctggcctgaatgctgcaaagacattaagaatttagatgaggatttggagacgtgcagtcgatgtgttcatcgggtccatggtgacctcggtgagagtgcgttcaattcaattgagtatgtgactgtgtaagcccgaatgcaatgtttaggagagaacgaaatgtgcagaattggatatggtaaacactttcagaaagcttggtcatgaaaggaagatgagaaggtggaagctgatgggagacagggcagcttgtgggtgtctctttcttctcctcctcctcctctttttcctacttctactccctctcttccttcttctcctcctctgcctcctctttcttctccttttcctccttctctttctccttctcctcttctcttgctcctttccttctgatttttcccttcttttctttttcctcctccttttcctcctttcccctctcctccttctttgtccccatcttctttcccttcctc

SEQ ID NO: 467517 - DNA, 972 bp, Homo sapiens
ctggcattttcttgcgacttgaactccgcaccgtgtccctgtcaccagcagccatcccacagggccacgggacaccaggacctcttcctcccagccagaagcaatggtgtgtcctctaacgaagctctccctgcgaagcagcagttcctgggatgaaaggagctcacgccggaggaggacgttgatctgaaggccgcaggtatttctgggctgctggactcagtctgagcaggtggggtgtctccatagagcttcagagagccacctgcagctcccagcacacggcagcattgcagcatggggcactcatgcatacgctttgttctgatcccacctcctactcctggctctacaggattcctgctgccatccccaacagcctgccttcgcgttccctggtactggatacggggagctgggagcctcaggcatgagaagcccttgccgtcggggcgggtctgtcccgggaaggcaggggcccccggcaaggcgcagtctggagatgtccgtgaaaagaggcagtttccgtgggaacagggtggtcaggagcccaaggaagcctcagcatgccctgagctggggacagaggaaagagtggtggacgcggggctagggaccttggaccttgagctggccatgcacagacccagcaccggctaccccgccatgtgcatggatcactgctacaaccacggctcctgcagaggcagataaatccttggccaaactctttcccctttcctccaccttatttctagaaggagtggcccacactggccattcacaaggaaggcagagccgctgggcttccatggttttgtgtttctgaccaaaaccgtgaatccgtgatctgagttgggttttgtgtttctgcccataactgtgaatctgtgatctgagttgggttttgtttgagccactggcttcagggggacattttcgcacctggagagtttcatgagcagaagtttt

SEQ ID NO: 467518 - DNA, 633 bp, Homo sapiens
tgggtcagtgtgcaccatctcaggctcttctgcacgcccatgtgggtggggtcggggttgggtgtctcggccaggtggaggctgggccaggccccaaagctgtgggcggcagatgctgcatccacctcctctggcttggatctagaagcttcctcctctctcttcctcttgcctgaattgacacaggagatgaagcctggggaaaatggaccagaactcagaccccaacccccaacctacaatgacattcaaggatgtccctttggccaaacccagcagaagccagaggggaaggagactcacagatgtagccccgcagggacacctaagctagcggggctgccagccacatcaccaaagcactctctacttgaaagcatgcagcagatgaaggtgtgcgcaggtgcagggcagcatgagaagggacccaacgtgacaaacttcattgaaaacaccatggcctctgacttccgtggtggaaaggaatcattcccatgactcttgttgaaacctcaaaaagcatttgaagatgcccattcgccttctggaagccctgggttgggggccaggtctgtgtccaggcctgaaggctgaccactctgtcacatttttttcctgtaggaaggggtgacc

SEQ ID NO: 467519 - DNA, 4647 bp, Homo sapiens
ctcgcccaagctacaggagaattccaaagtgattctgagtgccatgagctaggagtgtattagagcccaatggagtaggtcgaacgttagatgagagctggacagaagcagcgtttccaggccagcagcgagctgtgggccgtgtcatgcaggctggtgtgccatggaccgtgtcgtgcaggctgctgtgtcgtggaccgcgtcttgcaggctgctgtgccgtgggctgcgtcgtgcaggatgctgtgccgtgggccgtatcgtgcaggctggtgtgccgtgggctgtgtcatgcaggctgctgtgttgtgggccgtgctgtccagcacatcctttggtggttctcttgtgagggtgagtggtggaactgtcttctttatgctccctatgctgcagtgggtaggaggaaagttccatggtgaccgttgctacttcgatggggtctgcagcctgtccagctgctgtcccatcacaggccctgcttggctctttggtggcagagctgatgccatctgtctatgttcccttgacttcttttctatgctcctgctctcaagctcccggcaggcaggaactgaacctccttgctggatggctgctgtcaggttgcaggagcccgctctgcagcacacagatgtccacaaaggcctgagaaggcatgtgctgcaggggcagccccagttaggaccgcccagaggtgtcacccgcactgtcttcagaaccatgcgatttgtccacatcacactcctgcacagcctctgtcccctcctggaccagcatttaattctctcggggcctgctcctgcggaatccaacctcagcccacagctgtaaaatatttcgtgtacagctaaccctcggtttcactccttgtgtttacctttaaatttattttttatgtaacctgctttcaacttagacttgcattccttcagtttttgaaaaatattgccactatctgttcagatgctgagttttcataattctcttcttctggaactcctagtaggtgaacactggatcatttcgatctctcttccaagtttctttcacacttctaattttacggtttttctgtaccgtgttgtgaacgaattcctcatcaacattttccaattcacaaactctcctctcaactctttccagtctgggatatatcatattggttggattatttctttatttcaggaactgcattttgcaatctccgagatttgtggttggatttttttttttcacatttacctcttcttgttttatttctgcctgttctgtttcaaaattcctcactgggccttgacttatttctttgacatttacttacacttcagtacaagccctttgatgccagggctagggtctgcacgagacttccccagtggtcatcgccagcagctccgtgtcggactctgctgactgggggcactggggagagcaggggcagcaagagaagtgaggggctccctgctgtcattccgcagcagctgggatgccgagcacttcctattcatcatgatatctactgcctttcatttactctaaaattccattgcttatatgatgcaccagccatttgtgtgctctttagaaagaaacaatgctgccgattaaacaaggtcatgttgtttatggaaagatatgtccagacttcagagatgttgaaatatgaaaagctatggctaagatggtggggttttaaagtgtttgttagacagttttctaacatttatgttcagactgatggttttgtgtgctgtcttcttctttttgaagagagcctcatcctgcccctgtttgctatgtgtgcactcctgccagcccccgggatgagttccctttcctcttctttgcaccctgagggggcagggctgccacagccattctgaggaagaggtttctgttgttcagagatgcagcctcactcaccaagagtcacatgggagtaaaaatgcttttggttctccgcaagtgttctttttctttttccacttctttctctctactcgtttggatggtagacattaaacacctattcttagcagatgtcctagatattttaacatatatataattcatctagtcccggagtgccaatgctttcattctcctttttgaacaaccgtagatctttcagtgctgaaattctgatcgtctatttctgaacctcttgcatctttgtccgggattctttccccaccgactcccgcagagcaggccttgtttgtaatgagtcaatgtttgtttcaatgccatgagttcccaccatcttcactcttcttgcatcacggaccttccgtctgaggtccttcccttctgcccaaactgcattctttagaatttcctttgcctggggtctcttggtgtgtggtaggctgcaaaactgcccatacattctttccctaccaagcctgcttctccaccccttggagctggcttggaaaggggatactggcagatgtgtgtgaggtgcttgcctgtggcggtggaggggggcttgctctcctcctgctttggaccctgggccaccttgtgcatgaacctgaacaggagcgttcaggtcccaggcagcagcgggtgtggaaagggggccatcctgggtcacccagcagctgaccagatgccagctgaccgcaggaacaggggagagcaaaagtcagcttggcccctccatccgcagcccagcgaactctcaggagcaggtgcaggggagagcagaagtcagcttggcccctctgtccacagcccagtgaactctcaggagcatgagggtttacaccgtgaagctctggggtggtttgtgctgtagcaaagctaatttgcatggtgacaaacttagtgctatcttcctgaaatatctttgtttcatcttcattctagagacttctagcattggtgtagaattctaggttgaaaactatttgtcttggaactttgaagatgttcaactgtcttaacttgcattttgctattgagaagtcagcagttaatctgtttttcttttgtacgcaacagtccctcccccgccacccccagctatttctagatgcttttaagattgttttcattgtctttgatgttttttagtttcaaataatgcattttggtgtggattttataatattcatcctgcttgaaagttgagggggcggattttaggatctgaggtttagtgtctttttgtttttcgaacattattagctgttatctctttaaatactgcctccttctcatttttctctctactcccttttgaaattcaaatagattaatgtgagacctaattcatcttatcttccatgtcttaatgttttccatcactttcatactttccatctctttgtctctggactgcatccctgataacatcttctgacacatcttaccaagtttctctcaaactccagctagtctgctgcttttcactcatattttaccagaagttttatttttcaaatatcttgtttcttactaatacatttaatcttccttttgaaacttccttccaatttttaaaacatgttaaaatgttaatattatattaatgttatatgtctggtgtttccaatatctatggtcttactgaatctatttttgcttttctgtttttcccactcacttacactcatggcacctttgttccttgtgtatgttgtgtggggaactcatcttcctttgaattgggagttctttgagacctgggttgaagttgagaggactttttctccatttctccctccttttccctcccctcccatcccctcccctcccctcccctttcctttcctcccctcccctccccttctctccccttcccttccctttccttcctccttctttccatttcttcttattcctcttcctccttcttcttcctttctctctctttcaacttttgaggttacttgggccatctatatctggaactactttaaagtttatcctgaggttttcggggtcacacagggtagcctcattgatcacaaacctgtttgaggacccatttgctgttacgactacaagatgagattacgtttttccctttacataattccagggttgagacaggtaaattttctttctgcccccttctgagtgatcggtttatttgttgttcactcttacactgggcatagcccacagatggtcccagattcatctaggggtctcctgtgtttccctgctgtgggtgagtgctgggccccatcttcttctccccacagtgctcgggggctctgaggtgtggcgtgtacctgtggggtaagtgctgttggctgggtgcacccccaggctctgctttcacctccctttcagggcctgtccaggcattgccactgtgctggcccatggatttgaaataggttcaaaatatctcaccttttctctgtttcggtgtttctctgttcggtgtttctctgtttcggtgtttctctgtttggtgtttctctgtttcggtgtttctctgtttcagtgtttcagtgttttggtgtttctctgttcgatgtttctctgtttcggtgtttcagtgttttggtgtttctctgtttggtgttttggtgtttcagtgtttctctgtttcggtgtttcagtgtttcggtgtttctctgttcagtgttttggtgtttcagtgcttcagtgcttctctgtttc

SEQ ID NO: 467520 - DNA, 683 bp, Homo sapiens
gatcattggtgattctccttcactgtggtggctttcagtctttggggagggtccatgatgccagaaaagggcgagaaaattttcaaagaagttttatcccaaagtgcactgggtgctggtccccagaccctcccacaaggacctgccaggcccacaggggccccagacgtgcccccagcccagaggccgtgtcctcacagggaaagccaggtggggggagcacagtgttcgccaggcctggaggggccccagacgcgtgcccagcccagatgccgtgtcctcgcagggaaagccaggtgtggggagcacagtgttcctctgggcacagccatcatcaacccagcttggaggagacgtcctgaggccctggaggttaagctgctcgtcggggtctcagtctcacagctgcgaagtgtccctcggcctccgatcctcagtgccgagggtcactcagtgccgagggtcactcagtgccgaggatccctgtgcctgtgcgatgctgcagatatgcccacctggtacctgggaatgtgaccttatttggaataaaggtctttgtagatgtaatatattttaaaagactgctttcatgcaaagtatcttctgaccaccatgggatagaattagaaatcagcaaaagaaggaaatttaggaaattcaaaaatatacacaaattaaacagc

SEQ ID NO: 467521 - DNA, 573 bp, Homo sapiens
gagtatgacatatgctatgggatcttcatatatgctgtccatcacacatctgtaccaccgagtatgaaacatgctctgggatcttcatatatgctgtccatcacgcatctgtgccatcgagtgtgacgcatgtggctggatcgtcatacatcctctctatcatgtatctgcaccattatgatgtgtgctgtgagatcttcatacgtgctctctgtcatgcatctgtaccttcgagtgtgacacatgctctgagatcttcatacatgctatcacacatctgtaccattatgacgcatgctgtggggtctccatacatgctctcaatcatgcatcagtaccctgctgtgggatcttcatacatgctctctatcacacatctgtaccattatgacgcatgctgtggggtcttcatacatgctatcacgcatctgtaccattgagtgtgacacatgcggccagatcttcatacgtgctgtcaatcacgcatctgtaccatcgattttcatagtttatgtctttctagaaattttcccatgtcatccagttatgaaatgtagtgacatgcagttgttc

SEQ ID NO: 467522 - DNA, 1380 bp, Homo sapiens
gtgaatgctcacagcaactttatttgtaatagggtatatttgtattcgctacctcacaggctaaattctagacacattttccataatatttggtccaagcctgtctaatcacatggactgagactcctgtgataataggtggctgtcccactctaatccctggcatgtcatagggtagttccaagtcacgtatgccattgtgtttggtaatggaaggaaagcgagtttctgagatgtttccttccagctcccagtgcaagccagttaaccatgtcattagagcagctgtgcacatttcgagctgcttgccaaatgcctttggaaaccaggctttgagacgcctttgtgactcttgtttgcatgttttttggctatgatatcgaggcatttggttctgcatccacgctgctgtctatagcagctccctctcaccaccttgcatgggaagctcccaacatgcaggcagggtccctgtgggaagcatcttctcgcctggccagcatattgaggccggaagcttcgctgccagcaaagatcaagtccataaacatgaggtgcagccgaggcctctccccttggcgcgcatgcctggcaggctgcacaggcgaggtgttcttttgaccttgacctgctcccaggcacacctcccttctctggcacgccccttccgggcatgcctcttttctctggcacgcccctgggactctttctcttcctgcacctgcttgccctctctgagactttcggtggactttccctgcactctgtgctttctctgactttatcagccccatcctgtgcctttatcatggagttgcccactctggtgcatggcccaccctcagtcactatagggaaaagccatgggctgttgaaagcttccttccagattccacctaaggcttcgcatctccaggctccattccactttcacccagagtccaagttccagctacaccttccactcttgactctggatttttacccctggaacctgaggaaggattcaccttcccaggttgatgtcagctctatccttgggtgctcagatgttcaccctctgcccactgatccccctggctgtgcttgggggcactgaggccaaacccttgggtcagctcatggagctggcgctcatgaaggccccatgtaccagtcgtgaggcctcaatgcctgtgcagttggacttccctggagacgtgtgtcctgctgtatgcttcattgttctctttccaacaaggcaggtgatagcagaaccatcagtatgtcacggctttaatttcaaagcaaaagtatttcctatgggcacaggagacttcttcttccagtgctttgggaaaaaccataagtgggcatgtttggatttggcccccaccccat

SEQ ID NO: 467523 - DNA, 436 bp, Homo sapiens
actgtgaatggagaccctgcatgtagcctcctcgtatgacctgggcttcctcccagcatggcagcttcagggttcttgggtttttacaggtggcccagagctccaagacagacaaattctgactttaaatggcaagttaagtacattgtggggagcacgaaactgcaccaatcagatctgtgactgtggggagtatgactgggagaagggagtgttttgggaatccattctctaccaccacaatgggccaccacattcacggaaagaccacacccctcacaggcttcttctagccagaggccagcagggatatgaagacaggcccatgcctaggaaatctcagactcctcagatggctcaaggtctccccatctgcttggataaactttcctggaactggtctcccctctgaaattattctttcattttcagaaaa

SEQ ID NO: 467524 - DNA, 1397 bp, Homo sapiens
aagagccatctctttgttttcattacattgtaaaactattccaatgacagaaatctcaccttttgaagttcctcccttacccaggccctttactccaggcctaaaaataaacgacacgtgctctgaggttacaccgggcgaagcctccctcttactcccaggctcatgtgccgtatcacaggctccacggaggctgcatttaggagaatttggagtcagcgaggaccacacagtgtctgcagggacaggtccatgtttggcccaagaaccagggcataccaggagaaggctggttgctatcattcctgggggcaagctgctagtctctcagctggttcctgctgatggatctgaacactcagtttgggttgccaccccgaggctctgctccatgcatatgtgagggtaggtttgtttttttttggggggggaggtgtgtggggggacacagctggttcctggccagagccgtggctccagtctgaaagtccaggcatacctaagtcgtctcctgtggctccccaatgccatattaggctgccccctctgaagggtggaatctctgactcatcctccctccccaacaccccctcactcctgccagttttggccaagattagaattcactcaaatctgtgggttctaaggtttatgtgctatttcactttggcaaatgactccttcttgtttcaagttcgaaaaaaatcccttcccgaaaggggctttgaaaggcttttcttggcgacacagtgttttgggcaacccaaaagcaacgtggtgatttcagtgccctgagtcaggaagaagccgattgcatttctcaatatatcctggggttaatggatgagaagcaaggaggatttcgaatcagaagggcaacagcaacaccctcctgccattcttgagcacaccgcaggtttccagtgctgagctaggcactctctgcagtttattaacccacaccagttgttacccagtcccaacaggtatgcaaactttttcccattttaaaggtcagccacactttagagcctgggggagttgcctggttctacagctgctgttcagaaaagaatctttggtgttgctttactgctcagttctgccttctgctattgaaacttcttctttgttgccctgaatatctgcagtgggtgctgctgcctggaggacaggcaggtttagacaggactgccttcagccaggcaaaatgggcttttcattgtcacaactgtttgtatagagtcattggctgtgatgacttgttctgaccgatgatacaaaatcactattggaaattctttatgaaagaccaaacaataaaaaaaacctctttgttttgtggaggataaatgctccatggcatccacctaaatgatctttgcttttgaagtttt

SEQ ID NO: 467525 - DNA, 627 bp, Homo sapiens
gaatgtcagcctctcacctcccttccttccggaagaaccgcattgtttatttagcctttggtttgtggatctctgtggcaagcttgttaggaagagcagtgggcatgttgctgcaggggcaaaacggtttgaagtttggactttgcctttttcattcacagctctggctgctactgggtgagagccagccatcaacaaggaatttctgcattttggtgaaacctaaatccggcaagaggcaacgaaagggccagtctcatggggagtcaagaccaggccaggaagaagaggaggcttccgatttcctctcctgctgtgatcatgtgtacaaagatatacacagcctccttccagaagaggcagcaagtcaagtcacagaacaatctgaaagggcagccttgagcccgacttcaaggcaatttggaggagcccattcaaaaatcccagacacccggcataaaaaaagggcacaagaagggccctactccagaatgtcacttgagacatggacggcttctgctgtccctgcccagggtcgacagccaagtcatttcaaggctcctggggatgaaatgtgagagaagataaactttgctttcatctttaaaaccatgaaaaaataaataa

SEQ ID NO: 467526 - DNA, 1065 bp, Homo sapiens
gcaaaggggaatggctttcttaagaagacctccttagtcagaggagtccccaggaactgctcttgctctccctcttcaggtccccccgctcatcacccctggactgctccccatgccctaaatgggcatcttgccttaccagggtggagggaggagcgcatcgggcgccagcgcccccgtgtggccgcgagcaccgcgcgcgcaaagggggggcgagcgccgcccggggcgtgggtgacggggctggcatcaaggtagagggcggccgggcagggaggaggggcagccccgccagcgccgagcccagccctgaagtcgtttcggctgtgcagatgatgagcgacccaggtcgaggcgaatcaggagcccaggtgcttgcccaagcacagctggacgaaatgtctgttaccccgacggctggggcgcgggaccttgcagggacgtggtgctgcagcggcctctgcctgggcctggcgtgcggctacctcaggctaattctccattcgctgcgtggattcgcccccgggaggcggccccacgtttccagcctgtggatcaacaaggcggagaaccacctttgcaccctcgccgggaaaccagctcctacctccggccccctgttgggccttctggccctggtgttctctggcgctcctctcccaccaaggcccggcactcctggtgactgcagccctctctggccctccctggcgctccctggccctgcttggtgctctttgatgctccctggccctccctggcactccctggtgctccctggccatccctggccctccctggtgctccctggccctccctgatgctccctggccctccctggcgctccctggccctccctggcccttcctggcgctccctggccctccctggcactccctggcactccctggcgttcctggcttgctgctgcagcacttcagtggcttcagtcacactgcgttctccctgtgcgtctaagtccacacctttctcttgatataaggacaccagtcatattgaattagagcccaccctaatgacctcatcttaacttgaggacatttg

SEQ ID NO: 467527 - DNA, 983 bp, Homo sapiens
ccaggacaggaagcagcagcaggtctgcagctgggtgctggaaagccgggtcacaggaggctgagcaggggaggaaatttactttggatgtgggacccagatggggcggcggcctctggctgaggggccacccctcctggctctccaaatcagctgttgcccctcgagagtggtcctttcctcctcgcccagctctaggtcagcccacagcaggcactcgttaaatgaaacaaatgctcagagtttcagagagatattgctcctgcagcagcccacctccctgctggcccctggacaggcacaaaagctaagagtgtggccttcagtttgcccagtgttcctggccttttccctccatgaagcagccggggaaggcactgtgtgtccacagcgaccctacagtgggcagctgagggcccactgggattctgaagggcaggcctcaaaatggtgcccttgcctaccatgctgtggttcctattcacagttttcagccctgctagagtactggaagtttccattttccagggttttgctccttttcctcacaagtgccaaacctgggccctcccacctcttccccaactttgcccaagcttccaggagcctatgctgctcatgcatgaacaggttcaagggagtggaggcgaatctgagccctgggcaaaagggcttcccataataattaatgcggtagtttttgcagtcttcgtgcaaggtaaaaccaccctttggaagaacatcactggcaaaggtggccgtgaccataatagatctcaagatgttcttcctgactgtgttcttcgaaatgcccatattccagggtcaacgctgctcatatgctcaccagcccaagaagcacttgcctactcacgtgggaggctgtacagcatgaaagttatggcctgggttcaaatcctgactgctactctttgaccccagactatttgtttacctctctgtgctttggtttcctcatctgt

SEQ ID NO: 467528 - DNA, 825 bp, Homo sapiens
catcccaggacacagctgcgcctgcctgctctttccctgtgctctggcggcctgtcctgggccttacaccaacgcgatgaacaggggaaacggggtgctgagcctctgcctgggctacactctccctggggccattcagggaaagtcagaaatctctttctccccagaccgcagcagctgggccagagaaatgggagagttgaagaatgtttcaggaatcacaggagatgtgacatttgtgctggatctggaacatgggtgggatctggtgggcatagatggagatgaagcccggctgcagggagtcgaggagtcctggggctggagctggggaaggtgcatgcgtctgagtggccggaaacttgtcagaaaggaagattccctgggttcacccccagagggtcccattcaggatgcaagctctgatgaaagggggaactttgatcctgctctcactcagccatccacagggaaggaaaagccaaggagacacctagagccagtaaagccggagcctgccatgggtggaacagagtcagcagaatgcaggctcctctggaagtggaaagagattgttgcctggggcttactgaaccctccagaaggttccattttaagaaccatcatgccttcaggttctgctttggccccagaagcccagagaaaccctggctgtgcagtcttcatttcagaggttctcgagcactactaaaatggcttggtttgacccacatttattgagtcattcagtgttcactgagtgtgttctctgtgtgtagagcttgttcctgtgtagaggaggtccaaacccagcaccaggtccag

SEQ ID NO: 467529 - DNA, 604 bp, Homo sapiens
ggtcaggcctgtcatcctggataccctttcctgtaggtagactttctcccattcgcccccaaccaccactaccgagatgggaaatatgacagcatctggcccttggcgcttatctgcctttatggatccttttctgttgcttgccacctaccagcttcctttatcaataccaggaagctctctacacatccttctgtgttccccttcatttttctccttcaccaatgcactttataaggaaggccacaggctcctctgtcggacctgcctcagaacagcctgggctagggctgatgagcaatacatttccacgccttgcactgacctgttcccactgggtcgcagaggccgagcagctgagagcgtgtgcatggctgatgaccgggacactcagatagtagctgtgggggacagccctgctcaggtgtgccttccattctgtttgctttcaagtaaaatgatgacctcagcacaggaatcactggagaaaatgtctgtacacctcactacagtcactttactcacagggttctgcacaagttccagactagattccctcttcatttgaccaaacatgtgtgggtagcagcaaataaatgaggga

SEQ ID NO: 467530 - DNA, 685 bp, Homo sapiens
ggtctatagaccacaggagaatacaacttattcgaaaacgattgctctatatggattcttctttaagataaagggactcaaacatgatactacctcttatagtttttacatgcaggagggtgcttgacttctccgtagtgctcctgctggactttaggagaggcaggagaatgtcatatttaggagtggagagtccgcaggtgaacggccttgcgagctataggacctgggcaagtgccaggaactctcctctgtgcagtttcctcacctttaaggcagagaagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacggtggaacgtgccagacccgagagtgcatttaccagccctgccccacagaaccctgagtccagccctgactttttgccctctcccagcaccagggaagcaacagcagtggcaacagactgcagccaggagcatggaagacttcccttaaatgcagctctgcctgctacacagaacaacatgcctgccaatcgtccctggcagtttgggctcagacagaacaagagatagga

SEQ ID NO: 467531 - DNA, 515 bp, Homo sapiens
agtgacaaggtgatacggtgtagatatttgtcccctccaaattccatgttgaaatgtgatccccagtgttggacatggagcctgatgggaggtgctgcagagctgccagtcactgccttgctggagacaaaggcccaccctcgtcatccagctgcaactgtgcttgcagctggctttgagcaagaggaccagggaaggggcagccaagcaacaccgaaaactcttagacagcagccactctactgcagccagactataggaaaagctgtggccccactaccactcaagccagcaaagctgagtggaaagcttagatttcccccatcagcaggctgcaatgaagctgaaaaatacaataagcaaaatttaaaactctgtgaatggattcaagaacagaatggaaaagacagagaaaagaatcatgatcttgtagtcccagctactctggaggctgaagtgggagaatcaactgagcctgagaagtctagattgcagttagccatgatcatgtaact

SEQ ID NO: 467532 - DNA, 650 bp, Homo sapiens
gatatcatcatacaccgtggagcttctgaaaaactcctctgtgccctgcctcaggcacatggcttgagctatggcggcacgcagtatggccatcacccaggaaccaaatctccatctacgggaaggtcccggaagccatggtaaggatattggtgtttctaaaggtgcccaagagagcaggagaggggaggagaggtcagaggtgccccaaaaggggtctgtgtccagagagctaactgagcacacatgtctatttccctcttggttccactttcctttcatgacttacagtgcatcattaagaagagtatgtcttagagagaactggatgattagagaagaagtggtcattgaactaaaacttgtgatgaattcttggaaggtagacagaggtgccaaagcccaagatagacatcagagaaaagagaggggaagaacaattaaatggagtgatgatagtcagttgaactatctactgccacgggctgtggtctagatgaaccgagccttttcaacattatcttcaaaagtcatgattttctttttctgtgaaaggagaatattattcatttaactcattgcaatgaattttctgtgatttttatgcatgaccctgttcaatgctgtggttttgtacagtgctatggtgg

SEQ ID NO: 467533 - DNA, 985 bp, Homo sapiens
ccccgcagactggtttatgtccatctgaggtagtatccggtcaaagaaatctttatgcagcaaagcattcaagaggtgacttgggtgatgttaaaggcattcagtttcaaaagagaaacagagcacaaaagattagaaaatttgcaaacagacaatgcaatagaaaagaaaaactcattttctgaggaaaaattcaagccggctgcagaaatttgcataagtaaaaaggagctgaatgttaaacaccaagaaaatggggaaaatatctccaggcaacatttccatcgtgaggccattttcaatagaagcgaaggattccacgggtatcctggcagccgtcagaacaaaaccagctcatggctgtgtaactgcagtctcaggcaaggcctgccttctagccctccagacgccctccaggacaaggcaatgacagaaggtgacatgggagtcaccctagaggcttccacagaagctgatctaaaagttggaaactcctgtctagagcctgtgcccagcagaagaagcaagctgagaaagcccaagcctgtccctctgaggaagaaagcaattgaaggagagttctcagatgccggcactgctgtggaaggcacacctctccccaaggcatcctaccacttcagtcctgaagaggtggatgagaacacaagtccttctttgttaggaagtgccgggttccagaagtctcctcctgaccttaaagaaactcccagcactacgaaagcccttccaaggaaacttggcaagaaaccgggtagcaaactgactcacaagatacaaaaagatggtatcagcatagagaaggagacgtgccaaaaggtggaagaagacgtgtccaccatgcttcctgaagccatggtttttagtttctgtctctagtgataagcagaaaagacggatgaggaaggagctttactgtcccaaccagaaacaacaactaagaatccatgactgtattctctccctc

SEQ ID NO: 467534 - DNA, 917 bp, Homo sapiens
cggcacaccaggagattatatcccgcacatggcttggagggtcctacgcccacggagcctcactcattggtagcacagcagtctgagatcaaactgcaaggtggcagcgaggctgggaaaggggcgcccgccattgcccaagcttgagtaggtaaacaaagcagctgggaagctcaaactgggtggagcccacacagctcaaggaggcctgcctgcctctacaggctccacctctgggggcagggcacaaacaaaagacagcaataacctctgcagacttaaatgtccctatctgacagctttgaagagagtagtggttctcccagcatgcagctgcagatctgagaacgggcagactgcctcctcaagtgggtccctgagtcccgagtagcctaaccaggaggcaccccccagtaggggtggactgacacctcacatggccgtgtactcctctgggacaaaacttccaggggaacgatcaggcagcagcatttgcagttcaccaatatccgctattccacagccaccactgctgatacccaggcaaacagggtctggagtggacctccagcaaactccaacagacctgcagctgagggtcctgactgttagaaggaaaactaacacacagaaaggatatccacaccaaaaacccatctgtaaatcaacatcatcaaagaccaaagcaatggaacaaagctggatggagaatgacttcagaatatcaaactactccaagctaaaggagaaagttcgaaccaatggcaaagaagttaaaaactttgaaaaaatattacatgaatggataactagaataaccaatgcagagaagtccttaaaggacctgatggagctgaaaaccatggcacaagaactacgtgacgaatgcacaagcctcagtaactgatgccatcaac

SEQ ID NO: 467535 - DNA, 895 bp, Homo sapiens
ggcttactgtctgttttgtcagtaagccggcactgacatcacaagacaaagtccttctcacttttctctctgctttccacaggaagaggaacctcttccatggtcatggccaccacaggcctacatgggatactgccaggctaccaccaatgttcactttaagaccaagcgtccttcagtcagcttatggtcaatgctgccaggcctgggactcacccttcagggcagtgggctcccctctggcccagggcaggtccagaaatgtcatccaagagccaaggcctttggaatcagggatcccaggagcctgctcggtgctctgcccactgaactgagctggtacacaaggtgcaagactaagcccatagcatactacctggatatcactgctggttcttcaggacccaagggctctttactcagaggtgatgaatcctgccaggactttgtccttcccttcaaggcagtgggttcccttctggcccaggagagagaaaaagagagagagagcaagagagcacaggtaggacaaaaatgttacctggtgactccaggcaaacggtttttggagggggactgtgttactcctaaaaccaagtgggttctgcccgctcaggggttcttggctgcttggatttttgaagcaaacacacactcatccaagggctgtaaacagtgcaggtgacacagctgactgctatcttggtttaaaaatggagactctggagctggatgattgaatctctattacacccccaacttgggtgatcttggtcaagttctttaacttctctaggcctcagttcccttatctgtaaaatagtatgagaatagtcgctgtgttctaagattgctttgaagattaacatgagttaataatatctataatacttat

SEQ ID NO: 467536 - DNA, 797 bp, Homo sapiens
tctgctaaagtgtgggacctgctacacaaacaaacgctgagaggatttgctactgcaaagccatcactacaagaactgctaaaagtagctctaaatcttgaaataaatctttgaaatacactaaaatataatctccttaaagcataaatctcacaggacctataaaacaataacacaatgggaaaaaaaggaacaccaattagtcttatattttgtcacttaacaaagcaagcaggagtagctattcttatatcagacaaaacaaactttaaagcagcagcagttaagaaagacaaaaagagacattatataatgataaacagactagtccaaaaggaaaatatcacaatactaaatatatatgcacccaacactggagctcccaaatttataacacaatttctactagacctaagaaatgagatagacagcaacacaataatagtgggggacttcaatactccacagacggcactagacaggtcatcaaaacataaagtcaacaaagaagcaatagacttaaactataccctggaacaaatggacttagcagacatttacagaagattctacccagcaactgcagaatatagattctctgcatcagcatgtggaatattcttcaagatagaccatatgatagccacaaaacaagtctcagcaaatttaagaaaatagagattatatcaagtactctctcagaccacagtggaataaaattggaaatcaactacaaaaggaaccctcaaaaccacgcaaatacatgaaaatttacctgcttttgaatgaccgttgag

SEQ ID NO: 467537 - DNA, 626 bp, Homo sapiens
ctggcctgtatggacacccagaacaatctgaatgaatctcaaatgcactgtgcttgtgagagtattggtctccaaagtatatactggatgattctattagcatggaattgcctaaaacacaaaactgcagtaggggagaacagaatgcaagggagatcagtgggggatggggctgggacagggggagggtgtcaacagcacacgagattttcttgtttgggggatttctttttagatcatagaacagctgtgacagaaataaggcttccttggctgccttctgtcactgtgttcgggatggaaacactggacctgggtcactgtcctccatctggtcatggtcctccagctgcaaccgtgtggactagagatgcactgacagaatggcacagtgatgagacagatggcttttattacagtgatgtatgtctcttgtatgtggattttgctgagggttttaatcataaagtggtgctggattttgtcaaatgctttttctgtgtgtattgagatgatcatgtgatgtttatttttaattctctttatgtgttgtatcacatttattgacttgaatatattaaaccatctctgcatccctggtatgcacttgaaacccacttgatcac

SEQ ID NO: 467538 - DNA, 1195 bp, Homo sapiens
tctgctacacctggaccattcacccattgaaggctctctggagagctcctggagacccgcggtctcctgaaggggatgagatgagaaggatgcggagagatactgaggggctccccacccagcaccctgctgagcccccctttctccctgtggaaggaaagacaagcctcacccaggcattgaccatgggtgaccactcattctgcaagcagtcactgaaattaaatgagggacaactacacacacaaggagccttcacccctgttagtcagggacactgctcggcccatgccccacctccacatctcctccctatcctgctgtggcagagcctgccctctagccctctgcagccccgacccaagtccagctcccggctcccagtcctgcagctgcagaggcatcctggggaggggcagctcctggcccaccccaaagcagagtttggtagctatgttgcatctggcatctgcattggactaagagatccatcaagttcaactaggggaacagctccttcatgttctgtttggctgactaattcaatagcagacacccaggcctgggctggcagaggcactcccaaatccaatgaaggtctcgctctgcagccagtctggcagcattacctgggcattttgctcgctcagcatagacctgagtcaggccccagccaccgccacccccaggagctcacagggccatgctactgccaccaggcctccccaagcaagcacccttcctcataaataagattatttatggtgggcaaagattagaaaaacccaggctatctctttgtagtggtgaatgttttaaaattaaaaccaacagaaagtaacacttcccaagggaacattcttacagtgactatgacctaaaacttgtaacattcatcacttctaaaatatgttgaggatatttaatatataattgcattgtgaactcattaaatatttgcataattataaatagaaaacataaataaaaggaaaggttacaatatgagtaaacacataaaactgatatttaattcactgtgctgattagcagtgcacttatttatattggtacttgagtttaagactatatgcatacttttttctttgtttcaaatttttattttttaaaataaaattatatatatttaagtgtacagcctgttttgattcatatatgaatatctatgtatgtg

SEQ ID NO: 467539 - DNA, 514 bp, Homo sapiens
caaccagcctcctgccaggggaagtgatgccctggatagcacacccaagcagaccctgtccatccaggatcatgcccccaatcccccccaacacttgccccactgccgccagcagtgcagcccgggatagtgcacccaaccagtccctgccatgggcagtgcagcccaggataggccccgaaactgccccatgctgtgggaagagatgccttgcctggaggctggagcctgcggcactgcgactcgcctcgccgcgctacagttggtggtggcgacagagactgcagtgtcgcggaagcggtaggagggccacccacagcgggagctgctcctgtccggctagacgacgagaaaggggagccatctgcggcacgttggaagctggggcctgtgacatcgcacctcgcctggctgcggttggtggcggagaaggagactgctgcgcagctggagtggtaggagagaagaaaatagttttggggtacatggagggataaagagggtggttggcctc

SEQ ID NO: 467540 - DNA, 991 bp, Homo sapiens; identical to SEQ ID NO: 459619

SEQ ID NO: 467541 - DNA, 664 bp, Homo sapiens
tttcttgatactgtcaaataaattcagatgaaggaggggcataaaggtggggtgtatgttagctcagactgaagttggaccagagtccgggagcctgaggaaaggagagaaacttaaatatgtgtccactctgagtggaacgccaactctttctggccttgtgtgtgggttggcgattattccatctgctccttccgggcagagtgtagtcattatccagaaatttgataagtcaccagatgagattactctgggtctactgggtgacctgcttcctttgggaacatcactaggagatcaagataacagcacatctagaatcacaggaaaggcctatagggccaggaataccatatctccacacacgaaggcagtgttcagccttagtttctacactaatagaccaccatggaaattaacaaaaactggtaataataacaataactatagtgaaaattaagtagaaaatgaagaaatcaaaaagaaaatgaaaaagggaaaagtctgcatctataaaacagacagattttggatttctagacctaaattaaacacccagactgtctcctactgtttggttcaccttggacagcttaatagccaaatgtctttgagtcccagtttgcatatttttcatatagggaataattgtattagaactttc

SEQ ID NO: 467542 - DNA, 1886 bp, Homo sapiens
cttctcagaagaatctttatggtttgctgcccacaggaagagacagggggagatctgcctttgcaaacatgaaggatagaggggctttatctgctttgggaattaaatggattaaaggtgctgtgaggctgatcttgcagttctccccatacctgtctgtccctggccatgtcctgtggggaagcaatgatgttcagagggttctcacttcaacaagaagcagctgctctatctttggagaagcagggggcacttcagctttggaaaagatccggaaggactgttcaccccctcaccatccaaaacagccccattctcaagaattctacaagcttaagaatacctttttttacctctccatttgtcctgaaatttatgaccaaacactatctagcaaagttatctgcaaaggaacgacaccaggctgtggaagctgtgctcttccagacactgctgaaaggcagtaccaagataatgttgtctgtcccctctgcagccagagtggacgctcgagcaatcccacaggtcgctgacacataggaagcaaccagtaaataaatgctttgaatgaattggcctaaaagtcacttctctttatccaagggcatttgagaataaaggctgacactgacaaatatacaaagaaataacattcatacttatatctgtggcaaactttgtatatcctacaaactaaaaattcagtaagatataatttttctttaaacatgaatatgttccccatatgggttaagtaggcaagatagtctctaagtctgtttatatctgcaaatatttctttcaccctggcaggtaacattcttgagtgtgtaaaggattcttgggcctcagtctttgtcttccataggctatacaaccatgtacttgcagctggttagatctctgccagtctatctaattcattttccttgatcggtaactatttttttggcgagaggttgttctttctcctcgatgttaagtaattttacagaatatagctctaagttttttcaaatttgccttcaccttcagaactgccttagttattcttggaccttcaggttttgaaataaattttagaaccgtcttatcataaaactactgaaattgtattagaattacactgactctgtagataaacttggtgaaaattgacatgggcaatattgaatcttttatttcatgcctatagcaaagctacaatatttagctgcatctatttttaatatgacataaatttctaaattagttttctgtccaaaaagttttctgatttctactgcagtctactctgtactgtggcctatttagaaatgtaatccttaattttcaaacatttggagattgttctatttatcctttgttattttcattatatatattcatagaatatacttggtatgatttcagtcatttggtatttttagaaagttactttataaaaatttatttaaataaatttgttttataaatatcaaggctttccattgctttcatacagcttttcatttttgttttttcattttgtcaacccttataagtctaaaagctgaaagtggagtttaaatgaggataataataacctccctgagagctatgagaattaaattagataatatataaaaagtgtctggtgcaggtgcctacctcataataaactgttagtaaatgacatccactatagctgttgccttaatttacccatgtgtactatttgtgtttgacctgtcagtgccactagaccagactggatttatttttgcttctaaattacaaacctagatctgtgattttctgatgaaagaaaagccccggttttaatcatacattacagatcgtctttgggaatgcagctggttcgtttgcctgtgtggttgtgcact

SEQ ID NO: 467543 - DNA, 3219 bp, Homo sapiens
ggactcgaatttaattcaattgaacggattcgaatggaatagaatggaatggaatcaaatggaatggattggaattaaatggactcgaatgggaaggaatggaatgcacacgaatggaatgaaatggaatggagtcgaatggaatggaatggaatgcaatggactcgaatggaatggaatggactcgaatggaatggaatggaatggaataatagaatggaatggattcgaaaggaatggagtggaatggaatggacttaattggaatggagtcaaatggactcgaatggaatggaatggaattgaatggactcaaatggaatggaatggaatggaatggaatgcaatggaatcgaatggaaaggaatgtaatggaaagaaaaggactcgaatggaacggaatggaatggaatggactcaaatggaatggaatggaatggaatgcaatggactcgagaggaatgcaattgaattgaatggaatggacacgaatggaatggaccggaatggaatagaatggaatggaatggaaaggattcgaatggaatggaaaggaatggaatggaatggaccaaatttaaatggaatggaatggaacggaatggaatggaatggaatggaagggaatggaattgaatcaattccaatggtatgcaatggcatggaatggattcgaatggagtggaatggaatggattcgaatgcaatggaaaggacacgaatggaagggaatggaataatggacatgaatggaatgaaatggaatggaatgaattgtggaatggaaggaatggaatgcctggaatggaacggacttgaatggaatagaatggaatggaatggactggactcgaatgaaatggaatggaatggaaacgaatggaatggaatcgaatcaaatggaatggattggattggactcgaatggaatagagtgaaatggaccagactggaatgcaatggaatgcattcgagtggaatggaatggaatgcaattgactcgaaaggaatggagtggaatggattcgaatgcaatggaatggattggaattcacttgaatggaataaaataaaatggagtcgaatgaatgaactcgaatggaatggaatggaatggtgcggaatggactcaaatggaatggaatttaatggactcgattcgaatgaaatacaatggaatggactcgaatgtaatgggatggaatttaatggaatggactctaatggaatggaaaggaatgatttgaatggaatagaatggaatggacttgaatggaatggaatgcaatggattcaaatggaatcaaatggaattcaatgcactcaaatagaacagaatgtaacggaatggaatggacttgaatggaacggaaagactcgaaaggaatggaatggaaaggaatggaatggaatggaatccaatggaatggaatggaatggaatcgaatggaatggaatggactcgaatggaatggaaaggaatcgactcgagtggaatggaatggaaaggaatggactcgaatggaatgcaatggaatggtatgtactcgaatgtgatggaatggaatggaatggagtgcactccaatggaatggaatggaacgatgaaatggaatggattcgaacgcaatggaatgcaaaggaatggactccaatggaatggaatggaatggaatggaatggaatggaatggaatggacctgaaaggattggaatggcatggaatggacccgaatggaatagaatgaaatgtaatggaattgattggaatggaatggaatggattggaatggaatggactggaatggaatggaatggtatggaatcgaatggattggaatggaatggactggaatggaatggaatggtatggaatgcaatggacgtgaatggaaaagaatggaatgaaatggaatgtattcaaatggaatggaatggaatgcaaccgaatggaatggaattgaaggtattgaactcgaatggaatggattggacacgaatggaatggaatggaatagattggacaagaatggaatggaatggaaaggaaaggaatggacttgaatggaatgccgttgaaaggaatggactcgataggaatggaatggagaggaatggaatggaatggaatagaatggaatggaatggaatgaaatggactcgaatggatggaatggaatggactgaacacgaatggaattcaatggaatggactccaatggaatggaatgcggtggaatggactcgaatggattggaaaggaatggaaaagaatggaatggaacagaatgtactcgaatggaaaggaatggaatggactcaaatggaatggaatggactcaaatttaatggaatggaatttaatggaatggactctaatggcatggaagactcgaatggaatggaatggaatggaacggaatggactcgaatgcaatggaatgcagtggaatggtttcgacaggagtggaatggaatggaatggaatggagtggactcgagtgaaagggaaagcaatggaatggaactcgaatggaatggaatggaatggacacgaattaatggacacgaatgtaatggaaaagaatggaatggacttgaagtgaatggaatggaatggactcaaatggaatggaatggaacggtatggactcgaaaggaatggcatggaatggactccaatggaatggaatggaatggaatataccgaatggaaaggagtcgaatggattggtatgtaatggactccaatggaaagccattgaatggaatggcatggaatggaatggactccaatgtaattggatggaatggaatgcattcgaatggaatggaatacaaagaaataggctccaatggaatggaatagaattgtcccgaatgaaatggaaaggaatggaagggatcagaagagaatggattggtatggaatggaatggaatggaatggaatagaatggaatggactggaatggaatggaatggtatggaatggaatggacttgaatggaatagaatggaatgaaatggaatgtattcgaatggaatggaatagaatggaaccgaacggaattgaatcgaatggagtgaagttgaatggaatgggatggaatggactcgaagggaatggaatgaaatgaaatggactcgaatggaattgaattgaatggaatggaatggactggacacgaacgtaatgaaatgaaatggaatggcctct

SEQ ID NO: 467544 - DNA, 2368 bp, Homo sapiens
tggaaaggagtcaaacggaatggaatggaaaggagtcaaacaattaaatggaatgtactcgaaaggaatggaatgcaattgaatgtaatcttatggaatggaatggaatggactcgaatggattggaatggaatggaaaggactcgaatggattggaatggaattgaatggactcgaaaggaatggaatggaatacggtggaatggactcaaatggaatggaatggaatggaatgcagtcaaatgtaatggaatggattcgaaggcagtggaatggaaaggaatggactcgaatggaatggaaaggaatggaatgaaatggaatggaatggaatgcattcgaatggaatggaatggaatggaatggaatggaacggactcgaatggaatgcaatggaatggacttgaatggaatggaatggaattcactcgaatggaattgagaatagaatggattggaatggactcgaatggaatggaatggaatgtactcatatggaatggaatggactcaaatggaaaggaatggaatgggctcgaatcgaatagaatggaatggaatggactcgagtggaatgaaatggaatgcaggcgaatggaatggagtgggctggaatggactcaaaagaatagaatggaaaggaatggaaaggaacggaatgcaattgactcgactggaaaggaatggaatggactcgaatggaacggaatgccctcgaacggaatgaatggaatggaatcaactcgattggaatggaatacggaatggaatggaatggactcgagtggaatggactggaatggaatggactcgaatggaatggaatggaacggaatggaatggaatggacccaaaaggaatggaatggaattgaatggactcgaatggaaaggaaaggaatggaatggaatggaatggatccaaaaagaatggaatggaattgaatggactcgaatggaaaggaaaggagtggaatacaatggactcaaatggaatggaatggaattgatggactcgaattgaatggaatgcaatggacttgaatataatggaatgtcctcgaatggaatggaatggaatggagtcaactcgagtagaatggaatatgtaatggaatggaatggaatggactcgagtggaatggaatggaatagaatggactcgaatggaatggaatggactggaatataatgtgatggaatggactcgaatgtaatggaatggaatcaaatggagtgcaatggaatggactcgaacagaatggaatggaattgactcgaatggaaaggaatggactcgaatagaatgtaatggaatggactcgaatggaacggaatgtaatggcgtcgaatggaatgcaatggaatggactcgaatgtaatggaatggaattgaatcgaatggaattgaatggaagagaccctaacggaatgtaatggaaaggaatggtgtggactctaatggagtggaaaggaatggattggaacggactcgaatggaatgtaatggaattgaatggacataaatggaatggaatggacatgaatggaatggactcgaatggaatggaattgaatggattcaaaaggaatagaacggattgtaatggtctcgaatggaatggaatggaatggactcgaatagaatagaatggaatggactcgaattgaatgaaatggaatggagtcaaatggaatggagtctaatggattcaaatggaagggaatggaatggaatggacccgaatggaatgcaatgtagccaatctgaatggactcgaaaggaaagcaatgtagagaaatgatatggacacgaatggaatggaatggaatggaatgaaatggactcaaatggaatggaaactaatggcatgaaacggaatgcaatggaacggaatggaatggaatgcaatggaatggaataaaatcgaatggactggagtagaatgccattgaattaaatggattcaaaaggaattcagtggaatggaatggactggactggaatggaatggaatggacttgaattgaatgaaatggaatgcactcgaatgtaaaggaatgccctcaaatggaatggaatcaactcgagtggaatggactcgagtggaatggactggaatggaatgaactcgaaaggaatggaatagaatggacccgaaaggaatggaatggaatagaatagactcgagtggaatggacctgaaaggagggcaatggaatagaatggactcaaatggaatggaacgtaacggaatggatcggacttgaatggaacggcatggaatggaatcgaatggaatggaatggactggacccgaatggaatggaattgactggaatggaatggaatggaatggaatttaccc

SEQ ID NO: 467545 - DNA, 3854 bp, Homo sapiens
gactcgaacggaattgaatggattggacccgaatggaatggaatggaatggactcgaattcaatggcacggaacggactggattggaagggaatggaatgtaatggatttgaatgtaatggaatggaatggattcgaatggaatggaatggaatggaatggaatggactcgaataatggaatggactcgaatggaatggaatggtgtggaatggaatggactcgaatggaattgagtagaatggactcgaatggaatggaatggagtggactcgaatggaatacagtggaatttaatggaatggactctaatggaatggaatggagaggactggaatggaataaaacggactggactcgaatggaatggaatggaatggaaatgactcgaatggaatggaatggaatgaactcgaagagaaaaatggaattgaatggattggacccgaatggaatggaatggaatgtattcgaagtcaatggaatggaatggacaggattggaatggaatggaaaggaatggattcgaatggaatggaatggaatggactcgagtaatggaatggaatcaaaaggaataacatggaatggaatgccatggaatggaatggacacgaatcgaatggaatggagtcgaacagaatggaatcgaatggaatggactcgaatggaatggactcgaatggaaaggaattcaatggaatggactcgaatggaatggaatggagtggaatggactctaatggaatggaatggaattgaagagattcgaatggcatggaatagaatgtactcgaatgaaatgggttggaatggaatggactcgaatggaatggaatggaatggactcaaatggtatcaaaaggaacagaatggactggaatggaatgaaatggaatcgactcgaataatggaatggaatcgaaaggaacggagtggaatggaatggactcgaatgaaatggacacgaatgcaatggaatggactcgaatggagtggaaaagaatggacccaaatggaatggaatggaatggactggactggaatggaatggactggaatggaatggaatggaatggattggaatggaatggaatggattggaatggaatggaatgaaatggagtggaatgtaagtgaatggaatagaatggatggaatggaatggactcaaatgtactggaatggaatggacatgaatggaatagaatggaatggaatcaaaaggaatggagtggaatggaatggactagaatggaatggcatggaagggactcaaatagaatggaatggaattgaaagaaatgtaatgaaacgtacccaattggaatggaatggaatggaatgtaaggtactggaagggaatggaatggaatggaatgcagtggacttgaatggaaagaatggaaaggatcggaaaggactcgatgggaatggaatggaatggactcgaatggaattgaatggactcgaatggaatggaatggaatttaattgagcggagtctaatggaatggaatctaatggaattcaatggaatggactcgaacagaatagaatggaatggactcgaatggaatggaatggaatggactcaaatctaattgaatggaatggactcgaatggaatgtaaaggaatggactataatggaaaggaatggactcgaacggaatggaattgactcaaaaggaatgaaaaggaatgggatttcttcgaatgaaatggaatggaatggactcgaacggaatggaattcaatggaatggactcgaatggagtggaatggactcaaatggaatggaatggaattgaagagattcgaatggaatggaatggaaagtactcgaatgaaatgggttggaatggaatggaatcgaaaggaatggaatggactcaaatggtatcaaatggaacggaatggattggaatggaatgaaatggaatgtacttgaatggaatggaatggactcgaatggaatggaatagaatggaatggattagactcaaatggaattgaatggaatggaatgtagtgtgctagaatggaatgtaacggaatggacatgaatgaaaaagaatggaatggaatcaaatggaatggattggaatggaatggactcgaatgaaatggacactaatgcaatggaatggactcgaatggagtggaaaagaatggacccgaatgtaatgtaatggaatggaatggattggaatggaatggaatggactggaatggaatggaatgaaatggagtggaatggacatgaatggaatagaatggatggaatggaatggactcgaatggaatggaatggaatggacacgaatggaatagaatggaatggaatcaaaaggaatggagtggaatggaatggactcgaatggaatggcatggaagggactcgaaaagaatggaatgcacttgagtgaaaggcaatgaaatgtaacaaattggaatggaatggaaggtcctggaagggaatggaatggaatggaatgcaatggacttgaatggaagagaaaggaatggatcggaaaggactcgatgggaatgaaatggaatggactcgaatggaattgaatggactcgaatggaatggaatggaatttcattgaacggactctaatggaatggaatctaatggaatggaatggaatggactcaaactgaacagaatggaatggactcgaatgaaatggaatggaatggactcaaatgtaacggaatggaatgtattcgaatgcaatggaatggaattgaatggtgtagaagggaatggaatggaatgcagtggaatcgactcgaatggaatggaatggaattgactcaaggggaatagaatggaatgcacctgaatggaatggaatggaatggaatggactcgaatggaatggcatgaagtggaatggactcgaatggaatggaatggagtggaatggaatggacttgaatggaatggaatggactcgataggaatggaaaggaacggaaaggtgtggtctcgaatataatggaatggaatggaattgcatggaatggaatggactcgaaaggaatggaatataattgcaatgacgcgagtggaatggaatagaatggaatggaaacgaatgtaatttaacggaatggaatggacttgaatggaatagaatggaatggacccgaacggaatagaatggaatggatcttaaaggaatgaaatccaaaggaatggaaatgagtcgaatggaatagaatggaatgcaatggaatggaatggaatggaacggaatggactcgaatggaatggaatggaatggaatggactcgaaaggaatggaaaggaatggactcgaatggaatggaatggacacaaacggaatggaatggaatggactctaatggaatacaatgcaatttactggaatggactctaatggaatggaatggaatgcacacgaatggaatagagtggaatggactcgaatggaattgaatggaatggaatgcacacgaatgtaatggaaaggaattgtctccaatgcaatagaaatgagtggacttgaacagaagggaatggaacggaatggaatggaatggaaaggactcgaatggaatggagtggaatggattggaatggaatgaagtggaatggaatggaatggaaaggaatggaatgggatggaattgaacggaatggactcgaatggaatggaattcaatggacccgaatggaatggtatggaatggaatggacttgagtcgaatacaatggaatgcaatggaatggactcaatggggatggaatgcaatgtactcaaatcgaatggaatgcaacggaatggactcatatggaatggattagaattgattc

SEQ ID NO: 467546 - DNA, 865 bp, Homo sapiens
tgcctgtgtgcacagggctctgcccacggagcttcgagccacattcgcaacttactgagaaatgcccgtgggattgttcaccagccatttaactaacctgtatgtgctgccatggcctggaccctgtgcccaccctgggttgggagtgtctggtgtgttccctcacctaccctccccgggatcccgtgagccaggggtgatgcagctgtttagcagatgtggaagcagattaactgcaaggttttctcatgcctcctgccaacacaaacccactctggtgtggcgcattttgccaaccatccagggacagcctttgccttgtggggagcctgtgtgcacccagacataccccaggaaagaaaaggttgcagaaaaatggtttccagccctgctcaaagctcttctcagagtcagcggttcacagcaaagggacttttccagaagttccaaaaggctcacaggaggttttattttgttttttcacaattaccaaggaaaaggaaaataaattaacttgagtgaaagcagaaacccctgcgccctgacacacaacacaaaccaaaccaaacagggaagtggtcatgcgctttctcgtagccatgacgcgcccagccccagagctgttaaagacgcagcgttggtgcagcgggcctggtggacacttctctttgctctgctcaatgccccgtgcctgtttctcattgaataaactttctcatgaattaaggtcttgaaattaaatatatcgatcccaaaggggagctttcaaattaactagtcagagtcttacacaactactggttttcaacaagccggatgaaggccactcagccccagccccgtgttattagtggggttcaggccc

SEQ ID NO: 467547 - DNA, 805 bp, Homo sapiens
ggaaggaactgtttgagacgctgggagtttttggtgaatttcaaatgagaagtgctgtcttttgtgcatctgtgggctgctcaggacggcgatgcagtctgaagatggatttcactatattgaacgtgtactattgcatttaaaattagagacaagagaaaagaaaccaccactcactgatgacaagtgtctggtgaaatggacacttgtacaggctgcttgtaaaagtacattctgttatgagacatgggaaaaacaatttggcaacaagatgcaggggacttcctctgattcactagttcacctcctggtgtctatgggaccctgtgtggagacttacaggtcttcaaggatgcaaaatttccagccgggagagcaccacatgggcctctgttctcccaaagacacggccaatcaggatagctggaaaggcctccagacaccggcacctttgcaaagccttcttcagcactcggataccccatacctccctctcttctctgaaccctaacactttctagttgcaccattatctttttaaaatactaggtgcttagcccatcctaatcacccttatcatgctccttccacaccctgagaaaaaatggcctcgcagcagacgtttgaaggcaccgggactggaaaagtctttcaaatggcacctgatttggctacatgcctgcagacaggtgaaagttagtgcccccatttcacagaagtggaattactggggcaaatgacataagcatttccagttctcatggcggatgctgtctaattgcttttcagaggagtcaatgccttc

SEQ ID NO: 467548 - DNA, 1848 bp, Homo sapiens
ggtgtccagtgtggactctcttcacgttaagacacttcctgtgcagcttctcggacacccggcactgccggctttgggggctgtttgagccccagttggaacttccaaccagagaccaggcaagaaaagaaaaggagcttagcttcccctttaagtgagaacatacgatgtttggttttccattcctgaagaatgtgagttctgcaagcagcatttctcttctcttcactactgatggtgaaggaatatcaacaggatggagaaaagtcaatggtctgaatatggtgtttgctctcacctgttgtctgtccctggagctgcctgctgtaggcatgttactgacagcaacatcatgggacaattattccttgtgtcttttacatacatctgtttattgccagtccccatgtggggatgtcttggcagttgtgtatgttggcctgaacctcaggagagaaatctcagccagagataaatttggggatgaagaagccaagaagataaccagggacagggctgatggtgagaactacactttgaaaaacactggtaaaaacattgtagacccagttataggaaatacccagaacagtttactgcgatatgtggccgtttaggtggcacacaatatcaccagtgtggtcccattttatatgaaaaattaaattctatcctggtatccctcaacatcctggatgagtttttaaattagcatacaatgaagctccccctttgtggtgtatgcgcctatgggttttgacaaattcatgaagccgtgtatcaactacctcagtaccatagagaacagttccaatgacctaaaatagaacgtgtgtggtccctttttagctgatttctcctctaatctttgacaatcactgaactgttttccatccccacagttttgccttttccataatgtcatacgcctggaattatataacatgtagtcttctgggtctggcttcttttatttagcaaaatgcatttaagattcatccacattgttgcaggaatcaaatagctcattcctttcattgctgagtagtattccattgtatggctagatcccggtttttaaatatatttgcctgttgaaggtcatcttggttgcttccattttttagtgattatgaataaagttgctataaacattggttagcttgtttttgtgtgaacgtaagtttctgattcacttgattaaatacctaggcgtgtgattgttgatttatataagtctgtgtttaactttataagaaactgccaaaccgttttccaaagtgactgtaccactttgcatttccaccagtgataaatgggaattcttacggttctctgtcttcatcatcatttggtgtcgtctgattgattttagcaattctaatcagtgagaagtgatatctaattgtggttttaatttatacttccctggtgacaatgatattgatcatcttttcatatgcttatttgtcatttggatttcttatatgatgaagcgtctgcttaaatcagttgcccattttttaattgggtcatatgtttgcttatggtaaaattttaagagttctttatatattctgaatacaaggctttcatcagacatgtgatttataaatatttcttccagtctgtagctagtcttttcattctcttaacagtgtctttcaaagagcaaacatttttaattttgatcaagtccaactaaacgttttttttttctttcatggattgtgcttttgttgttgtgtctaaaatgttattgccaaacccaagtcctgctgattttctatgtttacttatagaatttcatagtttcattttttacttttatgtctttgatccatttta

SEQ ID NO: 467549 - DNA, 531 bp, Homo sapiens
agagttaattcggtggccaaatgggaagcaaatggattacaaaaaccccagatgagaaatgggaggcccctgcgagaggaacaagagtcgttctgggagaggacctggagcgtgcaggatcagggtgggtccatgcaaagccggataagggaagtgtttgtcaatatggagagattctcccattataatcgcattggcccaagggaccaagtcttggtgggatggctttgcaggcttggaataagtgatgggcctcaaccagctgaagcagagatgctaaaaatgccatgggcttactgtggaggagggaatctgaagactcagagagatgggcctgctgcaatggacttgctatataagaccaggacgaccaccagccgacattgggaggccccggaggacaccctgcttacaaggggataaggaatgtgggttaggggagcaccagtactgctggactctgcaggccaggacggttgagatggcagagagttgcaggctacatgttgggttccctcttgctaagtctgg

SEQ ID NO: 467550 - DNA, 915 bp, Homo sapiens
gagattggcagggaaagcaagggaaggcagggaaggaagtggttaggaccttgctggcccaaatccatttgtcatcatccctgcagagctctggtccctggcagtgacacaccctgacatgactgtctgcagcgagtgactcaagccctggattctgcccagtctggttctgtctccatgacccactctgtgtcgccctctgtgacactagcctcctccaaggtcatccttgctgtgctggggaacacatgtccttgtggttctgagctcaccaaggtgtcccttccctcctcccctccgctccctgctccctggggcttcctgcactcatcggagcagaagtcaccattcctcttccgcataggaacctcaagacccaattctcccttctatgtgacacatcaagttttctgtccactaggggaccacagaatttaccattcaaaccagatacttctgagcgtgaaagggggtgctattaataattacaccaacatagtaggtgtaaaccacgactgtcccaaatgggatctgatggccatcccactgtttgcagactcagaccctgaatcagaagtacaggggaagtttctagaagagtggagttgctggatcgagttccccaaatcctttaacagtgagtttcctgggccccctgaaccacctaccatccactagttcatctttgctccctccacacttcttcctctcttatggtctttgcctttttcacaggttggtccctgcctgtcccctgggcaggtgtatccagccctgtgatatttcccctctcactctgaacctgcctcctctgctatagcccacatatgggttgtttatagaaatgtcactttcctccacccaaaggttaccccagccttctatttttatttttctactgaaagcactgttatc

SEQ ID NO: 467551 - DNA, 616 bp, Homo sapiens
gtggacgggagcagctttgccaacccctgaaaagtgactctgaagaagacgacaagccctgctccagtcacacccggaagctgactggtccacgcatggccgaagcatgaggaaactcattgcaggactcattttccttaaaatttgtacttgtacagtaagtacttcaactgaccttcctcagactgagggctattcccggtgcatacatcaagtcactgagaacagtggtccccaaccctcggaccaagaaccagtaccagtccatggcctgttaggaacagggccatacagcatgagatcactggcggcattagattctcataggagcacgaaccctattgtaaactgcacatgcaaaggatctaggtttcctgctccttatgaaaatctaatgcctgatgatctgtcactgtctcccaacacccccacatggggccgtctagttgcaggaaaacaagctcagggatcccactgattctacattatgtgtctcccaccaaggctcccgactccttgcagaaacacatgccatccagtccccagagcttctcttcctggtgtgaaatgcactgtctaggtgtttctcacgccattccatgtgctccagtggaag

SEQ ID NO: 467552 - DNA, 755 bp, Homo sapiens
tgtatataatccttctgagacatgaagatcccaggatgtcactacccgaagaacagtatggggggagccactcccatgattcaattatctttcaccaggcccctccctcaacacgtgggaattatggaagctacaattcaagatgagacttggcagtggtttgtagttctccttgaagaggtccttcatgtccctttatcaccagcagaggctgcagaacagcaaaaattgctggctgctccttcctctggaagcttcatcccaggcggcactggcctgatgtcagccagagctctcctgtatgaggtgtctgtcaaccccagttgggaggtctctcccaatcaggaggcatggggagtgggcaggcaggaatgtttaagtctgctgaagctgcgcctacagcctccccttcccccaggtgctctgtcccagggagatgggtgttttatctataagcccctgactgaggctgctgcttttctttcagagatgccctgtccagagaggaggaatctagagaggcagtctcgctttgccgcactgtgttgagttctgcccactctgaacttcctggtctccttagcactactatattgtgcttcttgaatctgtggattctttttatcaattctggaaaattatcaactattactagccaaatactgctgttttgatatccttggttttttatttcctttcataagactgattacatatacagtgaaccttttcatttctgtcctccatatttttaa

SEQ ID NO: 467553 - DNA, 1219 bp, Homo sapiens
gtgagaagtagtgcggcacgctcggagggcatctgtccccacctcttcctagctgcgcctgcacgctgggaaggctggtgtgagtctggctctgaggcctagccctccctggcaccggcggacccgggctggccaggtcctgctagtgcagatggcattcccagcctttgtgctcgtatctcctctgtcgcgggctaggtgttcctcgggtgatggagcccacctccccagcaccatagccctgaaagccacattctgagtcagagagaaaccaggctggcagcagattccacagccgcggctgtaggactgttctgtttgctctattaagggactctcctcttaactgccgggagggaccccgatggtttttccatttctgtttccataatatgtaccgaaacccacacttcattgaaagcagatggtgaaagcggccctcgacatgcgaggagacgccaggctacgacgcctctgatttgtctgccttctgggcagccctggcaccgatgggggccaggacactggagccctgggactctggacatgagagcaggaagctggataatggaaaacaaacggcgggcctgggacgggaagatcaaaagggaagggaagaaaaaagccaatggaagagatgacatcgggactctccaagcctctcattcccgtgtcctgagtcttacagtgtcaaattcttgggaaagtagtgtgcatcaggcagccgcccctccagaggaaattgggaaagtcatagaactggggttgctagaaaaacagttcttcacctggactcgagcaagggaggaggagcctgtggccatcattaaggggcctcacgcacattccctttctctgggggcacacctagaatggcactgccctctcacctggagctcagggtacatagagcacccacaaactgagaagaccaaaggctcacagaaaaacaggaaaatgatgaatggacagaagagaaaatcaaagtgagggtgtgggggagtaggctctctcccatgttgctggtgggagtggaaatgggtaaaatttaattgaagaaaaatgttgcatatctataaaaattttaaatgcattaccctctgagttgtcaattggctcctaagaatttaccttatggattgcactcttctatgcaaaatgctgtattgtttataatgccaaagcttggaaacaaccactaaaatgtacattccatgaa

SEQ ID NO: 467554 - DNA, 561 bp, Homo sapiens
tctctgtttcatgccagtcttccaaatgccctatgagaagctggcagcccacattttcacctgctttttaattttaaacagccatttcttcaagacaccctggtcccttctatcagagaatggtgttagaaaccacaatctaggtgctgggtgtgtgtgttgttactgggtagtcattccttctaggctcactcagcagacggcaaagaaatatgtgtgtatactaacccacgctacttatttgacctccatgttctcacttattcccaatggctacgcatcaggtgagaattctaccactgaactatccatgcctccttatggctgtgtgacaaagaggatgaccgaagtgacaccagtgatgtcaaacaaggaaggggagacaatgatggagtggatcaaaaaaccaaagaaccctggaaccagatatgggaatatctcttggaagtaactaggagatgttaactggatcactgtgtgttagagctggagggtcctggactgtcatctgacccactcacacgttttgccgatgaagatgatgtagtggcacagagaggt

SEQ ID NO: 467555 - DNA, 757 bp, Homo sapiens
gatcagcagtcatactgtgcaccaggaaagaggtccaagccaagctggagccccttaggagacagtgtaggaactggggctcctacatgtcccactcccacgggagctcagtgagagcccctccagggccagagacccttgctgacacttgttgaacaacagggagacctcaagccacaggccacagaacctttgagcctgtccttcttcctggcacaaaaagaacgggtatgaaccctcttctgcaaagcagaagagcagcaacatccatgcagggtgtcttctgctctcgtgatccccctccagccttgcctcgtaaatcagcccgcgacctcgcctccctggggctgctgcgcttctctgaactcgctccagtgggtccacatctttctgataatgaggtgccagacaggagcggaggggcctgctgcgatccgtgggagcgttcaagccctgtcctggggagcgctgggggtggagcccggtgtcatggtagggagggggccctctggaagcttcagtgcctgaagggctcacataaggcacctcacttctttattcttgcagaggcccttgatggtggacagaccccagcacggccctggacagattgtgaggcacagagaagtcacctgccacctccccaccgtcagaacaatgatggcagacaccaccaggtcctgaggctctcctggcctttgggcactgttcctgctgccttacagacatgatctcattgaacactcatgaacactca

SEQ ID NO: 467556 - DNA, 774 bp, Homo sapiens
tgaggaactcctcccttctcaggcccagtgccaaagagcaaggctacttgcaccagcagcatgcgccagcaagagagcagaagcaggaagaaagccagccggaagacacctaccctggccggaagacacgtacccccgaagatcgagaaagaggctgtccggaaatccacactcagttacaaaagtgaaagtggcctgagaaagaaggggatggcaacttctaacaagatcggacagaaagctgactatctaagtacatctaaaaccatctcagcagaaactgccagcttccatgtgggaggaaaaatgcaaggaactcgcccaaggacaggacactctcctcatatctgcactgaatcctttcatcgacaccccagtcccttccatcctggagggtcccagtcttctggacacagtagggcagtgctggctgtgacccatgagaagttctctccaggaaccctcagccagggctatgctccaatgaatgatggcacggagctagaactcaaatatggctccgggtcaatgatgggctgtgaacacagccagcagaaggagttcaacttttacaaggcaggaggagaacgtggacagcaccagcacctggaagctgttggttcaggtggctgctgcctctccgcagccaatgcccagacaaagtgggctacaggtacccaaaaggcaggagaacccatgggatttagggatactaaatagggcctgagagtctaatggaaaaggtgatatattctgatttcccactacattttc

SEQ ID NO: 467557 - DNA, 3859 bp, Homo sapiens
caggcctggcagtgaggccagtctccataagagccagcttgggttatggccatgggacccctgagaggctggataaaccctgatgcgactcagggcctgagcagccatttctgtccggggatcttgttaccgcccagagctgggccgaggagtgggagacccaggattcctctgttgattgatttccccagaacttttttccccctaccggaggctttggcccagagagagcaacacatgggacctcccttggttgaatcctcaaaatctatgaatactcctgacttcttttctggctcccccgatggaaggctcctattgggcatggtggtcttgctgcttctctcaaataacttccttctgcccgcacagaaaagctgcaagagctcctcaaaagagcccgtggctgtcatctgtgtccttctgcaagggcccgcacaaaggaacagatacagtgaacttcccacatataacaccctggggggagttggacagttgggggagggggtgaaaaaaccaccctgggtacagactgagagcatcttgacaaagggaattcatgtaaaaatcattccacaaggaaccaaccacccagaaactgtggccctcatgctaactcaatgtttatatttcattaaaaacgatttcaagggtttgcgtcttgcacttcatggcccaactcccatgcatacagcttttcatctcactgagcatgtcctggagcagacgagcattcctcacctcttggtttcagaagaaggagcttcttggggaataattccaggttctttttttgcatctataatctaatcaagaatctgtaggtcctaccatcctaggataaatgagaagaaaacaaggatgcaagacccaacaataaaaatattagaattttaaaaatactatactagagtttgcttttaaatacctagtaaagctacaataagtcatgaaattgatgaatggaaagttatataatttcagctgtatattagttgctttttgctgctataacaaatcaccacaaactttctccttgcagctgctccattcctttgtttatggcctattctccattttcaaagccagcaaagttgcatctttttaacttttcttctgcaggaatatcgccttccaactatggcaagaaaaggttgtctgattttgaagatttgtgtgattcatttaggcccactaaaataatccaagataatcttcccatctcaagattcttaatttaatcacatctgcaaagttccttacaaaagcaacatattcacaaattgcagggattaggacgtggacatctttgggggatccatattctgcctatcacaagctatttccagactccaagtagtaaagagagttgaaattcaaaagctcatcagtcaccttttttcactgtcattccttttagcattgagttttaccttaggaaataggacagatgttttcaatacctaaaaccttaaacatagaacaattttacaaatgtcatgaaaccagaatgaatctcttggctgaaagtttttcaattttcaaagaactaattttaattttactagtaaatttgaaatggatccagcttgcctgctgtacttttatatgagacactaaatcacggttctttggaaacggcaacattgaaagcataaactgtcattttcccagaatgtgtggaagggcggatgtggttgatataatgtgtttcttaacacatcttttcaccctgagctcactcccaccatgtgtttatatgcactgcagggcatacagcagccttggtcggtgcacgtgttcgcaagtagtttcgcctatttctcaagcatatattcctacgggtgcctagcaaatgccttagctgaggacaaggtgtccaaggaataagtacttgctgctgttttccaacacacaccacaatttcggctgattctcagcaaagggcatttcttctactctgggatctgtgaatttgctcatggtttttaacaacctgcagcccggctcaagtcatagtctggatcccaatttgaaattagctacattttattagtaagtgtccagaaatggcttggcgggtcattttctgtcttgtaaaatgtggttcttattggcagtaacatgctttttgggcactgactcatgttctctcttcaagcaaatgattccttcaggaggcacacgctatatctaggtttgctgtgtgcaacacatcagatcctggccatagggtgacttagcaaaggtacaggcagtttattgcacacctatgtacacttcaggtcccgtgctaagagttttaagggcattatctcatttaactttacaaaaccctgtaagatagaatctgttaatcatcccattttcagacgatgaaagcaagatttaaaatgacttgcacaacctcatgaaaccgacatgcttgggctggactatattgagactaggtgagccttagtgattatacaccaggatcctctggtgagcttttaaaaccccccacccctggagattctgattttattagtcttgggtgtggcctgagcatggtactatcttagagcttcccagatagttttaatgtcagccaaggttgaaagccaccaagcaaaagcatgttttaagtggaagaaatttccagaagtttggtgaggttcaggtgtgtgtctgctcaagggatgacctgaacaagttcttgttttttcccttaattctttgactttatgaaaaatatttctgagaaaactttgacaatttataaacctctgaaaataaatcataaaaatgtccaagttaggttcttttcgtggtgttcagatgaccgaaaaatgagagacttagaggcatcagtaagtttgcagtcagagagaagaaagtcacactgcagggatggcttcacagttgtaacttggccaaaggtggagaaagtccctttctggacacagacgaagacagggcagtatggaagaaggagaaagggcgtggctttggggtcacacagacctatggttgaattcaagttctgttatttattaatgtgtggcctggaacaaattcttaacttttctgggtctcagtattttagttttttaatctataaaatagcaactatatagcaactttctcatagggtggtcatgaaggttatagtgggataatgtatgtatgattcctaaacactggtcaaagataactgcattttttaaaactgataccagcagttcttcatacatggcctttgcagcatacttacttcttgatttgctttcactataagggacccacctatcctaactatactccaagttagggcaggtggattctaagaccagccctgccactccccagaggcatgactttgggcaagtcacagctttgcagagccacaatttaagccttgtttaaacacttggaagcctctcctaacttcaaaaatctctaaaggagatctttttccttgcttggaatttttgatattcaaattaaatacatcacgagaacatctcatatcatgatttttaagagctgtaatttatagtgcctattatgtgcatatgcatgtgatagcatttaaagttcccaacaactatgggtagtacagggtagtcgatattcctatcctcagtaatgcgtgagggaacagattcaaaggaaaataatttatccaaaggtacacagttgatacattgcacaactgaaatttgaacttgattccaaagctcttggtctcaacatgcctgattccagagcactgctggttgttaaaacagccccgattatgcaaaggtaaacccttccatttgaggaccatgcaagctttttcattttcctcttctttcccacttcccaaattctc

SEQ ID NO: 467558 - DNA, 513 bp, Homo sapiens
aggaaaaccagagacccttgttcacatgtttatctgctgaccttccctccactatttccaccgtgcaatttcaaagcaaacatgggcaaattatggcaagtggataaaaccaaatcatctctaaagaaccctaaccctttagatcctcataagagccctctggattacagatgttcatcatctcattttacaaatgaggaaacagacagagactttaatgaacttacccaggactggatgatagcaccgggcttcgactctgcctggtgggagcgggtgaagggaagcctagaagcaggtctggggaaagagcctgcagtgctccatggggaaggagagacaaggtcgggtcactctgctcatcaccggaggctggcatgctgcctttctaacaggaccatccagctctcagcgctcaccgtcaccagacagcggctgccgagcagatggagcccgcacctgtgcatactctctgtcaaaaagacttcccagaagctgttgtgtcaataacaa

SEQ ID NO: 467559 - DNA, 1098 bp, Homo sapiens
cgaatatgattccagccttattctaaagaaacttggatgagggagaacaagaagcatttgtccttttgtgacagagggtcacagaaacaaggagccagggtgaggagggagtggaggaaaattatatgtttgaaggaagaagatggagaggcagcaaggatgaacattaaaggaggaggggggagagaatacagatctagaatttctaaattacccttggcgcaaagatctggtttaccactcaaacagtataattataaagttggcggatgtgtagctttttcaatcctggccataacattcttcttcatgctcttctcaatgtcctttctcctttcattaggtaaaatggagatgatccccagggccatcttggaaacagtttttgaagttggtagagtctcgggcccgcttaactgctgaaagagtaggaaggggtccgtttcattagcgcgttcaaccaaagagcgctgttaggtgagcaaaaacaaaccagttgtgtctgagccaacacccgtttgtctatgggttgtagcagttggtccacctaatcaaggaagtgccgagagcacaggacatgaaaagacacagcgctaaggtttcctgcaccacaaggttcctttcacttaaaaaaatttttttttatattacaccatctttatttgtaccttaccgtctaaggctatcaatcaaacttcagtaagaacagtttcagcatcaactaacgaacagtagccaaaccagagagcagtcaaaagtgttttaaagggagcagcatcagctgatgttctgccaagtctctgggtgttcaggaccatggtcccccggcacttccaggcccctgtgggctgcaggtggatccccaggagccaaagggccgctcaggaaagggtggaacttggcctcgcaatcagctggcttctgcctattatggtcatcttctttccagaggtcttgctatctcagtggacgtggctgtcatccagccgtcctgggctgttttctcatagaagaggatctccctctgaaaactgtgtcatccttcaattcctgggccaagtctggggacacatcttttcttaaagcttgctgaagctc

SEQ ID NO: 467560 - DNA, 1856 bp, Homo sapiens
cttctgctcttaacctcactcttttgtgcgcctgcgtccttgttctccttggctgtgagaccacgaacctcgggtgatactccagacaacgaagccatttcaggctgtaacccagagaatctggttcttcctggagtatttcagcagggatcagcttaaataggtctacttgaagttcacaactgccaaaaccgcgtgttcagactgaaaggctgggagcatttcagacgcatttatgaacttccaccaagatgatccggcaggctgaaatcgcagggagagcgtctgttcaacaaaccctttcttcttgattgaattagtgttacccactaacaggatgaggaattcccactccacaagctgactttttttcctctttccacctcccgcctccctccattaaaatgtaaacttgattcctgtgtcctttgccggagcctggcttccctgtaagcccatcataaacatcttgcctgcaagcagcagctggtgcccagcgtgcaaatgtatcactaccagcaccagaggttaacagatactacagctggagctgcagaaagagcctcctgaggagctggactctgcagatgagaatgaaagcagtgactttatggtgtacagtctggaccttcaaattggagggggtgaggagaaccctaaagcccaggcatcgatggggaattctggagacaaaagctaattaaagttcatttcaaacctgtggggagaaaaattctagacataaacctaatgtaaagaaacacataaaattttattggaagacaaaagaaaagtggaatgagcacacatatcatgtttttggatggtaagaataaaaattgtgaaagtgtcaatttttttctaaatcatctattaattcaatgcaacctcatgaaaaattacaaagggattgttttagtccattttatgttgctataacaacaccacagactgggtaatttataataagcagaaatttgtttggctcatagttctggaggctgggaagtccaagagcatggtgccagcatttggtgagagccttggtgctgcatcatcccatggcaggagttgataggacaagagagagggctagagcggcatatctgcagttgttcgttcctcctggtgggctcatggtctcgctggcttcaggagtgaagctgcagatcttcctggtgagtgttacagctcataaaagtagcgtggacccaaagaactcaggagcccagctggcttcacccagtggatcccgcacaggggctgcaggtggagctgcctgccagtccagcaccatgcgctcgcactcctcagcccttgggtggtcgatgggactgggcgccgtggagcagggagtggcgctcgtcggggaggctcgggctgcacaagagcccacggaggcgggggaaggctcagggatggcgggctgcagtcccgaggcctgccccgcaggaaggcagctaaggcccggcgagaaatccaccgcagcgccggtgggccggcactgctgggggacccagtacaccctccgcaaccgctggcccgggtgccaagtccctcactgcccagggccgttaggaccggccggctgctcggagtgcggggcccgccaagcccacgctcacccggaactccagctggctcgcaagcgcggcgcgcagccccggttcctgctcgcgcctctccctccacacctctcttgcaagctgagggagccggctctggccttggccagcccagaaaggggctcccatagtgcagcgctgggctgaagggctcctcaagtgccaccaaagtgggagcccaggcagaggaggcgccgagagctgtgaggactgccagcacgctgtcacctc

SEQ ID NO: 467561 - DNA, 606 bp, Homo sapiens
ggtttctgagtggagctgacacttctgtaaggggaactaagtgaatgtggcttccatttcacactcgtgctttccggactgataccaaatctatgagcctgagctctcgaactgtgggaatgggtatcctcgagtatctggcaggggaggagaatggcacagatgaattcaaaccaggaataccgcgtgcaggccagtcagccctgaaaggaaggcagttatcaaaaggaacgcaggcaaagcaggtgatagcagatgaaactcggcgattattttcaaaagaaccagcaggctctgaagtctgcggatgcttctctggcacaccccaaatcttcccctcacatccagtttggtgccaagctgtgcctgtcgtcaaagttcaagagacgattttgatgagaaatgacagtccggtgcctcatgagaaactcaggccggtgccacaggtgaaaactctgaggtcattaccccttctgaattttcctgggaaagggccttggagccactctccactgtgactgagaaactcaagaggagccattggtgtttcaggcttttaggggagatataaatggaggcctgactagtaaaacctgccacccaaag

SEQ ID NO: 467562 - DNA, 1217 bp, Homo sapiens
agacctgaattatttatagtcctccttttgctttacaagccctggggcaagtggttcaggctggcaggatgaaaattggcgtgccccctactatgctacctaaaaaagccatagcctcaccctggacataccttcttcttacttgtgatctgaaattatactatttttacttgtgtacttggctgttgtccagttttttccacttgagtatttctctgattttaaagacatttcccaaggaagtcaaacctgagcctgcaattacactgaggacccttgcaggggaggccaaggggcagtgggcacagaaagctctggaatgtgatcttcagccgggatctctgctttgggatgaacaccaagtggcaaacgggaaagctccagtgggtattcggagcccagaagattctgtaactgggctcttgagcccctatgctccagttgctccctctctgtggagtgtactttcgtcttcaataaatctctgcttttgttgcttcattctttccttgctttaagtttcattatgatgtgttttggtgggaatttcttttagtttatgctgtttgggtttgcccaacctcttggatttgttggattaagtcttttgctaactggagacattttcagccattatttatttgactcccttttcagcttcacattcttttccctctcattctggcagttcaataatataatttttttaaacttacatttttgttccataaatgctaagaattcattcattaaatttttttttagtttattttctttttgaataaactaaagttcaccaattctattctttgttgtctccactttaccactgaattcatacagtggggtttttttagttttagtaattgtatttttcagttctataattttcacttgtattattcatttctataatttcactataaattatagttttttttaaaaaaacgtttctgtttctttgccaagattttctattttatttcttcctagaaaatatgtaagtgtagaagcattttaatgatggctacttaatgttctttatctgataatcccaagtcatgattcatctcagtgctgctgtcagctgatggtcttttctcacttttgtgttttttatggttcttcctatcattaatggctttctgttgtgtcttggatattttgaatattatgcttggcagcttttgattctatttcaacttctgtttaagttt

SEQ ID NO: 467563 - DNA, 868 bp, Homo sapiens
gagagtctctgctctggagaaaagtcaaagtcaactctgttagtacaaggagaaactgcctgcaaggacttcagttatagctctatgagcagccttagaactataactaaaccttcagatgtctgttggattcactggatgcaggaggactcagggaaaataaatcatcctgggcagaggaagattaaaaaagagatgtttgaagttcagtccagaaagaatggggttctcattgcctggagcactggagccatctttgtggtggaaattgcagagagctcaggtcccagagcaactttgaagagaaacctggtgattctggaggacaacgcccatgtttctcaggcactctctgcaaatgtgagcaccgatagggcctttactaaggatgaagttgtggctctggatctgttgtcaatagatgtctcgtctgagagccacgtggctgctcaaaacccacagcagcgctcagagctgaaggacactcgactgactccagcaaagggggctgatgctccctgaccatttaagtgctctgccagctttagaagcctaagattctaaatatattgctggctttgtcgtgtaatcagatacaaaggtgggaccattcctattgacatttcttactctgagtctaagcataagaggtttgttgaaatagaaattggctaattagcatatttccatttctaaaaagtacattgacttcacttccctttgcacttgtgtgttctgcatgttttatgtggagtatttggtgaagactgtctcacaagaaggtcctagctttagcaacttgggggaattcttcagttgaaactccagtttttttctcaagtttacaaaagtacttttgtcatctatt

SEQ ID NO: 467564 - DNA, 1164 bp, Homo sapiens
gttcatacacgcaaacttcacggccagtaccaggcgaccaggatggtcagcgtttgggtttctttactgaagctttggagacgtagcgttcattgtcggcagaaggtgcaagagaaagcacaagagcagggtgttggtggtagtggtaatgacactgatggagacagtggaggtgttgatggagatggtggaggtgctgatggaaatgataggggtactattggagatggtggaggtgctgatggagacggtgcaggtactgatggaggtgaaggaggtgctgttggagatggaggaggtgctgatggagatggtggagaggttgatggaggtggaggaggtactgaaggagatggaggaggtactgatggagatggtggagatgttgatggaggtggaggaggtgctgatggagatggtggaggttctgatggagatggtgggggtactcatggagatggtgaaggtgctgatggagatggaggagatgctgatggaggtggtggaggtgctgatggagatggtagaggtgctgatggagatggaggaggtcctgatatggatagtggaggtactgatagagatggtggaggtggtgatggagatggtggagataccaatcacaagtcccaggttgttttacctgtgcttatgaccaaccactataaatcagggatcccacaaccccctcctctggttccagtaatttgtgagatcgactcacaaaactcagggaaatacttacatttacttacattcattataaaacgtattacaaaggatacggatgaagagatgcatagggtgaggtatgaagatatgacagcagaacaagcccatcaaaacttgagtgtctgtgtattgcaagaactggaattggtattttggggcctggaagagctgaaaatcaaatcaaatgcccaggtcattgattatgtcacatgcattgaacactgagaaacagtcttgggaaggatctcgatccttgtttggaatgtctcctgcataggagatagtgaggaattttacctgtagattaacaggaaaatgacttgcatccaattgcatctgtgaggcaagactttgaatatataaagagcaatgtttgcatacaatttatttttttctctacctaatgctctggaaataaggagctggaggagt

SEQ ID NO: 467565 - DNA, 594 bp, Homo sapiens
aggagattgtaaaactgcattagatttcagaatgagggggcatagattccatggaaacctgaaaaagtaccattatacctgtgatacagtcccagaaggaggctgctacctggcctgtcccagttccactccaaatgacatttttccatgttgggatctgcttgtccctggtgttaaagaatgtctcctgcaacacttgcaaatgtgggatgaattgtccagggtttctgcagacagaccaaaggtgatgatcccacatcagcaacaagagtcaggaggaagtcttcagaagcaggaatgcatagatccaagaaagggctcacttgcctggcaaacacctcgcggggaaggcactcatcctcctgagagcccagaggccaccagcacagaggaaaagaccctggttctgcccctgagtcagaatccaggttctgggacttgctcctgtctagatatgaacgagtgtcagggtttatctaaaactgtaggaattggaccccatgtaaactttctcatctgtacaggtcacaagtcacctgagattcctgcaaatcattcggatacctgggccccctcttgaggatttgggattag

SEQ ID NO: 467566 - DNA, 1058 bp, Homo sapiens
agtaacaagagggagtgggtatctagcaccacatgacctgacttgaagactaggggagcctctgatgagtatggtcaactgtccgttcccagagctttggtttcctcatgctggcagatcatcactgatgtccattccttccaggtgtttacggttgacgttcactgttctcttccacttgcggaagcagcaccattgcccctgggaagacctgcactctcccgagcacagagaggtctgctccgaggctgattccttccagtacttcctgggtccttgtcccaggaggagttattggggagagagtaatactgcctggtgggcttggaaagagaattccttagtctcctctcagtcccgcaggcatttggctcatgagataaggaaactaagacataccagcaaccagcgccagcattactggctgagaaatctcgttgacttcaggtcctacctgcatcactttcccatgtccaaaatatcaagaaacacattcaggaaacttaaaaaataaaagcaccttcttgagataagaaatattttagaagaagcctaaaaataaaatatagtcatgatctacatctgcccaggtgtcagattgacgtgtctgaattttattggagaagccctgctgcttgatcgcaggcaagaagttttaatctttgaagttccatttcttaatctataactgctctggccaatatggtaggcacttaccacttgaacagtactgtagggggaaaatacactctggacttcaaagatatagtaccaaaaaaagaatgtaacatatattatgaatatattatcaagcatttatcattgataattttaataacaattacatgaagagattattatattttggacatactgggttaaagaaaatatattattaaaattttttaaaagaatgcaatcatgatctgaatttagccagactgcccttgcatgctgaatgtaaaacaattctggatttgagaagagattaagtaggacccagtgaaatgctatgtttctgtgctaactatggataggtgagtccagagagagaaacc

SEQ ID NO: 467567 - DNA, 610 bp, Homo sapiens
cctggagaggaacaaggccatgcatgtggatctgctggagaatgaggctggcaccaggctctgtttccataacctcaggacaaggcggaagtcgctgttcacatgagagcaccttggacaagtgtcacatgggcagacagctgggccatgggttgggaacagaggtggagcacaggagtgtggggaattttcaccaggtttgcctgcatgagatgggaagccatggagttttcacaaggctgctttacctcctcagtcacgttgggaagaaacaaagaagtgcccccagagacaaaagcaaagactgtcccagaagctataacaaacttctttttacaactctttgtacagattcacatcacatggtcaaccacggctacaggtgtggaaactatacaaacaactaaattttctcctttgatgattttattttaaatccttattttttttttttagtccatctggaatttcttttggtgtaaaccatgaggtaaagctctaacttcgtgttttctagggtcaacctgttatcctggcacaacttagtaatcatctattcccctctaaatgaccttgctacctttatcatacgatactgaatttgggggga

SEQ ID NO: 467568 - DNA, 944 bp, Homo sapiens
tccacttccgcttaatgaatagaaaggattactcgcgcctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattgaagtcctcagcacatgttcttcatggaggtcatctttccctggactgcttggctactttagaagtcaaatcaagactagaagtatgaaagccaatcacaatttcccaacaattaggatccatcattcaccatttggttggtccctgctgctaagaattccaaactacaagggaaaaagttaaactcagctagatttccctgcctgctcaagaccacaaccccagtggcaacataattcttggtgaggatgaaaaaacgaaatctatacttgccttgagaaagcattcatgcaaaataaagcccagattcataagtaatctgacttcagcatcacttttcaaaacagtatcctgttaccagct

SEQ ID NO: 467569 - DNA, 850 bp, Homo sapiens
aggcagggctgtgcacagtcaccaccgctggatttcaaagttcctgaaccaagatcgtctgacctgttctccggctctttggcaggttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagagcagaaaataaaccgttttaacttctctttgccacatccaggagtcctctccttattgaagggagatacatcccaagacccccagctgatgcctgaaactgcagataatacctaaccctgtatatactatgatttttcctgtacatagataccaatgacaaagtgtaagttataaattaggtacagtaagatgttaacaatcaataataatgggataattataacaatatactgtaataaaaatatgtaagcaccttctctctgactctcaaaatatgttacattgataaaactaaccaaccactgctgagtgtaaatgaaaacttggaaaatgaaactgcagataagggggaactattgtacaagataatcagtatatgggtttgaatgtttgaatgactgaataatatgttaagttacctagtatattgtccctaccct

SEQ ID NO: 467570 - DNA, 874 bp, Homo sapiens
tcagttcctggggttggaaccactctgtttgctttagctggtaacaggatactgttttgaaaagtgatgctgaagtcagattacttatgaatctgggctttattttgcatgaatgctttctcaaggcaagtaaattaatcactaatgtttattacaagcctggtttgtgccaggtgattaacatgcttctaatacggttgctagtccttaccatggctgtgcatggcaaatactgttattcccattttacaggaagtgaaacagagaggttcagtgtcttgtctgtgctcacaccaccagtcacagaggagttgggcttagctctggcagtctctcaagggcgccctgtctactccccactctgtttgcacagctattggctttgctccatcaccagggacagaagacctggagctaagggaaagatgacctccatgaagaacatgtgctgaggacttctggtgaggttcagaggagaataaacagtgagaagaggaagggctctttgcaaaacttggcctagagctccaggcctgaaaatggtactggacaacctcaatatccaaccataggggagagaggaagtgaatcacaggtcagcttttggaaattattttctatctattctacaaagaatgtagattattgttatgaacagagcctaaccaataagctacatttcagatactttatagccactcatggctagtggttctcatgtttgacagcacagatggaagacattttcatcatcacggaaacttctattagacagcactggtttagaaaaaaaagacagtcattaattcactaatactttaagaaggattggctcttaactgtgggatcaccaatgctcttaagtctttgctgc

SEQ ID NO: 467571 - DNA, 600 bp, Homo sapiens
tcttaagaagtcctatccctatggggcttctgtcatatgaacgcttgttgcccgctgcgcgccatggccgtgttgctggcggtgctgggcccggcaggcagggtgggcgcctgggtccggccttgcgccacatggctcctgggcgcgaccaccccctgtgccccgctgcccctggccctggccctgctcctgcccaggccagatgcccggctgctccgcacagccgtggggactgccgcggcagccaggacctcagccaggccacggagagaacaggcagcagcgtcagctgcacagaggagaaaaagcaaagcaagtcacagcaactgaaaaagatttttcaagaatatgacactgttggcgtgtcgttgtacactggaatctcattcatttccttggtcatattttacatggttgtgtcaagtggtgtggacatgtctgcagtcctgctgaaactcggatttaaagagtccctcgtacagtcaaaaatggcagcaggcacaagtacctttgtggtggcctatgcaatccacaagctgtttgcgccagtgagaatcagcattacgttagtctctgtgcccttgatcgtcagatagtttc

SEQ ID NO: 467572 - DNA, 1484 bp, Homo sapiens
cggtctgccggtctggagcaccggacaagagacagtgaagaattatgatccctgaaagacagaaaacaaatgaagtgagtcctataatcatcctcattttcttcatggagacattttccaaaccacagaatatgaaggatcttgtgcaacaagagaggccagagctggaattggacccccttgggatctgctgtgggatggaggctggagagcccatatcgaagaatcagaggggcactttgtttcccaacacgtttcagcatagatgggacagttacctgatggcagcaggagctgagaccgggcctccttggaatctgctgttcactgccagaactgatgtcagcaggcaggtgagcctttccaccaagatcctagtatgtacaattcctcctggacctttggaagatggttttggttgtaggctcaaggccaaacagggctgtagtcaaagcccttgtgggactgggccatttctgtgcttgaacttgggagcacactcaatggattagctacctggctgttggtctgcaatctcaaaatgactctcataggtcttgggctcactggggtttcacaaactccaacccgaataatgaggctcctgcagagagacttttgactgtgaataggtatagaatccttattagggggttaggagcgcattaccttctattccaccatcttactaatgtccaattatacttcttttaaaacacttttaaatggttgccccagagtttgtaatacacatttacaacgaatacaagtctactttcagataacattattctgcttcagtggtagtgtaaatatcttataagaataatgtattcctaattctgtccttcattcctttgatcatttctgctatttgtttcacttatgtgtaagctataactgccaaatatattgtttttatttttattttgaacaaactgttatctgttagataagaataaaaaataaaaattttcattttacctttacttattccttctacagtgctcttcctttctttacgtagataggagttcccaacctatatcattttcctcctctccaaagaacattaagatttcttgcaaggcaggtctgctgccaataaatcccctcaatttttgtctctttcacttttgaaggataattttgcaggatacaaaattctaggttggtgttttgaactctcaacactctaaatatttcactccactctcttgttgcttggttagtttctgaggatgagttgaatgtaattcttatctttactcctcaataggtaaagtagttttctcctttagattctttcttgtttttctctttgtttttctgatgtttgaatatgaggtgcttggtgtagtattattattataattactgacatttatcctgtttggtattctctgagtttcttgggtctgtggtttggtgtctgacatcaatttggggagattttaagtcattattgcttcaacaatttcttc

SEQ ID NO: 467573 - DNA, 618 bp, Homo sapiens
ggccagttactcctgcgggccaaagccatgcggctgctgtactacctgaagaccgaggaccctgagtacgacgtgcagagcaagcagtggctcacccatttgctcgatcaatttaccaacattaagaacatcttggccttgaaaaaaattgaggaaggtttagaccttcgaaatctggcaagtgacgattcctacatcacaccatattttaacgtagaggagaattatttttcagattatggtcccagggttatggttattgttactaaaaaagttgactactgggataaagatgttaggcaaaaactggaaaactgtactaaaatttttgaaaaaaatgtctatgtagataaaaatcttacagagttttggttagatgcatatgtgcaatatttaaaaggctggtcttgaactaccgacctcaggtgatctgtatactggaaattttaaagccatgcacatgctcagggcaggacacgtactcagaaaagaactgcacaaactcaaagctttaacctctggctaatcactacagtccagcaggaagtgaaggggatgctgtggctcccttggggtatgcctaccaaggcgatgcttccctggggtacttctcctgta

SEQ ID NO: 467574 - DNA, 1249 bp, Homo sapiens
taatgagccatgatcatgccactatgctccagcctgtgtgacagaaagaccctatttcaaaaaagaaagagagagagagagagagaaaggaggaaaagaaagaaagagagagagaggaaaggaaggaaggaaggaaagagagagaaggaaagaaagaaagaaagaaagaaagaaagaaagaaagaaagaaagaaaagaaaagaaaagaaaagaaagagaaagagagaaggagggaaggaaggaaggagaggaaagagagaaagaaagagagagagagaaaaagagagagaaagagagaaaagaaagagaaggagggaaggaaggaaggagaggaaagaaagaaagagagaaagagataaagaaagaaaggaaagagagagaaagaaagagagagaaggaaggaaggaaggaaggggaagggaaggaaggaaggggaagggaagggaagggggggaggaggaggagcaggaggagaaggaaagaagaagggaggaaggaaggaaggaagaaaggaaggaaggaaggaaggaaggaccataaatacccgaaagagggagggaaaatatatatatattccatatatattccatatgtatgtatattccatatgtgtattccatatgtatgtatattccatatgtatatattccatatgtatgtatattccgtatgtatatattccatgtgtatattccgtatgtatgtatattccatatgtatatattccgtatgtatgtatattccatatgtatatattccgtatgtatgtatattccatatgtatatattccgtatgtatgtatattccatatgtatatattccgtatgtatgtatattccatatgtatatattccgtatgtatgtatattccatatgtatatattccgtatgtatgtatattccatatgtatatattccgtatgtatgtatattccatatgtatatattccgtatgtatgtatattccatatgtatatattccgtatgtatgtatattccatatgtatatattccgtatgtatgtatattccgtatgtatatattccgtatgtatgtatattccgtatgtgtatattccgtatgtatgtatattccgtatgtatgtatattccgtatgcatatattccgtatgtatatattccgtatgtatatattccgtatgtatatattcccttctaggatctgtggcttgattttttcccatcatatttggaaatttttctgcctttatttcttaaaatgttttta

SEQ ID NO: 467575 - DNA, 1432 bp, Homo sapiens
aactaacgctccactttgacctcacacaatgttctaccaagtggagatggggcaaggaggtgggaggaaggacaacaggaaagatttcttcacctacaagagtgtggtctgtggacgagttgcaccacgttgcaatcagaagatgttaaaaatgcagactttgcaaaggctccaattcatttcctccatgaagaataattccaaaagccagtcaacttctctagctcttctcaacagtggaagacagataggtctgaaacggttgcaattctcacaagtcagccttcctctgaatttcccacatggaaaactacatggcagggaactatcaggcaaggctgcagatgcctctaagctccagtccttccagttcagctggctgcatgcaaatctagaacacagtcccctattcctttctccacataccaccttccatcccatactggccttcaagagacactagaaaagctgctgtatcttacttcaggttaattactgctctgtgtcctctactctctgcatgggttgcctagaagcggctgttttactttgctaatttgaggatttttgtttggatgccttagagtaagtgacaagagaagagaggggaaaagtttattttaatgctgctgaatttaatgacaagtaattggttccacaggtactgtattcattgacctttttccatatggagctctcagaaaattccattgctattgatcccctccgattttaatgctataatgatgttgttcccacacacaagggaaatgattatgtgctgtgactgctacactttgaattgtgtgaataattgtgtacatatttatatacatatctttgttgtcctagtggagttctcaatgcacttgaaatggtttgtgaacgtcttttctaaatcccctccagatgtgtcaaatagcatactgtaaatcagacttttctttccatttttttctttttcctttggtctgctggtatttggttttaacgtgccaagcattttggattatacaaaggagattactatagaaggggtttgttctctctgctgtttctccttctcttccaaataactcttttcaatgtaagaagtcaacaagcttcctgtgttattctttggatttctccctacaacattaaaacctttgtctaggccagaagaagagttgaggaggctccctccagcctggcagccagctttcagtctcccctttccaagtgaagaaataaattaaagctgacacttggagtgtgtgtatgcctgctgcctttatgtttgtactcgaatgagcttatttattttttgtccattgcaaaaagatttatgacccttaattatgaattctgacactcttgtgctacatggatgcgcttagattggtttttcactttctgatggctttgaaaagctttccttttcaacttgaaa

SEQ ID NO: 467576 - DNA, 825 bp, Homo sapiens
tgtttgacctctcatctcctccatcacttctgtgaccaattctctctacttgggaagctgacgtgagaggatcggttgagcctgagaggtcgaggctgcagcgagctgtgacggcaccaccgccctccagctggggcgacagagtgagaatctgtctctaaagaaaaaaaaaaaagcagcgaggcagcggaggaggatctgagaacaatggaggaacaagtcagaggaacttggggtgagactgttcagggagggagcaaaggaggagagaggaatggagcaacttcagagagtgaagaagataatgagctggactgtgatcccctgagggagagtcaagggcctcagcattctgaacgaatgggatcccacagcagggccccaggatgtgcatttactcactgtatcccagaagctacttcgtctaagtggaattataagacgtctgtcattttgtttggcttatgtcacttagcacaatatcttcaaggttcatccatgcggaggtctctgcccactcagcaattgaccacatttgaccttttgagcttgggcaaacttggaagaatgcgctggcagggagttaactatatggagaaagatgactcaggatccattttcatccttgcctaccataccttaaaggaaaagaaattttcctaattgtggttatttacagcagtgtaaatcaagcaaatgccatgaagtgccaatacaaattttttaaaaatcagccttaaatagctaaactctcaacagcagctcataaagtgaggcttggcagttgttaggtagttatggttgaattgacagtcctttggggaa

SEQ ID NO: 467577 - DNA, 1466 bp, Homo sapiens
tttcgctacttatatttgcggtaatgttaggaagcaaagtatcatcaatcagagaatctgtgcgaagggaaaagccccgtctgctccacgactgcaaggccggcggatctgggagccgcgcccggctccggaggactcggcgggcccggggctccccggcagcggctcctctgctaggggttaacagcagcccccgcggccgggcgggcgcggacgcttcctctccacccgcccgggaacgtggataccgcgcccgcaggatgttcgccggctgggaccggcagtcaggaaacatgagaaggcctcgctattcctgttcccgggcggcgcgcgccgggctggcgcgctggagcccgcgtggagaacatgcggcggggatgggagtgcgcctagtctcgaggcgggagagccagccgccctgcagccggccgtcggccccgcagccacagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacaggtaagtccgtgctttctgtagtaattcctgcgatacctgtttaaagcacaattaaaactgcatcagagggatttattttaacaggtataaagacatcaga

SEQ ID NO: 467578 - DNA, 1165 bp, Homo sapiens
atatgatatgatatgccttaagtttattggctttgtaaaacctgccacttcatcctgacaacattttggatctaagaagttataagttgaacaactcagcatcagttgtttttacactgaagtgttatttaaaagaagcagatacagtcaacttcacaattttatgaacacttaaaaaaaatgaattgacaagaagagacagagtctcactctctcccaggctggaatgcaagtggtgccatcatagctcactgcagcctcgaactcctgggctcaagggatcctcctgcctcagccttctgggtgactaggagtacagagctccagagcaccaccccactgtgcctcattcaggaagtgctgtgatcaagaaaccactactgctgctggtgccaggactgtgattcccatcaacagcactgatggcctgcacctcacctctgacacccatgggactcttgtatgtggacaccagaaagtctgctaattctggaacaaaaacctgaaatgtctccatgagatggactgctgaaagaaatagaaaaccacagaggtgaggcctccaccgtacttccaaatgctgtattgcacatggaatgcatttgatttgtcagatcaatcactttcagaatccaagctgcaaaggagttttggaaacacagaccagagttttccagcctctgtcagacgagaaggctaaaaaagattggaatggatgatgggcattcatattcacataaattcgacttctatatatgtgatgatgaccttgctctgttgcccaagctggaattcagtgggaaggtcgtcctctttgaccaagcatgcaatccatctcttgaacagaggagtggtaaggaatttgtggacatatttcagaaccaccacaattgccatcagaggacagtgaataaagaatgtggagggctgggcctgccgttctggctctatttggaagcccgaggctctggacagcaaaagagtgctcaggaagtaccagactacctgaggcattttactggcttcctgcacaggcaccccattaagtatcagccctgtgggttggatgacatggatcccaccatgttccagtctacacatgacccaagcaagtcagcataaatccatctccttactagtgcctggttctccagggatgaacaca

SEQ ID NO: 467579 - DNA, 942 bp, Homo sapiens
gcggctttccacagtgcattactcaagtcctagcaggcccctgaagtcacccctatcatcacccagtaggctcatgaacaaagtggccgtggtgccagggatggaggtgccagggatggggtcagagaaggaggatgcatggactcagcagcatggacttccactcaccaaggttgagctggctacagttgctgagtacccagtctgcctgtggcagagattaacacttaagtccccaatatggcagcattcccagggtgatcagtcggatgggtggaaagttgattataatggaccattttcattatggaagggacagcattttgttatcaatggaatagacacttgctctggatgcaaatttgcaattcctgtatgtagtgcttctgccaaactactacctatgagctcacagaatgtctaccatcgtgatattctgcacaggattgattctgaacaaggaactcacttcagagtgaaagaagtgcagcaatgggcccttggtcgtggattttactggtcttactatattagccatcatcctgaagccgctggcttggtagaacaatgcaatggcattttgaagactccatcacagttccagatgggtaggaataccttgcagggctggggcaaggagctgcgtatgggtgccaagttgacacaggataaatttgtgatgggttattttatgtgtcaatttagttcaagatgcaattgtccaataattatcctgaagactgccataacgctctctcctgttccttgggctttttgtctctggggctggagctccctggaacatatcctggctggacagcatgtttaacgagctaagatttcccccttttacttttctccatagagctgctcctgattgattttataccaaggattcttcaaaatttctggtgcattgattagactttttttttcccatac

SEQ ID NO: 467580 - DNA, 486 bp, Homo sapiens
caggaaaacggggctgcactgacaccgcctcaaattccacatggctggggaggcctcaggaaacttacaatcatggcagaaagcaaaggagaagcaagacaccttcttcacaaggtggcaggaaggagaatgaatggaggaggaactaccgaacacttgattcctgttaacctgcaagcccatcatcttgaatatctcagagtaaacagcaccctcttcgtctggctccacatcaaatcttcactctctctcaatgaaagccttacctacaacctggctggtcttgcagcctgcccaaccatggctacccgttctctcctacctcacacaactctgcacaaggctctgccattttttcccctccttgccactgtcatccaccagccagcctccagcccatcccactcactcattgaaggtttggacgactggctcacagttgctttacatctcatttcctgctgtcatgtgatgtgacctcagtgt

SEQ ID NO: 467581 - DNA, 774 bp, Homo sapiens
gggagccagcgagggtcctgacagcagctcactggacaccagaagacgccaaaagcagacaagtcagctcagagtacgggggtgacacagggtgcaggctgctagcacagtgccgccccatggcccagggctgcccgtgctggcaatgctcttgccagcaagaggcgagagttgttgaggtctgcagacttgggggcaagtgaaggcccaagctgcccgagaagagcaggggtgtcccatggggaccacactgaactcttgcatgtgcaccaaagccagccccaatcatggccggcacaagggttctgcaggaccagcctgtggctctcatgtctaccagcgtacagacagcaaagacacacgacacgatatacaggagcagaggcgcccagaacacgctgtcccccaatgccagccacaagcggggccagctcagggtgtagtgggtgaagccgtcctgcagctctgtgatccacaaggcggaggtggcagtagcacaggactccaccgctttggaggctgcccagtcgaatttgggagccaggagaggagcggaagaccttctggtgtgggctgggcagcaattcacttgaaggagaaacagcccgggtgtggagaggcggctgtccttggagggatcctttctaaggagccgagaaatcaacgtagagcttcctctatctgattctctaacaactgcagaccttccatgagtcaagctttgtgtcaaaaggacaaattaaaaggcaagaaaataaaatcataataccagga

SEQ ID NO: 467582 - DNA, 567 bp, Homo sapiens
cggaatatttttaaataaaatgtgtcattttttaagcaagagatcttactctcctcatcttcaaaatgaggagttatttcagtgctgtgaaaaatccagatttttgggtctatactcatcttgctgaatcagcgtctctagggctgtgctccaacaatttgacttttaaccaaaggaaggaagagtttacctgccacttcctgggggtgttgctggaacaggctctggacggtcaaccctctttgggcattgccttagctgaagaaaatctctctcaggatttgcccccttccagggacagcttgcagccagtgactgatcaattggaggaccggctggcaggatggaaactcagacagcatttccaagttacagtcttgaggcagaattccttctctgagaaacctgtttttgctgtaaagacctcaactgattggatgagacccacctataataccaaatgtaatctctttcaggtcaactgattataaatgttattcatatttatgaaatacctctgtagcaacatctagactagtgtttgcccaaacaactgagcattataat

SEQ ID NO: 467583 - DNA, 571 bp, Homo sapiens
ttgctctccagacaagacaaaattgtgcctcttgaaaagcatgatgtcagaatgtgccaagatcagcaaagataaaatcttggcacagaattcctccatcctgaggggcaaggagacaggacccaatgacaggttttccaaacgaccttctgcagctgagcggtgggtgctcaccttctcagcaagttcagttgccctggaactcctaggcaagcagaaaactctggaaacagaaaccatgaaacctacggagttcccagaggaaactggaccacccggaaccttcctaaaaccagtgataactgaccaaattacaagtcaggaaaatggaggaaagaacagaagaaggatgaccatcctgaaagctcccaggacggctgagaaagacatggccagggccctgcccctgatcttctgcgtcatgcatcatggttctccagtagctcctactcttcacaaccagtgtgactggacagccacgtgagaatgccatttccctggccattcatgagctggaatccagtagtcactcagaaaatactaattccttgtcccttcctttcccatcaat

SEQ ID NO: 467584 - DNA, 692 bp, Homo sapiens
aaataaataaataaataaataaataaaatcagctgcagcaggatgaatgcttggttcacaggaataagcaggtctcaggacatggcaccctgcatcccagctgctccatctccagctgtggctaaaagcagccaaggtacagctcaggccattgcttcagagagtgcaggccccaagccttggcagcttttacgtggtgttggacctgcaggtgcacagaaggcaagagttgaggtttgggaacgtccacctagatttcagaggatatatggaaatgcctggatgtgcaggcagaactctattgcaggagcagagccctcatgcagatcctctgctagggcagttggagaagaaatgggttggagcccccacacagagtccccatgggccactgccttgtggagctgtgagaagagggccgccctcctccagatcccagaatggtagatccactgacagcttgccccatgtacctggaaaagctgcaggcactcaatgccaacctttggaagcagccactgggactgtaccctgcagagcctcaggggtagagctgcccaagaccgtgggagcctaccccttccatcagcataccctggatgtactgtgctagacactagaggtagacatcattcctgccatcatggaacttaactatatcgttctaaagaaatcggaacattagtattttg

SEQ ID NO: 467585 - DNA, 609 bp, Homo sapiens
ctggtgtgtcatgcctaatgacgaagctgaaatcagaacccaagtcactgggtggccagcccagtgcccagtgccacaaggtgaccagtctcccgtagtactgacttccaacactatggaaacaaggggaggagaacaggggagaggaaggagcatccgactccacagcgggagatgggctccgaatttgtggctcacaccctctcttcaacagcacagagaatgcttcgccctgtttatctgccctgaacccttaggttcaggttgtaatgaggtgcaaactcacgaaactcatccaagtggagcaagtctgcttcctttagaagaggagggcgggaagaaggaggagcgaaaaggtggtaaaactatcagaaagtttgcaaatttctgtcgggctgcattcaaagccgtcctgggccgcttggagttggtagactgtgggttggacaagcattctttagggactcaacttttagcagatgtcaggatggttgaaggcccttaaccctacaggtcatttctgtgtatgttgttgttataatataatccgtactaagcaaacatcatccaaatctttccaaatagttttcaagaagatatgaatttatt

SEQ ID NO: 467586 - DNA, 529 bp, Homo sapiens
atccgaggtctggaactgcagattggggcttctacctcggcctccagcagagctgtctggtttgtatgccccaccctgacttgtttgtcatgcagttgtgtttgaagaaatcgtcctccgttgaggatgctgttggcctgctcactgctggctgcctgctgggatttcacagtccttgcccctcctccagccagacctgtgactttgctatgccgggctctggtcacagtggccacctctccggtcagggtgtataccttcaatttgttctggaaaaagtccccataggcaccctgggcatgtgtgggaaacccaagaatgccagggtatgtctcagagctcagctcagccattgctcccattcagggagacttgtggaggccctttctttgtgtccagtggaagataccaaaggcctgtgtgaggaagggggtcacccagccgggacaaaccatttcatcgcatctttcctgaggggttagaccaggcaggacaaagccgtgggtctcgagcacattccttgtcctgc

SEQ ID NO: 467587 - DNA, 538 bp, Homo sapiens
tcaggtggaaaacaggatattgcttttctcctcacaaaccacaatgagctgtgggccactgtttttaatacaaagggagatgctgaaaaccaggcccaaattggattgtaaagatgtggaggcacaaggtcctgggaaggagtggaaactagagcctgtgatgaggccttctgggactggcaggggtgagggtgggggttccctgcttgataggggagggcactgtcccattgcctggagaccttgtagccctccccagggccagatgccttgtgagatgatgtgtactttccccatgatctctcttgccttccctcatagctttatgccagtaactggcatctttacacagcctgggctgagcagaaaagcattgtccctgctactggaagaaaggagttattctcctgagtgctgcagggcctgcctcacggatactgacagggactgggtagaatgtgcctgggaatggatcgtgagggaggttgtgaagaccagggaggaagaaggataagcctgggcagtggagagctcattg

SEQ ID NO: 467588 - DNA, 572 bp, Homo sapiens
aacgatggtgaatggcagctaaccatggcattaggaccatgagcctggtcagagagatacaactgatttgtacacatttattatctagcacttcattgggacactactgctctaaaggccctggccaaataactcccaaacgaaacactcaacccaaagttgttttcagcccactgttaatgaagctagctgcagaacgcaaggcctctaaaaggagaggacacaaagtcaggcgagtaggggccattggcaatgctcagagccagccagactccaaacagggagcccaagtggtttctttctgggacactccacttgattattgttcaattaagcaactgactgctcttgactgtcccttccccagcaatagcactgattgtgttgggaaaagccacagagcaagactgcacagccagatggagatggaggagagtttaaaggcaaaataccaaaatggctctctggtaaactcatagctttgaaaattacattgttctaacttttcctccttatgttttacaatgacctttgtttgaattgtattggaaagtccaaaatagccactgacc

SEQ ID NO: 467589 - DNA, 1087 bp, Homo sapiens
gcctgtgtcctatagcaaacattctccctgctgctctgcatgctgagacaatttatatccaggacagtgatacactgtataagttttgttacccatacaacgggtccctttcacctccccttcaccctctgccatgagtggaagcagcctgaggccctccccagatatagatgccagcaccatgctttctgtacagccagaagaactcatcttctcccatcacattggcatagagttcttatatcagatggtagaattaaagattcagtttcccgttcaaggatttcaggcagcaaactggcgaaggagcacatatgaggaacatctcctcgtgcagatggcaacccaagttcggccctgctatatccacaccctgggcacacatcctggacacagttggggatcgtctggggcccacacatgcaggatgtcagaatgtgccaagatcagcaaagataaaatcttggcacagaattcctccatcctgaggggcaaggagacaggacccaatgacaggttttccaaacgaccttctgcagctgagcggtgggtgctcaccttctcagcaagttcagttgccctggaactcctaggcaagcagaaaactctggaaacagaaaccatgaaacctacggagttcccagaggaaactggaccacccggaaccttcctaaaaccagtgataactgaccaaattacaagtcaggaaaatggaggaaagaacagaagaaggatgaccatcctgaaagctcccaggacggctgagaaagacatggccagggccctgcccctgatcttctgcgtcatgcatcatggttctccagtagctcctactcttcacaaccagtgtgactggacagccacagtaaatatcgtgttttttgcagtctggaggatggttgtatatactcagaagaccctggaaaccgtgagtccagagtggctggccaccccagatgagattattcttgatcccagatttcactgaaggaaaccaaagccaataggctgtttgggggctctgcacgtgcgcgtgcgtgcgtgcgtgtgtgtgtgtgtgtgtgtgcgtgtgtgtacgcgcatgtgc

SEQ ID NO: 467590 - DNA, 439 bp, Homo sapiens
acaagattaatttgccataatgaaggtctactccttccccttgatttctttgttatgccatgtgacaaattctactgatgcaggttctgagcagcttcctgctggggccttgcctcatgcctttgcctcacacctctgctggagcttccagagtctgccctggagcttctctaagccatggacagccctgaaacatctttcatgcaactcctcaggcagcccagaaacagccaggaaccattcgccaggagctgtggccaacttaataactcatccttggagagtgctgagtcatgatgtcttggcaacagtcacagcaggacccagaatggagtttacagtgcagatccagcaactggttgggaattctggccctgtgcttttgtctgctaactttaacttggccctgtgttatttttccaagccatatttttaactt

SEQ ID NO: 467591 - DNA, 888 bp, Homo sapiens
gaagctacgcctgctcaggactgacggcactgatggcttttcagagatattcctgctggccaggcacagtggctcacgcctctcacttatgcccaagatgtgcaacataaggaaacaaggaaagaagccctggggtgtagcgggaaacaatctcagagaaaacctaaaggcacccaaaactgaaaccctgcaactagcaaaaggacctgatgtgttgcaggatggggacagctgggagcaggggcagaacggtgacatcaaacaaccaaggtggcctctggggctgtgttcatgtccatgggaaatgagccaccaagagtccagcacattcttcattccaaaagtggtcagtgaccagcaagagataggtggactgactcgcccaaggttgttggcaaaatccattcaagtccagcacttttttcttctcttccataatgctcctgtcactggtgcctgccatcatcccggagttcatggcccgagactggcaaacgccggccagggcgttacaagcatccatgttgactaattgcacccaacatcccaatatcttgccagtggtacaaaaggaataggtttacttactgtgccaagtttcagagctgagcaaatttttatggtctagttataaaccctagaaaaacaaggtttataggaaatgttgacacaaccttaactaaagtggtgctagctgacacctctatattttcaatttggggatttctactgggaaagtataaacgctaattcagcaaaggaagccaactataataaaaatgttgtagtcttcctgttcaccccatgaagttctacttcaaaagatgccagtgcaacgtggaggtgagttagagttagaatgatcagcatggagagcacctgcaaatc

SEQ ID NO: 467592 - DNA, 543 bp, Homo sapiens
tgcagtaggtaccgccgagcagcatgtctcccctggcatgcctgttggagcaagcagcatggtggactgttcgcctgccagcttcttttacatcacatgatctcatgcaccacaggggctcagccctcaataagagcagaaactatgcaaaggagtccaggtcttggaatgatggcctgaattctcctaaatccgtaggattaactactgcaagctgggatccatcagttggagaaggtgagtggtggagaggtggggaggtgaaggaggagcagagtagaggcaacagaagaattcaggagaaaacactacctatgcttgcaaagaagatgcttgcaaagaagatacattctggcgatgcacttaagcatcctccactgaggtatggaggcctagagaagggaaggtgttatggtttaagtttcaggcctgctcaattcaatctcaaacttcaagatgtctgcgtgaagtttctgaagaaatagaaaccccttactaactcagataattaaatggtataaataccgcaccttagaagacctt

SEQ ID NO: 467593 - DNA, 2128 bp, Homo sapiens
agcagctgcctggcttcactcctctttgttctctcatgccctataattttttttttttgaaagctgtacctgatgcattggataaaagaaactaagaggtggttcacactgttctcacaagggctgctcccaatgtttggtactcacagcccacctttcatggaggttcatgtacatgcgtgtgcttacatcttcagcaacactgagcaaaagccattgcaaacttcagaaggactgtgcctcttctgggaaaaatgcaatacactcagaatgaacaatacttgtttggaaccaaatgtaggtttatatattcctcctgcatatcaacagcatcatcatgaccatcatcatcatcatcatcatctccaccatcgtcaccatcactgtccacaatttttaaagttatttgagacttgcattcacagttttatatctgattataaactgtcttttgaaaaggaccaaagcaagacaaaatgtctgtggaagacaaaagtctatagccactattaaagctacaattgactagtaattttggttaattttgtggcatacaacaattttacataacaattataattattaataatgtacactaaagtatattagaattatatgagttacccataagttttagaacacatactaataacatatttatacaaatatagtttaaagaaaaccaaacaccattcacttttttatttgaaagttttctaatatcataatctccagagttattaatcagaaacttgcatttaagagtacgtattaaattttatagctgattataaaaccattttttaagaggaccaaaatgagacaacaattgtctttggatgacaaaatcactttagggcagccaccgttaaggacaggattgacaaggaaattagttacctctgtggcacacaaccatttaacataattataattattactgacaacatatattaagtcatattagaattataggagttttacaaaattttgcagcatatgccaataatacatttatacaaatatagtccaaagaacgctaaacaccatttaatatttgacaatgtttcctgtatgatttttatacagaataagccaaatgttatttctggactttagaggacctaatatttaaaagattaagctagaaagagacataatttacaatttgattttggaaagtttgtcaaatatcaaaagtttagaatactggatatcacgaaatagaatctcaggtcaccataagtcattcatttggccaaaatgataatttcaaaatcttaaaaagaaaaacctttactctgatagaggagacttagctttccaaacaagacccaataaaaataacatgaggctaactgaaattgtctcttttttctccttcctttttcccctgccatttacccaaaggagaaaacaaaaatctttcattattttttaatattacataccaattgtcttcaaaagagaaaaccaaatttcatgctggcattagtgcatctttaatgttaaagctagttttttaaaataaaattttatatcttcatccagttttaattagtttgaccataacgtaacattttcataaactttttagaaccctttacaattttccatcaaatagcagatcagtttttaagaaaaccctgttattcggacacatgggcccagattctggccccatatcagtgtgattttaatgttttaacctgcggaaaaagctaattttttttttaatcttagccaacttgtttttacccacagaatttttttttcaagattaatcctttataaatcctttttattttgcttaaaccttcagttttgttctattacttttttaattgaagaaagtctttaaaaccctttgtattagacaaaattacattccctttaacaaaaaccatattcctatgcctttttataattttttaccaaaaacacattccttatacaccttgtatgtaaaactgtctctttagtaaacttaatttcatgttataatgttaactcttagcaacttttatttttagtgaaaaacctgataagtaagcgattttaattatatactggggtagagctagggcatgagacagaagtgaagataaagtctggcttttttcagcat

SEQ ID NO: 467594 - DNA, 658 bp, Homo sapiens
tttaggttaagtgacaccgaagtgtgcatagagaactcaggaacctgtctcggtgaggttgtcttgcaggcagaagtgtgggagtggtttggagaaagaagcccgtgctttggttttaaacaggcctgcttcccactctcacatcaaccatttggcacctgactggtcaggtacagccagggccagagttgaagccatgacaatcccgttagacccacatgcaaggggacttcatggggaagcagaggtggttaaagaagaagagaatggaggacagcctcttgacttcctaggcttcactggaccaaagcctaatccagaacaagaccctacccttttcaattttgtgaaggttgagagagatgaggaagctgcagaagaaaagtttgaacctagcagaagttggttcatgaggtttaagaaaacaagctgtcttcataaaatacaagtgcaaggtaaagcagccagtgctaatgtagaagctgcagcaaattatccagaagctctagctaagatcattgatggagatggctgcactgaacagcagattgtccatgtagatgaaacagccttctattggaagaagatgccaggagatgtatttggtgttcctacgcaggaatgcctccactgaatttttggatttattctcagtcat

SEQ ID NO: 467595 - DNA, 1267 bp, Homo sapiens
gcgcagtgtctggcactttcatcagctgcctccaacacttagttgatacaagaaaaagcagtatctggggagttgatgggcttcaagatggaaaaggacctcactacactacagaaaatttatgcaatgaacctttctcccatcctttcccaaggagatctcccaaggagatttactggagtaattgagcaatggggaaagggaaatgatcagacatttcaaaaactactggaaattggctctgagctgatgttgattccaggggacccaaaacatcactgtggtcctgcagttaaagtggggtcttatggaggtcagataattaatggagttttagcccaggtccagcttacagtgggtccagtgggtcccctaactcatcctatggtcattgccccagtgccagaatgcataattgtcataaacatacttagtggctggcagaaaccccacgttggctccttgactggtaggaaaattggtgaagaagaaatttggagaagaggtatgtggatgaaccatcctgagtggtcaaaaactgtgaagatatttgtatcccatgtgagtgctcaccaacgggtgaccttagcagaggaggtgtttaataatcaagggaatgggatgatccattctgtggacatcactcaacctctttccccagccacccctgtcatcccccaatgggatcatgaacaaagcggccatggtggcagggatgaaggttatgcatgggctcagcaacatgggcttccacccaccaaggctgaactggctacggccactgctgagtgcccaattttccagcagcagagaccaacattgagccctggatatagcaccgttcctcagggtgatcagccagctactttgtggcagcttgattatattggacctcttccatcatggaaagagcagaggtttgtcctcactggaagagacacttactccagatatgggtttgcctatcctgcacacaatgcttctgccaagattagcatccatggactaacagaatgccttaccccccatcattgtattccacacagcattgcctctgatcaaggcacttactttgtggctaaagaagtgtggcagtgggctcatgctcaaggaattcactggtcttaccatgttccctgtcatcctgaagcagttggattgatagaacggtggaatggccttttgaagtctcatttacaacaccaaccaggtgacaatactttgcaggattgggacaaagttctccagaaggctatgtaagccttca

SEQ ID NO: 467596 - DNA, 492 bp, Homo sapiens
gatgtactgagatggcttaggcacaccggctcccaaacctggctgacctctcatgcccacagctgtggaagctcagagatatctgcgggcagccctgggtcatgcacaccagagctctaaggtttatttaacacatgattcaatgatggctctcccttcctcagcccccagctattcctcaaaagacagaagccacacaaattcaacaactttaaatagacatcccccgcaggttctctgcacagtctactttgttgctttctcagcaagctccatcctgtccacctgcttcatttctccaggaaacccagtttgtgactctcctctgatcaaccagcttcctcttctagaccttcacttaccatccagacctcctacagctgtggcaagtctaaatcctataataaatcctttattccacagtactcattatgaatttccttccctgattgaaccctgactagtaggaaatgaggaggcctctatatgccc

SEQ ID NO: 467597 - DNA, 611 bp, Homo sapiens
gatccttgatcgatcgccacactgtcttccacaatggttgaactaatatactctcccaccaacagtgtctgctggagttttctggaggcccactccagaccctgtttgcctgagtatcaccagcggagcctgcaggacagcaaagattgctgcttgttcctttctctggaagctttatcccagaggggcacctgccagatggcagctggagctctcctgtatgaggtgtctgttgacccctgctgggaggtgtctgccagtcaggaggcacggggtgctctgtcccagggagatgggagatttatctataagcccctgtctgtggctgctgtctttctttcagagatgcccttcccagagaggaggaatctagagaggcattctggctacagtggctttggtgagctgctgtgggctccgcccagtttgaagttcctggtggctttgtttacactgtgaagggaaaattgcctactcaagcctcagtaatgtggatgccccttcccccaccaaattccagcgttccaggttgacttcagactgctgttttggcagcgagaatttcaagccagtggatttcagcttgccagactccatggtggtgggatcca

SEQ ID NO: 467598 - DNA, 3233 bp, Homo sapiens
cagacagtgggatatattagaattacttaagaaagaaaaagtccaactcgatgctaaatctccaatgcctatttctgtttgttacacagtggatcaggtcagagcatcagttccaggcaaagaagacaataggaaaattaactgctttgcactgacatatgctgtattgacgaagggccgcaggcctttctctccccaaaactttcaaaacataaggcttctgtccaaaatagaagtgaatgttacactgttcccacaaaagaaggaaacaagaggagtctcagagccacaaatgttctatttccgagttcagagcaaacaaaaaatccagcccagaggggatggatttgagttctgtctgggcttccagagtcttgcatgtgtcatggttttagggtgcagtgggaagcatgtgctcaagtggctgtctaacctgttgcgtgtgctcagacgcaatggcttgtgtttggtttctggctcagtccacacaggtattgcactcctggtttccagctttcaggctccttgctctgtagctctctctcagctgccttttacagctggaactgtaccacctcagccttgggaaatccagccctttattacaaccatattactcctggtgcacagggatgctctccttcactgaaagattctgtgctagggctctgagactccttcagggctattagtacagacacacctgtagccatttctctgttttgtattttattttatttttccataagttattggggtacaagtggtatttggttacataagttacctggtgcttctgcctcacatctcttaagattctttcctttgtcttaattttgtataacctgatgaaaatgtacctaggcaaagatctttttgcagtgactttcccaggtgttctttgtgcttcttgtatttgacggtctaggtctctcacaaggctgggaacgttttcctcaatcattcccctaaatatgttttccaggcttttagaattctcttcttcctcaagtttggtggtttaacataatcccagacttcttggaggctttgttcatattttcttattcttttttctttgtttttgttggatcgggttaatttgaagaccttgtctttgaactctgaattctttcttctacttgttcaattctattgctgagaatttctaggacttcacatttctaaaagtgtgtcaaaagtttcctgaatttttaattgttttctctttaagctatctatttccatgaatttcttctttcacttcttgcataatttttttggatttctttgcattgggctttgcctttctctggtccctccctgattagcttaataactaactttctgaattctttttcagaagtttatcaattattttagtcatttcaattaacatttgcctttgtttattatctgtgtaatgggtttattttagactccagtgtgtttagtccttactgttctcttctttctaccttctttggctttaatttgatgctttcttttgaacttcctgaaatataaactgtacctatattccacatgtttaaggttatacatttccctttaaacacatgtttaagtttataaatttccctttaatcatagctctactctagtatcaaatttaaatacatacaatttgtattatggttcaattcattattttttgtttcccaatttccatcttcatgccttcctctaccatggattcgttagaaatgcactacttaattttcaaatgtataggatattccagctattttttgctattgacttctaccataattcttatccagttaataaaatattttataatgcctcctcttttttgtatttgtattctcttttctactgcatatttgaaattattggttccaatgtcattccaatcaattatagaatctaaaccttttttctaataagagctttaaaattttcaatcatttagaatccgatgagaattgcatttatccagtaattggtcaattatagtaaatgttctatgtacttttaaaaagaaatgtatattttataattgtgagatgcattattttaatcattttaaccagattcttgatttttttgtctttatattattatcagtagtatggtggtatcttatctttcacatttattatgtcttcatttaaattttttcttgttttagttttgtcagtatttgctttacatactttgaggctattgtgagttgaattgtgttttctaaaagaatatgtttaagttctaacctgtgaatgtcctgactttatttggatagggtctttgtgaatgtcatcaagttaagataaagtcataccagattagggtggtcccaaatccaatatgactgtcgttataagaagagaaaacagaggttcagggaggaaaatgctgtataacaacagaggtagagattagagtgatgtggttgaaaatcaaggaatgctaagtgtttatagccacacaggcagctaagaagaagcaaaggagaattctacccagagtcccagagggggtatggccctgctgaccccttaattttagacttacagcctccagaactgtcagagaatgcatttctgttgtcttaagccactcattttacttgattgatagagagagtatattattagatgcataaaagtttaaactttgtgtaattttctggagagttgaaactttcatagttattgcatgtgcttatttatctatgattttcagcttacagtctacttttatattaatattactaccctgcctctattttgagtgtttgcatgctataactttttacaccttttcatttgcaagctttgtgcatccatctgtctcttatatttaatgtttgtatgtttttttcaaataagcccaagaatgcatgccatttaattggattatttagttttcttacactaaatgtcaatttttgtattttaatctaccctgttcttaattgctctctatttgtcccatcctcctatcttttttttccctctgccttcttccttttctgaggaattattgttattacttatcattcccctcattaagttgttattagcttgttatcctagaaaatccttcatgaatctttgactaattaaagtccaatgtaaatcagtacttctatcatttattagccaaggcaaggacactagaataccatacctatatttaattaccctcgaacatacatatttttaattatttgaacgtttatattttaa

SEQ ID NO: 467599 - DNA, 702 bp, Homo sapiens
gccgccaaagtaggagcccaggcagaggaggcgcctaaagaaagcgagggctgtgaggactgccagcacgctgtcacctctcagctttcttatagtccagcacaggatgcaggtgtgtatgtcatttcaacacaatgtgaaaggcgttgatggagtgatatctgctggcccacccctaccagagatggtaaaattcaaaaagtcacatgacatcaaacaaaagtgggaagggaagatcacctttagaggagctctagatgaagacattttttcagtttatgaatataggagaagaggagttgctcagggcttctctggctgtgtagacagcagccaccacctacacctagatgagttgcctttcactttctccttcaggattttcctggagagaacacagcctctctaccattctcttgatcctatttgtaactccctaatagctgctgttctcacaagagtcagagtgatgtttagaaaaacatctagagacattgtttgccattcacctctcagaaccttctaaggactatgtctcagggtaaccaagagagaaaaagtttctctttatagcagtggtccccaacttgttcggcaccagggactggtttcatggaagataatttttccacagacgtaggtggggagggggaagtttttggggtgaaactgttgcatctcagatcactaggcattagattc

SEQ ID NO: 467600 - DNA, 775 bp, Homo sapiens
ctatttataatggaaccatacttttccatctctcaccctgaggaagttgcaagttatatgggctacactcataaaaatcaaggcaaagaaaagctcaactctcagtcagaacttcagcaagtgatagaggttgtcaagtctgcatgtggccctttcccaaatcctctggaagaaggaatctcatttgatatttattcaacattcatagagccccccacaatattggatacggaaatgaagaggttggatcaagaacaaggccctgaggagtctcagccagaaactgacacctcagacatggatcctttagttggttttaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtatacaagagtttgaaaaattatatataaaaatacaattacttttatgatagtcctttgacgttttgactaataaatcctattcatcttca

SEQ ID NO: 467601 - DNA, 1941 bp, Homo sapiens
cagccagcagtgacacaccttgcagcatgagaggcaacttcaccaggcctctcgactcctctctgtgcttctattttaagctccctatttgtaaaccaaatggctgtgctggaaccatttctgaaatcagaagggcaattgtgattgtatgtgagtgtgcatgtgtaagtgtgagtgtgtgtgtatgtgcagtgtgttatcgaggctccagagttctgctttcaagagtgacattggaagaagagagacagattttgcacgtggagagtgtaactcacctggaagagggtctcacttgtgatccaggcttctttctctccatgctttcatctaatgggatgaccaaaccaggcaagatcaatgagtctgaggactacactggtgtatgtgctatatgtgctctgccatacttcacagaactgggaagatggtatgaggaaatagacaccaaaaagccttgataagttccagagggccaaaatagtaactcttgttggcaagggtattctataaatcatttggggtcagaaggatcattgaggattaggaaagttaactaaggtgttccaggtcttaatagctaatacaaagcgaagctgaacttggaataccttctgattttggatttgatactttcaaccctctgacacaacagtgcctctagaggacttcagtggttatttcccaagataggccagtttatctgatgctaactaagatttaatgttaaagttgaattatttatactcatttttggaatcacttgatgtaaattttaatgtatctaagatttaatgtctcgtaggtatatattattgtatctgagctaactgcagcatccagaattatgacaactaatttgcaattcaagttctgtgattcttttgccaaaaggcttgaatgctaaggggtttaccaaaaaatcttggaagctgaaggcaaaaggatggttcatagaatagcacttaaatgctggtatcccatgattcacagggtagttttcatgcaaggtgatgatgaaatttctaggaggtttgtacatcgagcttgttccacatgtctgtgccatgaatatgcaatatactctgaaagactggaatgacttggagcactggagttgtgaagcatggatctctggtttgctcaatcaaaaccctataccctagcctcacaaaacttagctccctgaacatgtaacaaggcataactttataaattaagtaacattaaagttttgcaaaatctaatatacaagtcaaacctcgcatcattagtctggaccatgggttgttctgaataacagacataattttaagcaaatggaagtgtgagaaatttgaaaaaaaattgaacaaatctattattagttccttgcctctaaattaaaacattagtactggtataagactggactgatcgcagaaagacaagttatagttatcaacaaaatgatcagctgtcttttacagaatgatcttgcctccttgctatttatattacctaatacacagcatgtacatgaaaaaaaaccttttatggtaatatatccttaatcttggagatccatcttgtatctttacatagttaagatgctgaaaagtcttccagtcttttctaattcattgtttctcagtcttatttgaccacataatactatcttccagtattaacagggaagtattattgtgtgtaagatggcaacattcacctgggaataaccatttggattcaaaatgtctcctttccccatagctcatggatttctctttgtttcttttcatttttcaaatttttcaaaatttcaaacatacatgggaagaaaattataataagtcccatatacaacatacatataacaactatttagattttttccatctattttttgaggtgatttaaagcaaatcccagacattacaatgttttatccttagatatttc

SEQ ID NO: 467602 - DNA, 942 bp, Homo sapiens
aggtctttaatctagagcagtggttcttaagcgtgtgtccttgggacgcctctctacttggatttatctgctgtttttgtcacgactagggttatggaaagtcaaggttatactagccagggagccagcgaagttggtagcatggctcaaagccttagaaccagggaaactgatggttgtacctattatagaaaatatgttattgatttttccaaatctgagatcattggaataccaatatccaagaatatagaagatatacccttgaccaatgccttgcaaaatagatttgtgagggcagcacctgcatctttgaagaaccgtgtaattgctcttctctgtatattagatctaacagtgggaaccacagtcactcaactacaaaatttaaatacagtgggaataattggatcccgaggtggcagaggccaagtggcagcactcaactgtgacaggcaaggacacctctggctttttaccagggtaactgtgcactggagaatgggaaatgatcggacattttggggactactggacactgtctctgagctgatgtttattccagggaacccaaaacatcattgtggccctccagttaaagtaggggcttatggagatcagtgctaccatcaaggacttgaaagatgcaggggtggtgattcctaccacatctgcgttcaactctcccatttggcctgcacagaagacagtaaccacgtggtgactccaattgcagctgctgtaccagaagtggtttcattgcttgagcaaattaacgcgtctcctggtacctggtgtgcagccatttacttggaaaatgcctttttctccattcctgtccataaggcctactagaagcaatttcccttcggctgacaaggccagcaatatacctttactgtcctacctcaggggtatatcaactctcaggctttgtgtcat

SEQ ID NO: 467603 - DNA, 713 bp, Homo sapiens
ggtgtcctgccaggatttatgctggaattgtgccaccagcccttggctgctctgtcagatattatatggtactatttcagtaggtcctgtcctccccctcgcacacctccctctcacctgccgccatgtaagataggcctttgcttccccttcgccttctgccatgatcataagtttcctgaggtctccccagccatgtgtaacttcagtgccttgcatgaaaactggtggttgagaattcctcaaggaaagcagaagttgttctccgagtcagcagtgctgtgcggtgcagagcagcgttgcttctctggatccaagacattgctgtgtgtggcaggactgatcctcactacgtacggtttggattccttgtatgagcgtctggaagaagacaaggtcttgagctcgttgccgcagcaaacatccctgctaacccctattccactctgtttctacaaattctacttttttaagatgccacatcagggctgtgatattctccctgctggggcatctgaagtgtctcctgtagttggaggtaggacggcggcactgggccaggcggttctgcacgatgactttgttgccaccagtctggcccttggccagatgccttgggcatctcggacttgctgagactgtcatctgtgaaacaaggatgatagtgcttgtggagtgtttaaatgacatagttgtctgtaaagttggcagta

SEQ ID NO: 467604 - DNA, 1237 bp, Homo sapiens
tttttactctgaaggttgaagctgtgcatttctggagcctgggctgtcggccgtagtggctggggaatgctggggctgtggtcgtctggccgctggcagtcctgctggtgggtcctgcctctttgacaccgttcctttctgaagcttgttttccccagtgttggaagtagcagcactggaggaatggccttcttcctacagcaaagctctgccaggagaggaggagaagacatagagcatctgttgagggacatgacgttctgggcactgcaccatgctttctgcttctcagcagtgcctcctggttgatgttaccgtcacctggcatcgcccaggagaagagccaagtgtgcaggagaccaacgtgtgcactgggagtccccaggggcgtgtcctggcacgcggcccagaggcccctgacaaggctcagtgcaccaggcacacagcggattgttggtgcttgacccgacgagaaggggatgaagtgagagttgcacctccccgtttcgcacgtccccggggtgattctccagcatgggtgggagttgtgtttggaggcctgagccctgtgaagctagggttgctgttacctgagcagcagaagcatggactctgggaagtggggtcagggggcggcctctgctgcatccgcaggaggggctcctcgtcccagttgaccatcgtcactgcagaagggggcgtgggcttcatggtccattgataaatagaacgttcctctttttttttttttaaagcatgtcaaaccctaattccttcagcctttactaaagtggcattttataattccatgtgatttcattattatacctgcaggagagaatgcttcctgtaaaccagaagtgtctctgagacagttctcagcccatttagaaagttcattttcccacggttcaagacggcctcaggagggttgaggacacatctgtgacacggcctcaggagggttgagtaggtgcccgtcactaagcagatacgcatttatctccgtgtgcagggggtgactttgagttctgttctctgtccatgagaaatttccctgtggactagttgtgagggaggcttcgtcgagggagggtcagttctgacactttcttagatactgaccttgaatggacagaattgagattcaggaaaaccctcgagctgtgagagtgtgctgggatctatgtaagtggggtttatgtgggaaactcagtaatagtttaagaaatatcaa

SEQ ID NO: 467605 - DNA, 1378 bp, Homo sapiens
cgccaaaacatgaggacacacttctaattttttaaggagtgcttcatcgtgagtcagtcctgacgtgtactatgttaggaaacctctgaactccacagtcaagccagagctctgacagaaagtggttgcgcccttctcactgtgtttttgtcactagctttattcatgaaaattatttccttaaaaccctctttgtatgacttctattacagtttggaaaaaaaaattatgtggaactggaagcctttctgcagcgttaatattcatggcctgttctgggtctcggtatatgtgtactatacaaatgtgtacttgtatgtggtgtatgcgtactatgtattgccattgtacatgtatttacaatgtataggtatgtacactacatgtgtcctacatgtgtgcatgctatgggcatgcatgtacatgtgtacatatgtgcataactatgggcactattatatccacactatttggacatgtatctgtactgcatatgtgtacatacatgcatgtatttaacgccatatatgtacctgtgtacatacaccatatgggtatttgcacatttgtgtacttatatatatacatgtgtgcacactgtaagcatgcatgtacactacgcacactgaataaacttgtggatatgtgcacactaatgtacgcatgctgcatatgtacatacactatgtactgcatatgtacatactttacacatgtatatgttagtgtactgacatatatacattatatatatgtgcatatgtatacactacgcatgtgtaggcatgctgtagtgcactgtacatcggatatgtgtacactatatgcatgtatatagatgttatacctatgtacatacaaatgtgcatgtgtatgctatatgcatgtacatacaggttatagtatacctgtgtacactggatagagatgcgtgtacatgctattcatgtacatacatgttatagtgtacctgtatatgtacattggttatgagtgagccttattcatgtgcaaacatgttatagtgttcctatatgtacattgtatgcatatagattgtgtgataggatgcatgtacatgtgttatagtgtacatatgcatgtacactgtacacatgtgtgtacatgctatgcatgtacacattatagtgtacctatgtacatatgctatatggatatggatgtgtatgctctgcatgtacatacattatagtgtacctatgtatgctgtattgatatggatgtgtgtacactatgtgtacatacatgttatactgcacttacgtacatacactatggatctggatgtttgctctatgcatgtacatgttacagtgcacatgtttgtacactatttggatgtgtatgctctatgcat

SEQ ID NO: 467606 - DNA, 1386 bp, Homo sapiens
ccaggtcaaaagcattttttaagaagttaaaaagaacctaactgcatctttggatcttatgtgaggcaatgtccagggtcactgggacccctgcttgcttcaatgcagcaccgtccacagcagccaagatccggaatcacctgagtgccggtcaacaggggatgaagggaatgtggcctgagcatacacaggagcagtactccaccacacagaggagagagccctgtcatccacaacagcatggagctggaggacattacattaagcaaacgagccaagcacagaaagaaatggtgcatgttctcactcatgagcaggagctgacagcagatgtcatggaggccaaaagtaggtggtcagcagggcccactcataagcagcatggggagaggctggtaaggggcacaaacacacagcctgacaggagcacaagatctactattgataaaccagcaggggaatgtcagtgggtcacctactgtgtatttcaaaacagctaggagagaataacttgaatgttactagcacaaggaaaagaaaatgtttaaagtgaaagacatcccaattacccagatttgatcaatatagggacgtatcaaggtatcacatgcaccctgaaaatatgtacatatattatgtatcaacaaaaacaaaaataaaccaatgacagaatcgtttgcgaagcaagtgcaggtaagaacggggagccagacatggtgtggctgtgtgtccccacccaaatctcatgctgaactgtaacccccagtgttggaggtgggccctggtgggcggtgactgactcatgggggtggtttctaaccccccagtgttggaggtgggccctggtgggaggtgactgactcatgggggtggtttctaacgccccagtgttggaggtgggccctggtgggaggtgactgactcatgggggtggtttctaaccccccagtgttggaggtgggccctggtgggaggtgactgactcatgggggtggtttctaacccccccgtgttggaggtgggccctggtgggaggtgactgactcacgggggtgctttctaaccccccagtgttggaggtgggccctggtgggaggtgactgactcacgggggtgctttctaacacccagtgttggaggtgggccctggtgggaggtgactgactcatgagggaggtttctaatggtttagcacaatcccaagtgctgtctcatgatagttctcatgagatctggttgtttgaaagtgcatggcaccttccccttcactctctctttccggccatgtaaagacgtgcctgcctccccttcaccttccaccctgattgtaagtttccccagatgtagaagcctgtacagcccacagaacagtatgccgattaaacc

SEQ ID NO: 467607 - DNA, 2638 bp, Homo sapiens
acattttcacatgggccatgtggaaagttggctggacctgccactggacctgacactggacatgctgctggacttgccactggacttgacactggacctgcccccggacctgccgctggacctgccactggacctgccactggacctgacgctggacctgatgctggacctctccctggacctgatgctggacctgccgctggacttgaccctggacctgcccctggacctgccgctggacctgatgctggacctgtccctggacctgcccctggacctgccactggacctgtccctggacctgcccctggacctgcccctggacctgtccctggacctgccgctggacctgccgctggacctgccactggacctgaccctggacctgcccctggacctgcccttggacctgtccctggacctgtccctggacctgacgctggacctgatgctggacctgtccctggacctgcccctggacctgccgctggacctgtccctggacctgacgctggacctgccgctagacctgtccctggacctcacactggacctgtccctggacctgcccctggacctgccgctggacctgccgctggacctgatgctggacctgatgctggacctgcccctggacctgcccctggacctgtccctggacctgccgctggacctgatgctggacctgacactggacctgcccctggacctgcccctggacctgccgctggacctgacactggacctgccactggacctgacgcttgacctgatgctggacctctccctggacctgatgctggacctgccgctggacttgaccctggacctgcccctggacctgccgctggacctgatgctggacctgtccctggacctgcccctggacctgccgctggacctgccactggacctgtccctggacctgcccctggacctgcccctggacctgtccctggacctgccgctggacctgccgctggacctgccactggacctgaccctggacctgcccctggacctgcccttggacctgtccctggacctgtccctggacctgacgctggacctgacactggacctgatgctggacctgtccctggacctgcccctggacctgccgctggacctgtccctggacctgacgctggacctgccgctggacctgtccctggacctcacactggacctgtccctggacctgcccctggacctgccgctggacctgccgctggacctgatgctggacctgatgctggacctgcccctggacctgcccctggacctgtccctggacctgccgctggacctgatgctggacctgacactggacctgcccctggacctgcccctggacctgccgctggacctgacactggacctgaccctggacctgccgctgggtctgctactggactgctaacaaatgctgcagacctttatggagagaaaagtacaatccatctgagagcagctgtcccagctctggatgaagccgacagaatgaggcagagctgctggcatcattcagtgggcagtcagtgaccctcctttaagtccagaaaagctcaaactgcatgtctgcaactagaaataccaatcattagccagacctcctggcaaatatcaccactgacccactgtaattctgtgtggtgtattatgtttcatgtgcaggaaatcattcacaaagcctttaacaaggaagtattaacatgacttttaatgcaatataacagctttgcacccatttaacatatatttaaccccaatggtatatgtaaatatatattttatagagcatcaggcgtgtttacctaatggctcaaacctttaaaatatctctctccctgagaggacagcggaggatcccatgcactctctccaggaacatggccctcccagagaggactcacaaatcaaatgtgcatatgcatgcatgcacagacacatatctcacacacacacatgcgcacacacacatacatgcaatacacacattcacacatgcacacacattcacataatcacattcataataccaacatgtaacacatacatgcacatacaacactcaaacacacatgcatatacatacatgttcatgcatatacattctggcacacacaaacatatgtaaatgcatacacataacatgcacacatatacatttataactatatacacaggagcatccacgcatgcatacttgcacatgtgtgcgatgtcatgcctaaacatgtaacacatgcacacacatacatacaacacaaatacacatgcacacatatacacatgcatgcatctgtacagtaccaagacacatacatgcacaacacatatacatgcaatacacactttcatacacataaatgcaaacacacatacatatatacacccctcaaagaccccattattcaattctatacaaaatggtttatcccccaaatgtaacttcttgtaattaataaactctactttactgcacatttcttgatttcaaataatgaggtctcacacacagcacacatacacacattcatactcaaatacatgtgaacatacgaatagaaataggcacacatgcctgaagaccctcttctgtaaaggcctttttactaccctttcatcatctcgg

SEQ ID NO: 467608 - DNA, 954 bp, Homo sapiens
aggaagaattcgcggtggcccagtataggtcaagggaggcgatgaaatgatcctccttctaacttcccagaaagacccgacagccagcaccgtaactggagaccatgcgggcaccggtgtgaacccagactccacggccagcaccgtaactggagaccatgcgggcaccggtgtgaactcagacccgacggccagcaccgtaactggagaccacgcgggcaccggtgtgaacccagactccacggccagcaccgtaactggagaccacgcgggcaccggtgtgaacccagactccacggccagcaccgtaactggagaccacgcgggcaccggtgtgaactcagacccgacggccagcaccgtaactggagaccacgcgggcaccggtgtgaacccagactccacggccagcaccgtaactggagaccacgcgggcaccggtgtgaacccagactccacggccagcaccgtaactggagaccacgcgggcaccggtgtgaacccagacccgacggccagcaccgtaactggagaccacgcgggcaccggtgtgaacccagactccacggccagcaccgtaactggagaccacgcgggcaccggtgtgaacccagactccacggccagcaccgtaactggagaccatgcgggcaccggtgtgaacccagactccacggccagcaccgtaactggagaccacacaggcaccggtgtgaactcagacgcaacggcaccctcctgggctgctccagccaccaccagaacccgttctgcagctgaactcgaagctgattctggaaggaactgaggaggatgaggacgagatccttctacctcaaccgggatcaattttttaatgatttctttcttttagaaaaatgttaataagatactttgttctaaaatgaccaggatttcagcagcttctacatttcttcatgtcaatcaaagctt

SEQ ID NO: 467609 - DNA, 662 bp, Homo sapiens
ctctatctcgatgatcgtctgtcagaggacaaggttaagtgtcaccaccgaggaccccgttgagcctctgggctggaaggcctcgaggtctcaccacctccagcctgagcgcccagtgcccaggggcaatttcccgccttccccgggggctcaggatgctggctcctggggcagtgcccgcagctgggcccctcctccagggctggccacggcctcctgctgtgtcataccagctgcttccccgcagctgcagcccacactgcgcggccgcttctgcttctgttggatgaggagacgcaggccctcgcccaggcccccatgggccctcaacgccccagagacccggcttcccggcctcgcccctgctggccctaaggctgtgccacctccccctgcccagtccctgcgctacttccaactctgagctgatggtcattacgagtggatctgccctggacaagtagtttagtgtagctgccttggacgggcaggtgaaaagtaacaaaccgccagaaaactcagctaataaaatgttaggagagacttggggcaccaggaaggggtgaggcctgtctgtgtgccatctgtgtggagcctcagtatctaggggacagcgttgacgctgagccccaggtttttattagtgtttccctgaataaaac

SEQ ID NO: 467610 - DNA, 1443 bp, Homo sapiens
gctgaatctcccagcaaagcccagtgacgtttctgttttcatttcaggcgagggagtaatagagacaatggcaccaactcctgagacagaggacctgacacatggtgcagccaccgcctgtggccacggaaattccagggaatgcagaccccagttgcctggtgcagccaccgcctgtggccacggaaattccagggaatgcagaccccagttgcatggtgcagccaccgcctgcggccacggaaattccaaggaatgcaggccccagttgcatggtacagctaccgcctgtggccacggaaattccagggaatgcaggccccagttgcatggtacagccaccatctatggccacagaaattccgaggaatgcagaccctcagtcccatggtgcagccaccacctgtggccacagaaattccagggaatgcagcccctcagctacatggtacagccaccatctatggccacggatattgggaaacacagaccgcagtcacatggtgcagccaccacctatggccatggaaattccagggaacacagaccctcagtcacatggtatggccaccgcctgtggccacagaaattccagggaatgcagaccctcagtcacatggtacagccaccatctatggccacagaaattccgaggaatgcagaccctcagtcacatggtgcagccaccatctatggccacagaaattccagggaacatagaccccagtcccatggtgcagccaccacctgcggccacagaaattccagggaatgcagcccctcagttacatggtacagccaccacctatggccacggaaattccagggaacacagacccttagtcacatggtacagccaccatctatggccacggaaattccagggaacacagaccctcagtcacatggtacagccaccatctacggccacggaaattccagggaatgcagaccccagtctctaaagtgttatttgttttatgaacttcactgcagtgattgtggaagagtttctctctgtgcagagctcagcatccagaagggaagttggccccaggaacgccttcctcctcttcagagctcagggcccagggctaaggcccttgggagaggtccctgttcggcaactgtgcctgtggagggccccccaacactcaccgtgtatctcctaggagcagaggctgcaacagggacccagagaccaagcctctgctcaggcaacagtgagctgatggccttccactctaagttccaactgcatggagtgtgtattccatgaatgcttgttaaatgaatgattcacataataaggtcttctgtgctgacctttgctggtctgctgaccatgggcttcagagcatagacctcattcctggagcaaccagctcttcccagagcaacggccgctggaggacaaaggccagggcttcttcctgcagcaac

SEQ ID NO: 467611 - DNA, 636 bp, Homo sapiens
ttggctgctgccctcctgaggagctgaggatgaggagggcatggctaggaggcgggagctgccgtgtgcagggttcggatgtaaactggcccaccctggttatctgattgtgtcagccttgggtaggtttcccggcttgcgtctcggcccaggtgcacccctgcctgcagcaccctccgtgttcgctgtctcaggacaggggcttctgtgctgcctgcatcacactgatgtgaagtgtcagtgccccatccagaccctggtccagttctgctgtgcccgcctgctgggcgccattacatgcactgctggtgtcctgctttgcagggctgcaggggcacttcctgctgcggggccgagggctccatccttcttccactgcctgtccctgtcccgtgccctgtgccccctcacaggggaaggacacttggcacaaggtcacagatatttgtggctttggaatggagttctgccctcggcacccccagccctgtgcatttcttggaggttccaccctgcacagtgaggaagtcacacgcctgtgtaagagctgaccaggggaccaccttccagagcctaagagaaggtcctgaggactctgtacacattattttcattgaaaagaaatagtttactctg

SEQ ID NO: 467612 - DNA, 1216 bp, Homo sapiens
ggagaaagatccgttcggttcggtgttgggcatctctctcttgggagttcccagggccgggcaagggacgggcaccatgttgatgtggatgagtcttcccctgatttcccaccctgagcaggcctcacctcaccgtccccgccccaggcctctccaccctgagagccaagggtgtgcagggaatacctccctccggacagaggcagcccatggccctgggattcccaagcccttctgtgtccatccagggaaatacctccctccggacagaggtggcccatggccctgggattcccaagcccttctgtgtccatccagggaaacacctccctccggacagaggtggcccatggccctgggattcccaagcccttctgtgtccatccagggaaacacctccctccggacagaggtggcccatggccctgggattcccaagcccttctgtgtccatccagggaaatacctccctccggacagaggtggcccatggccctgggattcccaagcccttctgtgtccatccagggaaatacctccctccggacagaggtggcccatggccctgggattcccaagcccttctgtgtccatccagggaaatacctccctccggacagaggtggcccatggccctgggattcccaagcccttctgtgtccatccagggaaatacctccctccggacagaggtggcccatggccctgggattctctagcccttctgtgtccatccagggaaatacctccctccggacagaggtggcccatggccctggaattctctagcccttctgtgtccatccagggaaatacctccctctggacagaggtggcccatgaccctggaattctctagccctctatgtccatccagggaaatacctccctccagacagaggcggcccatggccctggaattcccaagcccttctgtgtccatccagtaactgaccttgaagtttcagatctttagtgctttctggtattttcccttccccagatgcaggccttgtgtgatttcatttcagtgggaaggttcagcctaacggcattaccaaattccagaagcatcaactctcctttctcatcacgtcacatccactctatgaaatatatctttgtctgctcaagccaaaccaatccctctcatctttgtgatatgacagagcgtggtatggtaaccttccccctctccagaataacatcagcaata

SEQ ID NO: 467613 - DNA, 647 bp, Homo sapiens
ggcagcaacagccaggaacagggtgacgtcccttccacccctacatgggctgcttatggggtaagcggagttcccagagcaccaaagggacagcagaacacagcagggaagaggcagtcaggggcaccgtggtcctgggccaggtggcacccgcgcagggaagaggcggtgaggtgaccacagtctggccacctgacgcagcaaccaggtgcgaaggactcactgaaaatgagattcaaaagatgacgcgggcagagatgttctcctgtccttactcaacaccacctgaaatgctggtaacaactgtccatgtggcagtgactcccactgcccgccagctaccagcattaattctgggccttgttattaacataacgtttctgttcagcatcgccacaaccaccgataagataggaatgagcacaaaactagggcactggaaaccaggggagtgtgtccaggttcctgccacaaacccaccctgtgcaatcggctgcagcaagtcagttcagctgcccggtccagtcactccagacgaagctcagggtggccgtctggctgttctcagacccacgaaggccatgcttcactaaagcagacatcctgcatcaatctaggagggggtccaatctgtgttgagtgtttac

SEQ ID NO: 467614 - DNA, 1190 bp, Homo sapiens
tgctactgtgcccgccccagccctccccatgctgccgtgcccttcctgaagacgccatctccactgcacacagaggggttgtgatacgctgccctgactagaacaaaatgcttcactgcaattttccagaacttgtcataaaacatgtctcaggctatgatttctgcagcgtgagtggcaggaccaggacagacgcagctgcagggcacacctgccggtcatctggctgctctgctgtgcacctggttctgtgggccgtcctgggaagagctcctatagtgcctgtgtctctgcggaaaaccctaaaaatcagcaagtcagacactcctaagccagctctgaggctgccagtgagaacttctgattgctttgcacatccaccagctgatggcaagcagaaaacattcctgatgccactgtgtgcccgacgacccgagggagggctgtacagtgcacaggggctgtggaaaccaggccccctcagcaaggagcttccacctcagatcacactgtgggggctgctgcaggccagagcggctgccagaccgagacaacgtgaccatgccttctggggctgcagcatcagtgagggcacgcacgcctcacgggaccctctgccctgagcttcagcaacagctttttcttagagtcgggcggggtggctgcattgctgacgtgccctctcccgtccttgccagcgtcttctggagtcccctctgcccagcaaacaagagatgcatttggtccagatttggcaaatacctgcattaatgtgccattaagagtaaaattactctttgtaaagtgtcttacaagtttaataagaagcagttatgtgatttcatcgagacaatatttgaagatttttgtgccttgttcttcaaataatttcccattggaaaagtggagagatttattgagtttttcaggcaatcctatttctatgtcgcaatcagaaaatctaggccttgacctgcctctgcccttttctgagaatcaatgttgaataaagacggtttattaacttattcccagctcagacagatataagggtgatattaaagaaaaaaatgaaggccatgtaacagaagagacaagaaaaatctaccaaaagtcattgttgtttcatggagccataaaaaagttgtgaaatttgtgtaaacacagattggatacaatgtaattaaata

SEQ ID NO: 467615 - DNA, 886 bp, Homo sapiens
cactaatcccattcacaggggctccaccctcatgacctaatctcttcccaaaggacccaccttcaaacaccatcccctccgggcctctggtaaccaccattccactctctgtttctctgtgggattgacttttgaagattccacacgctgaatagtattccattttgcatatgcacaacgttctctttatccttcatccgtcgatgggtgctgaggttgcttctgcatttcagctactgtgaatggtgctgcggatgaacctgggagtgcagacgtctctttgacgtgctgattttaattcctgtggctctacagatggctcctgacttgtaatggccaaacgtcttagagaacgcaagagaagactagtttacagtaaccctctcatccaggccagacattttagagaacacaggagaagactagtttacagtaaccctctcatccaggccaaacatcttagagaacgcaagagaagactagtttacagtaaccctctcatccaggccaaacatgttagagaacataggagaagactagtttacagtagccctctcatccaggccaaacatcttagagaatgcaagagaagactagtttacagtaaccctctcatccaggccaaacatataagagaacataggagaagactacacattaaaaatgttccatttccttctggcttccatggtttctgaggataaatggactgtcatttgaaagcttgttaccctataagtaatacgtcattttaccctggttgctttcaaattttttgtctttgttttcagctgtttagttatgatgtgtctgagtgtacatttctttaggcttatcatattttgagttcactgcactttctaaacctcagaagacactgagattt

SEQ ID NO: 467616 - DNA, 1368 bp, Homo sapiens
tggtttgcgataaccctatgcaggatttccagagactagttgaatggctttgatcaaaatgctgaaaatgatatggacaatgaagtccaggctgaagtggtcacagatgaagatgaggaacttgttgggaagtggagcaaagaagggaaatatggagtcggagcccccacacagagtccctactggggcactgccagtggagctatgagaagagggctgccatcctccagaccccagaattgcagatttacttacagcttgcactgtttgcctggaaaagcttcagacactaaacaccagcccataaaagcagccaggagtgagaatataccctgcaaagccacaggggcagaactgcccaaggccatgggagctgacctcttgcttcagcgtgacctggatgtgaaacatggaaagagcagaagaactgctgagcacaagcaaaggaaatcacagaggcagccagcttgcttttactacaacccactctcaagaaaactcactcatgactcacaagatgtggggagagcctacaaatacagaggtgtcttctctcctgtagaaaagaatacaatgatagactttagtacgcagctgtagattaacagataattattgcaaataatgacatttcatttgattggtactttatgttttatgttgttgctgtcccgtatttgctggaagctacaaacaataaattgtgtggtccactagtctttttaattaaatatgaaaatgttgatagcaaaatagcaaattttgtaaagcacctttgcaatgtttatttttgttcattgctcatagccctttctcttttcaatttaagaacatatctgattagagaagatgtaaaactaccctttttcaaccatcagagaaaaaaatcctttttttctctatggcaaaaagtaataagttaattcatgaaggtacctgaaaatgtaattggagaaattatttttaaaatatttttaattagatttttctttttgtcttttttaaaattcaacttatattttagaaacaggaggttcatgggtaggtttgttgcatggatatattgcatccaggacttctaatactatgttaaataggaggggcgagagtgggcatccttgtggttttccagttctcaaaggtaatgtttccagcttttgcccattccatatggtgttggctgcagcttgtaagtaaaatgatatagtacataactcaacgggtaactgtgagagtaaagtgactaaagcagtactaataattgtaattaatacaaatagcacagaagtagtaattactttattacttttgtgatacttaattgatactttgagggagagttataacaatgaaatgctttcagtgcac

SEQ ID NO: 467617 - DNA, 1862 bp, Homo sapiens
ttcaaagtcaacattaccataactgggggaaaggagttctaaaggttgggaagtccaagatcaaggaactgacaggtttgtttgtctgctctcatgggttggagttcagtgcctgtggctctcccaggctttggcctctcgagcggccctgctgccacaactccatcaatcattgccctagtgggcacaactgggccacctacaccacaactgaagcagccaattagcactgtacaaaaacaatgggtgcagagacttgaaggagttctgggcttcaagaacatttggagtactgaaattccacaggcaggtcgtctcaaagagtgtgtgagtctagctgagcctggggtttttaatgtgctaagaatgaaggaagtgcatgctaatttgtccatgggtgaccacaaatgggcctggaaaaagcaccatcagatttgccaagcagtcatcaatgaagttctcactctgggtccccaagagttcagggatgctggagtctggactgtgactggacaggtgcagctctgttgtgggaagtcagggaccccaaatggagggactgactgaagccatggtggaagaacataaattgtgaagatttcatggacatttatcagattccccaaattaatacttttataatttcttacgcctgtctttactgcaatctctgaacataaattgtgaagatttcatggacacttatcacttccccaatcaatacccttgtgatttcctatgcctgtctttactttagtctcttaatcccgtcattttcataagctgaggaggacgtgtaataaataaattttcaacttgtggtattttcaatttacagtggatttatcaaggctctaacctcattgcctggttattccaagaacacttagttgtctccaggacaaataacttgctaagctctatttcctctggtcttatgtagtacaaaattgtgagtcactcaccatgcatgatgtcagcatacatttactgtcagcatacatttaaaattttttttcatgacaaggtttacacactattggtcaatttttatattattttgaccttcacatagaactgaaccatcatattgttcagaaataacaagatcagcctaagaactacctgattgttctcttagtcttatttgattatgctaaggtgacaagtacctaaagtaacagttgagataaaattagcttataatttccaaaggatttgatggataaatcaagtattaatatttataatatttaaattagttttaacatgtatttgaataggcttttcattggtagtgtttgtgtttcctaataaacttgatatatgcctactcagagaagcttaaatcattccttgattgttcagaacataacttgtaaaatcagactgaatgttggaatcgacagtgtcctgcctggggaaggtggggtataattaactctacaggtataccaaatgtagatatagaaagtgttaacattttcttaattactctaaaccagagaacttaatgacaaattatatttagaaatctatactaaactgaaaacttgagtttatatatacgtatgggaatatttagttcttagccatggctgcctttacattatacatcaattatttattaagtgtttactatatgccaaatatagttgtagattctggtgatacgcaaattaatttgaagtttacatctgtattctagttattgaagtgggaggaagagtgtctgtgtcttgccaaaatacgtttcacactttgttattaactgattattctactgaagatttcatgggaagatatgaaagattttacattgtactgccatctttgtttatgctgctacaacaaaatacctt

SEQ ID NO: 467618 - DNA, 587 bp, Homo sapiens
ttctgttccattggtttatgtatctgtttctgtaccatcaccatgctatacataaaattatatcaaaaccacatttctgagcatttgaaaactggcatgaagagtgacagtgatgagctatattatcctctgggttttatcattctgatacattcctgcttgtcattttgcaagtgttttctggaatatattctgttaaacagaaacatatcatttatttcaaataaatcattgtgtgacttttcaccttgggaatgtgcatattctctgggcgatgcagtaactgctttagtcagactctctttgactgtctctttcaatgatttctctggaaccacagatatgctttgccattctgagggagatgtgggttgtggtgccaatgccacagaatatgacatcccaaaatatgccactttagcataagaattattatgaattaaaggaaaatgacaattaaacacatggaaagctctctgccttctccctgtttgcctaaaagcaggacataaatttacgaaagcaaaaggatgcctccttacctctctaccaggaagaaaaaaggttgacccactgaagacaacttt

SEQ ID NO: 467619 - DNA, 798 bp, Homo sapiens
aattatgggtaccctacacgtggagcatgaggtcacagcccagcaactccatctggggccatttcacccaagctgcaaatatagtgtctagaaaagctattagtgtcgagaatgttgaccttacaaaccagttatttaaagtgatcatagtttgcagaaaagattaccttctgaaagaggtcagttgcttgccacacagaaagccaatcactgagacaatgagtattgccagggaagagggctataatcaggtgcagcatccaaggagaacagatcacactcaaatctgtctcctcaaccaactaaaattggagatttatatagcaaagaagaaatgtactacctgcagaaaaacagcaattagggagggggtaacactactgtcaccttctggaaccagtcagcttatggctgagctgaggggctttttggactgatataaatatttatttaaagatgacataagtgaacacgtgtattaagcgttaggtatgaaatcccttttattttaaaataaaaccatgcttacacaataaaatgaaaggattttgacattcgtcccaatcattttggccaaccaatcggtatcactcatgtttgggaatttactcatgggtattgaaggaactaagtcaacaagatattctacaccaaaatgacaacattgggttcaaatgttgtattttcaaaaaaaaaaaaaaactcataaagctcatgtggtgagttcatctctctgatctgtaataatcgttctggaaattttggtctcaggacccctttacattttaaagaattttc

SEQ ID NO: 467620 - DNA, 667 bp, Homo sapiens
ccgcctcttattagctgtgtgcctgcaggtctttaaagatcctccagcccagcgcttcttaacagctagaattccttttaaaatgacaccttgggtgatctccagtgctctacctacctccagcgtcaaggcagctccatccacatctgagttgcttcagtggaggaatacaactgatcttgaccttccagtccaactgccccctcggtgtcagaattatcttcctaaaaaagcaaagacagtaatgccagtatccactatcaaaatgggacatgggaaatgctatttttatcaatacactgagcattcatgggaatatcagcaaagggttaacatctctgggagattcatttttcatgtgaaaaatgaaggcattaaacaatctgattcaaagagtccacaaaaccctgaaaatcttgaattgtatgattttgtatttgctatgccccctaccctctttaatccaaatctctgctgcacacacagcaaactttgacccagtcttgaggcaactctatttctgccctcttgggagctctcccagcagctgggaagggataatcattaccagtgctcaatgtttctattctttgtaacaagcaaccgactctgatgacctaagctgtaacagaatttgtacaaatattgaagagtccatagaatattt

SEQ ID NO: 467621 - DNA, 554 bp, Homo sapiens
aggccaccatcgatgagcatttaggttgattccatgtctttggtatcaaaacagattgtgacattgcatacagaaagtgtaacgggagggacgcacaagcaagccatgaggaagcgaatgatgcagtttggagcaaggatagagtctgaaagcgatgcggtctcagcagggcctcagccgccccacggagctctggcgctcacagcaccagccaggcccttcccagggagcctcacagagcatgtttgcatgactttgaaaattgttcaagactataggagcccaggagccatgggatctacagctggaccgctgggctccaaccctgtgcctcagtttagtcatctgcaagacaggacacaatggcacctaccacgtgagagtgtggtcaggtttaacggagatgacgaggtgctctgggaaattaagacgtgtgcatggaggttaaagtggagtacttttgagaccgacatcagtgagggttgagaaagcagtattgcacagaaggagaactggacaatcatataaacacaacaaaagactctgctcattcc

SEQ ID NO: 467622 - DNA, 627 bp, Homo sapiens
acaaattgataaacagatcataaaattcatttttaaacagctagaattttactgctgtatgatataccgctataagaataaaccaggaacaaaaatgaaaatcaagaagaagaaggaggaacaagagaggcagccgacctgcaagacctgcaatagtcacactgtgttaaagagcatctacgcgggaggtagtgctaacctcaacagactttcagaggatccaagtctgtgtgcattcggcaggaacgcaggaagtgactcagagacctgggtccttacatcctatggttccaccagcttcaacacttccaaggctgccatgctcctgtgcatgaaggtggtgaagaagaagatagcattgggaattgtacatgacagagttttatgcctgaaaatggcgagtgccacttcaataaaaacaaagtctagaaaagcgaaattcgtcttcgaagaccatgcaacttagctaatgacaaaactaaaacaattttcaagtcctaaatttgtacctaaatattctttcaaccacaatttgtaatccagtatttgattttttaatcacaagctctctctttgggaattattaaagtgagtaatcataaatcactagaagtttgggaaaagtga

SEQ ID NO: 467623 - DNA, 2634 bp, Homo sapiens
ccgctctccagccatgagttggctgggtttagatctccctggtgtctctttgccagaggactatgtgacatgcagtctcaggcagccagatgccacctataaagaaaggctcctccaggccttcgcaaacacagacaaggagaataggaggaaggagaaagaggcccagaagagcatgaatgaagaacctggcacctatgcagcgaagtggccagctcaaggccacacggatgacagtgcagagctaggactagtatccaggctacttctggactccttgtccagtgcccatttctctcgctcaggccagcatcctcgttcaggaggtgaagcccagcaaacgactagtgagaaccatttcttggggggtgaggccatctctctccagttcaggaccacatctctgtatccttctcatctttttggtgtgtaataaaagtgtcaactttttaaaggttaacaaatgactttccctatacccttctgtcccttccttaccacttccctccccaaccctggacccccacattagtatgtagattttgaataacctggaaatagagctttttctttctagctaggggctacagagggagaaggtttaatgcaaagggaccatctctgtttctacaagtttaatgccctgctccattgtctttcattttcttgtcatagcagacaggtgaaatatctcattcgcccaccgctagcactgccttcagagtcctggcctgctaagcttgtgctgtagttaaagacactttagctgacactcttttgattcttttcttttagaaagccaagtgaggaataaacatgttgttttttctcttttccatttaagtaaatctctttctttcatttttaaaaagctcctcgcttcagtgggttttcatacttacattaatcccatcaactttctactcgtacatctttggaagagacattagaaaataatctctctgcttatttcactctgcctgaactccccccaccctgcccccagtctggtcaagctaaaagctgtttctgcataaaaaccaaattatcctttggtcacacgcattgaagggagaatgtttggttgttaaaatgtaattggttaatctgtatttgcaggtttcatttctttctctgttgacaaagacagctatgtccatgaacagagctgctcggtaggactttctgtgatgacggaaatgttctgtatctgcctatccaacacggcagccactagccacaagttgggtacttgaaatatggcttgtccaactgaaggactgaattttaaattttatttaatttcagtgcatttaaatgtaaaatttaagaagccaaatgtggctggctaatggccatagttgtggacaatgaaagtctatgaacaagatcactcctgggtataaggaaatgactcccaaatgctgctctgcagaatccctggacacctgggaagtggggagggctggtcggcttctctgaatctcccccaagctgctctaaacctcatttccaaccccccactcccacccaaccctcagcccatgtggccattgggtgcccagacatatctggagggaggggtaggtcccacagaggtggagagcctgagtcacaggcaggaagctctagggctggcagctcaaatccctgggatgaagaaatatttgagcctttttcttagttgcttggggtctgagggttgctaatctggagcacaggcctgttgaagagctgcatgaagagtgatgaaccaaaggtgatttgccttccaggcatgagattctgacataaccaggagagctggtatcagaagacaggatccaaccaggaaaacatacagcactcattggttttaaggtacataacatggtgcatgtcaaaagcacaatggctcttcagcttgtcttccttcctctaatctcttcccttcgcatccatcctttgcactgttgtcactttcattatcttaaaacaaagctctgactatgacatccctgctcaaaaactttcagtgcctccccatttctgccccaataaagctgaactcatcaacatggtagccagcaaggccttccttcctgaccatggatgaatggataataaacatgtgctacatacagacaatgaaatattagtcatctttaaaaaagatctgacacatgctatgatggatgaacctcgatgctaagtgaaataagctagacacagactgtatgattccacttacatgaggaattgccttcacctgtgagttccagatgtttataaattagtggctatgctgtttattctccacttatccgtccataaccatcctctttcctctctgccctgctctgagcccccagtggctaacctctaaagaccactcagtgcccttgtcttctgtcttccagttttttttccttttattattatactttaagttttagggtacatgtacacattgtgcaggttagttacatatgtatacatgtgctatgctggtgtgctgcacccactgacttgtcatctagcattaggtatatctcccagtgctatccctcgcccctccccccaccccacaacagtccccagagtgtgatgttccccttcctgtgtccatgtgatctcattgttcagttcccacct

SEQ ID NO: 467624 - DNA, 638 bp, Homo sapiens
ggaaatcacccgtcttctgcgtcactcacgctgggagctgctaccccaaagaagcccttgacaaggctcatccctgatgaggggcccaatagagatgggcagacacggtcactcatcaaaccaagcagttttcctggcctatggggccacgcccccagaagcaggagccactgggggccacccacgaacgggaagaatcaagtcaccaccaaggaaagcagatctcagaggcagagggctggagattcctggtgacatcattgagtacctagatccagccaattctgaactacctctgaaattttcagtaaatgagctcatcagttcccttctctgcttaagccagtttaagctggacttctgcaatatacaagcagtgttctcaccaatacgaagagagggctgtatgggatgtaggaaacagagagtcacttgtggttacttcaaggaaaaacaagtgatgggaccggaacctgaaagtcacttcccaccaggccccaactccgacactggggattacaattaagcaagagatttgaatgtggacacagatccaaaccatactggtgggaatgtagttgggtgtggatttatgcagacccctttcaaagctccagggagactgtgtggatgctact

SEQ ID NO: 467625 - DNA, 846 bp, Homo sapiens
agaaagattctgtgtcttttcctctctccctttccaggcttaaaacaaaacagaatgacaatgtatgtactgagtgctgttacactaagaaagcaggtctttattcagcagcaaagcccatggttgctttcaggttttgataaatgcacatggcattacttttccttggatgctgaccactgtccagatggtcatgacttctgtggccctgatgtggtatggcctgaaggacagcaaggtgccttccgacctctggagagaatccccaactacttttacaagacttgtgagggccttcggggtccagggtctcaccagctttccttgcctcactggcggcccctgcatagtgccccaagctccggtgctcagaacacttgcttggatctggctgatgcaatcccaagaaactccagtcagcgttctctccctttgagccagtgccttcacttccccgagcctgtctccctcatgtttccatcagacacaaaggaccgcttggggcttgttgatgaagtgaggactgctgttctctcggagcaccaccaggacgcctctcagatcactgtttgagcccagtaaagggacgaatcgtgctcatgtttattctgcaatttcaaaggctgccatctaatgtttaagagtgcagagactttaaatgaacaaacggtttggtggaaaataagagatgcacattgccatgatttgctacctggtagatggactttattttatgtggttaaggtgcagagcttagaaggctcttcaagtacaggtaagatttggaaagtcaccactaggctctaaatttggggagcagtgccttatgctaatgatgttttttgt

SEQ ID NO: 467626 - DNA, 549 bp, Homo sapiens
ttgaggggggcaggactgagcttcaggctttctcttatatcatgatagtggtgggggacaggggaggggaggtgctaccttgttactgccagtttgatgcaggcccaaatttgggcctcagtcaacaacattgggctgcagaccttggacagctgggcctggggcctcaagaggtattaacatcagagccaggtgggtctgccagaggccccctgacccaaatgttctgtccccacatcatgtggcagcacaacccaattagaggtgaccagggcagctgtccacataattgtatgcagttaacatctaacccttggctttcttggcaaagcaaaggcattggccttttggcttctgctgcttctcagccctttgcaggaggaactcacatcagtctggaacataaaaacaggagaattttcagccctggaaataattgcttcttggagtagatcctttgggagcctccacactgaggaatgaagtttgactaagccccagcaatgaataggacttggatgaggagaaagggtctgagatctgtgtttc

SEQ ID NO: 467627 - DNA, 598 bp, Homo sapiens
ctgaatgtgggattttctgattattatcaacctacctgaagataagctcctcacatctcctcctctcatatgcccacaatacccgataaatcctttgcacatttcatgtgccagtatttgtactccggcttgtgcattcttggctgcatcttcgggttccacactgtgtaccttcagcaacttcaggcattctctatactctgttggttgaagcagtcacaacattttgaagggaggaacatagaccccacttctcaacagagggtgcatcagggtcacattgtaagaagaccaaagcattcagcaatttcaaagcacatggctcctttttggtgtcttacatattcaacctcaggtttaaagtcccctgtgcccagaaattcactggagtcagcagctgaaattgtttggctgggagctcttttagctcctgagacccaagagggagcactgcccctgacagaagctccagaagaaagggaagtgtgtgtgcctgcaggcaggatcagcagagacagcccctgaaatgaaaagagacaagagggttggatcacacaccaggcaaaatgaacttggatggacctgtgatcttcccatc

SEQ ID NO: 467628 - DNA, 587 bp, Homo sapiens
gaaaaagtaggtcctgagaaaggctggaagcaaaggggagcacgcttaggtacactcatatgattcgggaagaaaggtgctggtcgacagattatggcaccacctatgaaaagctgaatgacaaagtgggtttgaagactgtcctcagttacctctatgtcaatccaaccaacaaaaggaagaaggaagcagaggcccacagaggacaactgccccacccagccaactcaacagaaatgtgcaattcacctgggcagacaagatgcaccgaagaaaatgactgctacatagacctaggtctcaaattcggatgcatgcaggggccagaagataatggcaaggaagatgtgggccaggtagagacttggaagcccctctgtaaagggccttttgccattaggctccaaatgactgttgtcatagtcacaggagaacacttcgtagactctcttgctggggacctgcactgatacccttatatgtgtgagagataaactaagtcaagtgtggcttacaaagatttccctttgactcagaggaagcacatggttgatccttcagtgcaaagggactttttgtgtcattgt

SEQ ID NO: 467629 - DNA, 975 bp, Homo sapiens
ctcctttatgtgctatgattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaaggtgaataaatactattttcatttacttcttgtcatccagtctcatcatcgtcagatctcagatccagcatcacttcctcaggacaccttcccagaatgtgatgcaagtgggatgggggaggaaattggcttcagaccagggaaatgctgcagatggggactccacagaagtcccgaactgaggccagagagcaaggagttcaaggatgattttccagtggaagaggaggcacaatgggctgtaatagtggctgttctgtaggcataaagtataaggcaaatatagaagctgaggttcccctgatgtttcttctctgtggcctgctctaataacctcatttgaacttatttacctttttaaagacccagtctccatatatagtaacattctgaggtactgggggttaggacttcaacatgtggatttgtggggatgcatttcagcccataagacatatgcatgtcaaggttgctgaataatgaaagtcttattgccctttgtgtccctgctgccctgtagaagatccaggatgatttcagggcagttatgggaagtttctcaggaagtgttttattaattagtattcctttatgcatgcatactatttttatcttggttgtaacaagttttgtacaaatttgccttttacacttgcttgctataacatgaaaatgattcttacttttatcttgctttcattttagcagaagtgatggctaaaggaagggagattaagaggcatacaccaaagtatatagcatgcttaattatatgcttaatgaaaaaaaaagatttggtt

SEQ ID NO: 467630 - DNA, 880 bp, Homo sapiens
ttggatccttaaatagatcattctggatagagagaagaaacttgcaagttcccagaatcatgagaggtgcacaatttcacatccaggttaaactcaagggctacctcctctttgaagttctccttgatttgtccagcccatatactttctttcttgtccgaacatccattgcacttaagaagtggaaatccaggccactcttggctttctctgtgaaccaagacaaaaaggaaggggcatacaggctgtccttaaagcatgttggacaagctgttgctacagggtcagggaatgaggatgctcactacctcacctgcaggatccaggaatgtgccgagacaactagaagtgggccttttgcccgctccattgacatcagttccctggttgtccaggatgaatatatcttcattcagggacccagtcctctggggagagcccagacttctactggttttagtgatgcactgaatccttccattggattgccattttatagcacaggagctgtctgaattggctagtcttgggctgggtttgaatttatattgtgtctctttctctcgtatcaacataccttccctgagctcttgtatttctgcttcaaacccttctcttatagaggtgagctcttcatcatacaggttattttaaattatagcagtgtgtttgcaatttttatttgctctatggaagcatattttattccatatctgttatttgtttttcctgtccctttctgtcttttattttcctatattattttatcattattatgctattttcttttatctttatatgtttaactattgcttattttttaatgctgtgagttcttcccagaaaaagtatttgaggaggttcattttagcaacagatt

SEQ ID NO: 467631 - DNA, 638 bp, Homo sapiens
gaagcctgagtcattttttgaccaattgaaggaatgacacattaccacagaaatttgtgtgctcatcccccgccagccgttcctcctcctgccttgggtttgctgtcttggctatggaagactgatcttggactcagaaatacagtacaagggaccacttctagcctggacacttacatgatgagtgactttggacaaatgatcaaacctctctggttacttgaacacaagcactgtgatcctgggactgccaatctgataaccaagagggctgctaagcaactaacgggcagtagttacagcatgcatatgctggacaaagggaagaacactgtgatagttaatactgagtgtcaacttgattggattgaaggatgcaaagcatggttcctcggtgtgtctgtgatggtactgccaaaggagattaacatttgggtcagtgggctgggaaaggcagacccacccttaatctggtaaatttccttttgtgttcattcatgttgtctatctctttcactagatcctgcaatcgtatttatcataattttaatcataacaattttaaagtccctttctaatagtttcaagttctagattatttttgagacgctgtggtgagtctctgtttctgagctctc

SEQ ID NO: 467632 - DNA, 3502 bp, Homo sapiens
caggaaaagacactaccaacagaatgataaactgtaccataaagaacaacctacagaaagaagaaggaggaggaggaggaagaagaagaagaggaggaggaggaggaggaggaggagaaggaagaggactaggaggaaaaggaggaagagaagaagaaggagagctgcttttatctgaaggcaaattgcttctggtgggccttacggacaggaatggagaaaaaggcatttgccaagtcaacggctacgtaccaggcagcacagagtttatctcctcatacaaaggtggaaacgctgatgacagcatgggtcagggaggggatgttgccactactggggatgcggaagctgtttcttctggcaaaaaaggttcatcagagtttgcaaactccgtgtctccagcttcatcagctattgatacttatgctatgacatcgaatgagcagttcttagcacaaaaagaaggcaccgtagaaagtgaagagttagaaagaaataaagttcttgttgatatgctgaaccactagatcaaaccatcatacctaccgacattttaaagccctacattcactgctgtgtatgtcacagaaagtcagtccatcattattgcatgaccacaaagatctccctcgtactacttctttatagtcagtttttttgtcttttagcccataagcatgatacatgtctccatttatttagtttttttaatttctttcatcaatatttttagtttttaccatacaagtactacatgtctttgttagacttatatccaagtattttatttttgattaataaagtagagcctgaaaatgtgattaagttgctgcaatcttataataaaacttgaataattgcgcagttgcttcttatggacgagcaaagatagtgttttcttgaaatggaatccactcttggtgaagatgctttgaacattgttgaaatgacaaaaatttagaatattagataaaaatcattgaaaaagcagcatcaagatttgatagaattgactccaattttgaaagaagttctactattggtaaaatactgtcaaacagcatcaggtgttacagagaaatcttttacaaaaggtagaataaattgatgcagcaaacttcattgttgccttatcttaagaaattgccacagtaaccacttccctgataagtcagcagccatcaacatcaaggcaagaccttccactagcaaaaagattacaacctgcagaaggctcagataattgttaccatttttaagcaataaagtatttttaattaaggtatatatgtgatttttctagctatgatgctattgcacacttaatagactataccatagtgtaaacataacctttaagtgcactgagaaacaaaaaaaaattgtgactcactttatttcaatattcactttttgtgggagtctggaaccaagcctgcaatatctctaaggtatgcctgtatttatgttctcttcttccaagctaagctgtttttatcattagatgtgctgtgtcacctaacatttatgggatttactataccatgatatctgcatgtatctaaagaagagagaaagggtaaagaaacagatggtaacatacattattactgatcaggaatgcctggttcagagatgtgaaaaagagctcataaacatcaagcaatgtaaaaatggaacaaagtgtcagagaaaaaaaacatgtttattcattcatttatttgttcaagagaatcttcttaaatgcctgcaaaatataaccccttggtgaaggaagggctgtggaaaaatgcttttacatcaatgtctgtgataccgaggaatttataaagttgcaattgttgatatttatttgccaaaatacatcatatttagaagagtaaaatgatagagttttggtggaaatagaaagtcagtttgaaaaaaataactataattttcataattataaaacagtttggtaatatatatgtatacatatttaaagaaaaaccaaggtgcaatataatttgaataccaaaatatccatctgtgtttttcttcaacaaattaattattgtaaactgatttacaaatcctatgtgccacatgaatactaaacaattaaattcaaaagtggaagtaataatataagccagtattatggggattatataacttcagatatttacatatgtttgaagaaaaaaaatttaaagtgtcaaaacgataaccagtgggaagtttctaaatattcctttgatctaaaaacaagagagtttgggtgttatatttttttaaaaaatcattttcttttgttggtttcaaatatcctgggaacttaggcaatattttttctgccccaaatggtcccaccagaataacttaaaaatacatgtatatgattgttcctgaccaggcaaatctaagccaatttaaaattaccttcacaaatacttgcacctgcaaataattctatggtaacaactaaactagccttgttaattggaccgttaatcacagagggagcagattttccactgccagaagggtcatctgtgcttctaattgtttccctgctgaaagtaacctgaaacaattcctaggagtccctaagcttagtttgaataaattgatcagattgtgtccctctatgataggcatgtcaactcctaaaactatgccttgcataaaataggcacttgatgtgtatttgctaatgcactagtttactgatgcaaacattaggagagatctgagttctattagtatggcaggcattgaaagggcaggaggaaatacaacagaagttttactctctacctgtatgccacagatgaagtttgcttagaatatcacttgtgatttcactttaaaattgctttccacaatagtaagccaaagagtctaaaaatgtctccaatttccactgacttctgtgtgtttaaacttgtgtcattaaaaataataatttagagctttatgaacccctcatatggttgctcctctttacagataaggaaactgtgacccagaattggtgacttcacaaagattgtatagatgtcagattagctatgctgttatttccacttcacctgtaaatacactctcagttggagtttttgacataagggagaagaccgatggctttatcccagcctaaaatgttaatgttcccaacagaataaaagtatagattcccaaagcatgaaatgaccttaaaattgtcctagttaacccttctccctttttcacagatgaggaatctgaggaccagaaaagaagagcagtttcccaggatatatagtaatttatgcttataataatgctattatcaatgagaagcgaaattatatttcatttacattttttactaaggtaggaaaatgttaatacatcttaaattaactttgctactggtcagctataaacttaaaggtttttatttttctattatgtaaaaaatttaattattcacattaccctgagacaattgcaataaatgatagattactgacct

SEQ ID NO: 467633 - DNA, 599 bp, Homo sapiens
agaaatattttattagatttagttagtaagctccctgacaatggaagtaacaaaagagatactggaagaagtatgcaatggatatctggactgggtcttggtattgaagtaccgccttggctctacttcaagattggagaatgaatgcggggaaattggagatgaaggagtgaaggacttgcagccccatcccttgactgtcacctccttgcagagactgcctctactgaatggagctgcttcaatcaagattatgccccattcctggaatggcccacacccagtgactaatctgatggacctgagaacatcaagaggtcaatcagctatggacactaaacagcccaaggaaattttcatgagagtgagtccccaagagagaaggaagaatttaaaggctcatcaaatgagactggaatgtctgaggtgtcccagtcctcagtaatgataagttctaggatgttgacatagacacagaagagagaccaaggtgaaaaagtcaagaaatgatgagaccaagatgtttaacaacaattattcaggattaacagatatggggtactgtcgggaatattttaggagaggtagaaaaggtagaa

SEQ ID NO: 467634 - DNA, 966 bp, Homo sapiens
ccattagagagaccggaaggaaaagatgctcaggttccagagactttcaatgactgaagagtgcactaaggtatcccccactaaggagtacagaaagaatggtctggtgatgaagataaaacacaagtccaatttattagagttgttcacagtcagcaatggtgatctacttgctagtcttaccattcctggacccaaagtgctccctggcttccatgatattcatgccttccttcactttgccaaagactatatgcttgccatccaaccactcagtcgtggctgtgcagatgaaacactggaaactgtttgtgttgggtccaacatttgtcatggacaagatgccaggaccttcatggaaaaaaatgagctggttcagaaggccaaactggctgagcaggctgagcaatatgataacatggcagcctgcatgaagtctgtaactgagcaaggagctgaattatccaatgaggagaggaatcttctctcagttgcttataaaaatgttgtaggagcccgtaggtcatcttggagggtcatctcaagtattgaacaaaagacggaaggtgttgagaaaaaacagcagatggctcgagaatacagagagaaaattgagatggagctaagagatatctccaatgatgtactatctcttttggaaaagttcttgatctccaatgcttcacaagcagagagcaaagtcttctatttgaaaatgaaaggagattactaccgttacttggctgaggttgccgctggtgatggcaagaaagggattgtggataaagtctgctctcttgcaaagatggcttttgatgaaggcattgctgaacttgatacattaaatgaagagtcatacaaagacagcacgctaataatgcaattaccgagagacaacttgacattgtggacactggatacccaaggagacaaagctgaagcaggagaaagaggggaaaattaacc

SEQ ID NO: 467635 - DNA, 1822 bp, Homo sapiens
ggcttgccctccgtgggctgcaaccattgtccaaccagttccaatgagatgaaccagcaaggtggtcttcaaactctgttattctttcttcttcttgaactaccaggaggtgaagctaagtctgctggtccacagagactgtggtcacccctccccctaggggctcaggcccagggagatctggattttgtcatggagcctctgagtggagttattggagttcctgcagggaaaccccacccactgaagaaggatgagcagttgcgagtcccagtgttggctgctgctcctctcacaaggagctcaaagggcttagacagtaggcagccacagccagtgctggtcacccctcacctcaggagtttgaacaggataactcttggggacacagaacaaaatgagagaagtaaaggcaatagagttcatcaaatagaacttgttctctttatgacttgtactcttgtattcttgtactctttatgactatttagacacatctgaattcagatttttttcttaagttctcatctcagggagtatggggaaattaatagataaatacttcataaagtgaaattaacagacatatatcccaataacagggaatttgctttctttgcaaacactcaagaaatagtctcctaaatgttaacattgaaaccccataatactgtctttcctgataatattgtaataaaactataagttgagaataaaaacaagtaaaatatcatcattttaaaattttcaaaattacacattgaaaaaatgaaattataaaatatttagaaataaaaatagtgaaacagtacatagcaacatttttgagataaagttgtactcagaggaaaactcagttttaaacattaacaataataaataaagataaataataaataatgaggaaaaaataaacattctaacggaaggttggaaaaagaagaataacagatttcagctgggcaatgggttgacggtaagcaaccacacatttaagcatacagtttaacttatttggtgtgagtagtcaattatacctaatgcaacatacttgaggtgggcacatagatcaagaagaaaagcagcactttttgatgcatttttttcttgtccctactttttgtacaaggtttttacactggtgatactttttatgcagtcaacacctttaaagggttgagaaaaacagctaaatttttgctgagttaccttctttatatcctcaggtcttcatatccatcctggaagtgcttgtacaaccagtataagtgcttctgcttggaggaatgtttaaaagtatcgggataactcagtcatgtcttgatcggtaaagaaagctgtacatatctaagtatccctgattaacatgtctaataataggcctggagccacctctttagtgttcatgaaagctgctctccatataactacaagaaaaatcaggaaataatagcaataaacatgaaaattaattacttgaaaaatagaaaactaaaattgatcattggttttataaaagagccaataaaacagtgtagcctaatcaagaaaaaagaaaactgggaaataaagacagtggagaaaacataatatctgaaatgtttaaatggggctatggctgtaactaagaattgtgaagtttattttttttttcttctactttattgtccaactccctccacttcctggacacccatactttgccagtatttgctttctcagcttctcaagagcttattttctgtaagcaggttgtatctatgtattagctcagataagaagttatcttgtactcagtaaatctatggaatgaggtactgtc

SEQ ID NO: 467636 - DNA, 617 bp, Homo sapiens
ctcaagcccagcgccacctcggacaggggtcccggcccagcgactgccttgtgggcatgttagagaccttcagagcagcccctcccatcaccggcctggaggcttaagagggaaaaatggttttgtgggctgggcccaagacccccactgctgctctgtgtagcctcaggacttggtgccctgcattccagctgtggctaaaagaggccaatggacagcttgggccattgcttcagagggtgtaagccccaagccttggtggtttgcatgtggtactgggcctgcaggtacacagaagtcagaaattcaggtttgagaacctccactcagatttcagaagatatatggaagtgcccggatttccaggcagaagtttgctgcagggatggagccctcatggaggatgtctgctacggcaatgtagaagggaaatgtggggttggagccccacacagagtccccattgtggcacttcctagtggagctatgagaagagggacaccatcctccagaccccagaatggtggatctgacagcttgcaacatgcacctggaaaagatgcaggcactcaataccagcctgtgaaagcagtcaggagtggggctgtaccctgaaa

SEQ ID NO: 467637 - DNA, 2007 bp, Homo sapiens
cggagcagcaaagattctgcaaacgattgtgttgtgctttggctaaaggcagccctgaggattatagcagtgaaggtcacttgcaaatatagttcctggctccagagtgctaattgtagcttcgaaaacgtgcgcgcgcgcacatacacacgcatcccaaatggcaaaattctcaaggtgctagattctctcagaaaagcacgtctgctctgcagcaggggagcgtggtcagggctgcgacctccacagtgcccatgggagacgggaacaggtggaagccccgccctcttctaagttagaggggagggagccccgtcctccctggtgctgctgcagccacccagcctcagctatggacccaagtatccctgcactctccgggatttcggaagcacccccaggaccctgcagtctcagtagtgctgggttccgacagagcccgagctggacactggtccggatgatctgcctgtggaaaggagccacccacttcaggtctcctgagagctgttttgttgctcagggaacctcctttctgccttgctcaccctccagttgtccacacacctcattctccctggacgcaggacaagaacttgggacccgctgaatggcaggactgaaagagctgtaacacaaacagggctgaaacatgcccccacagactcacacaccctccaattgccacactgcgtccatgagaaggagagaacagctgtggccctttgggaagcccagacctagaggctccccaagccagggctgtgacagcctctttggggctcagcagttcctggtgtctccaagcttccaggagccaccacattctcctccttcagacatgggtgcccacaggggaagccgtgtgtggtacatctggtccagccacagcctcgcatataaccagcatctgtgcgggcgtctggagctgcccacccctccgcagcagccggcatacctggctgtgcgcggtggctggaccccgcgcttgcttgctcgcacatccctcaccactctgcgcctggctcgtccttggcagcttcttgctatttcttagctcaaaggcaatgctaggaaagcaaagcatttggggtcaaaagcattttttcaagctaaaaggaatgatctcctcaaaaattgtcctaagtatgcaaagtaaggtgagagagggaatgtttttaaagtgagaaaaaattccttacctggggaaattcctcagggaagttggtgagtcataaagaagatattcccaaggattccccatcataataagaaaagagttgctaataattagggctgatgaacaattagatccaccaggtttctcctggttcaaatattcaaatagtgactgtatagaaggcacctggcaccaggtaagggcttggactcgatgacctctaaactacaatcaaaagctgagagtctgtggttgtatttgcctaaatatctcccgtctcttctgttttcataggcactttttatcacaagctattgacagcacagatttttatctaatgcatataaatgaatgtttatgagaaattccagaatgttttataagacactactttttaataatacaaggctgtaagggtaaaagtctaaattttcaacaaaataaccaaatttgcatataaccggtctatgcaaaggcaaagtggaattgaaaaattcaagaaaatgccagcctttacactgtatgcatattcctgtcaatgtatacagctaagaaaaggtaacagaccgccaaataatactgactttactggtgtacgatacagatattaaagtttagaggcttcctaatttctaggcaattggcttaccttttcataaccttaccttaactctgaaagataactacaatgagctgaattgtgcacgcccctccgctcagatattgaagttctaacccctagtatctcaaaatgtgactgtaggtatttggagatagggctgtgaaagaggtggttaaagtaaaatgaggtcatgggggaaccctaa

SEQ ID NO: 467638 - DNA, 640 bp, Homo sapiens
cacttcaggcctcactcgctgcatcaacgggactgaacctggacctctcctatgcgtgttggttcatgtactgccccaggtctatgtctacagtgggccagaaggacaacctctcattgccccccgctgagttgcagttaaggtttcgccaagctgccccactccttgtaccccttctagccggccttagcacagctgggtcagcagccatcggcatgagtgccctgattcaaggagaaactggattaatatccctatctcaacaagtagatgctgatttaaacaatctccaatcagccgtaaatatactacatacccagatagacgccagcaagaacgagaaaataacacccccggtaccaaaatatgttcaaccggaatccatggctaactactctaattactggggtacactcgcaagcagttttgccacaaagggctaacagtaaagcattaactgccaattttgactaatacaaccactgaagagagcctgaatgtgttagtcacatgtgtatgtttgataggctttataacctaatcaatacctacctatatattacttttagcatgaagcaatgagacaaaattcaaagttgtcatctatttaaattttatgtagaactgagcattttcttct

SEQ ID NO: 467639 - DNA, 1346 bp, Homo sapiens
gattattccaactacacaaggttcaggactgcctgaatggttgttaccaaaagactgagagtaatatggacaatgaagtccaggctgagggagtctcagatggagatgagaaacttattgggaagtggaataaaggtctttcttgctatgctttagcaaagagactggcagcatcgtgcccctgctctagggatctgttgaactttgaatttgagaaaggtgatttaggatatctggcagaagaaacttctaagcaacaaagtgttcatcagggtgtcaagtggagctgtaagaagagggctaccaacctccagacccagaatgttagatccaccaataacttgcaccatgtgcctggaaaagctgcaggcactcagtgccagcttgtggaagcacccatggggtctgtaccctggagagccacaaaagcagagctgtccaaggccttggaagcctgcctcttgtgtcaacatggcctgtatcgagttagttcccacgagatcttcttatttaaaagtgtgtagcactttcccctatgctatctattttaccaccatgtgaagaggtgcttgcttcccctttgccctttcaacttaattgtctgtttttctctattccttctgtactgaaacatacactttctagtatatgccctaatattatttcgtattaactatacatatcacacaaaatagcccataaacaccatgtgtttttctctaaaaatatattttatcaaatacattatctatttttataactaaaactataattttctatatttcaacacaatgaattacctcctgatctgtactactcattcactcctcactgataagatttggattcagattccccttcttccgctgatgaactgtgtaaacttggagaaaacaatttatcttacctgtaaagtgttgaggtacatatgaggtatatattgaatagattgtaggtattatttatttgtttttatcaatccagttttctctttttctttgtcttactcatcaattgaatcttcacaagtcatatatattaataagtcatatatataaatatatattttttaaaaatataattatttcttttttcctatgctgtctttttttggtaatttggaatttatttcagccaattatacagtcattttctgtacaattattttttaacagaagtaattattctcagttttgaattatccacaagtttcataggcatgcctttgatgtctttaactaaatcaactaaagaattgttaacacctcagggctcttgacaaaatgttatatcttcactcttagctcaatactctcccaatgcccctaagataacattaggtgtcc

SEQ ID NO: 467640 - DNA, 736 bp, Homo sapiens
gcggtatatatacaccacggaatactactcagccataaaaaggaacaaaagaatgacatttgtagcaacttgtatggcattggagaccattcttctaagtgaggtcagaaattcactgaatctcattggacaaaatcaaggttatgccatgtggtcagatttgttgaatggttgtgaacaaaatgctgacagcgatatggacagtgaagtccaggctgagcttgtctctgatacagatgaggaacttattgggaactggagtaaagttcaatcttgctgtgctttaacaaagagactggcagcattgtgtccctgctttagggatctgtggaactttgaacttgagagtgattatttacagtatctggcagaagaaatttctaagcagcaaagcattcaaggggtggcctggctgcttccaacagcatatggccatatgtctcctcctcctcctcctcctcctcctcctcctttcttgttaatctttatcatttctctgccactaaatgctggatttttctgcttgccaacccaaggcacattgtctaatatggtagacactagctacatgtagctattaagcacttgaaatgtggctagtgcatcttagaaacatatacttaattttatttaattttaattaaataaaaagtagttcaatctggcaaattttaatttatatttgaaataatgtgggcatgtgaatctacttcttaaaatataaattttataaaat

SEQ ID NO: 467641 - DNA, 587 bp, Homo sapiens
tgatactgcaaaaggagtaaaaatgacacaaaaaagtaatttccagttgagaaactcatttgagtcagagcgagtgtatcccttgcgagatcccccctctctgtgttttatccacaactcttcttcagaccacagagctggggcattaaaagcacattgtcatcagtgcaatttaaaaagaaagaggtttattggacttacagttccacatggctggagaggcctcacaatcatggtggaaggtgaaaggcaaaaagtagcaagttgtattttacacggatggcagcaggcaaagagagcttgtgcagggacactcccatttttaaaaccatcagatctcatgagactcattcactatcatgggaacagcatggaaaagacccatccccataattcaatcagctcccactgggttccttccacaatatatgggaatttctgaaagcctctgacttctttttgaagtgtttaatgtattcatatttaagttattattaatatggttggatttaaggttgcttctgaatttgtatgttttattacagcactacttataagagcaaagtcatggaatcaacctgtttatc

SEQ ID NO: 467642 - DNA, 597 bp, Homo sapiens
aaagttgtcacagacactgtgaccaatggaagcagaaatggctcatctcccagggctgctgtcatggttgctgagtgcctgtggctttttcaggcaaagggtgcaagccaccagtggatccactattctcggatctggaggcagtggcccccttctgacagctctactaggcagtgccccagcagagactctggagactgagattgtgataagaagagatattcctggggaagttatggttgaatacttgaaattttgtgatcaagaccatttcttactcctaaagtgtgaccgtaaagggagagtttggagaaggctctgtgatgtgcgcatcttccatgagcatcctgtacatccttccatgagcatcctgtacatgagcattctgtgcatcctgaggtactcaatatcctccatcctcaacaaacatttaaaggcaattaaagtataacctaacataatgtgtgatttctaaaaagtaaatagtttatcagataatggcagtgccacttttaactactccaaatgtaagatgacaatttccatttcaaaagtgggtttttctcttctatcgcactgtcaggctacaaattttcc

SEQ ID NO: 467643 - DNA, 822 bp, Homo sapiens
cctcatcctctgctgtttcgcgagataaacttctgttctatattaatgacccagtctgctgtattctgttatagcagcagaaaatggactaagacaagcctccaggttccatgtgcatgtatgcaaactccagtgggagcagagagagaatggcttgtggagtacctggcatgccgacacgtaaaagctcttatcatcctcttcagcaagagcccaccatgggtggttaataatagtcctgctgagggtcacttggtcacagcagcgacttctgtggagctcagttttggccagcacaacacccatcttggttctcagtgcaaagggaggcattcgtcttttcccttgaagatcatcataaatatggattcatttcctctgtgtttgttcacatttgcagtagaaattgatcatggttccagccacacaatccagctacattcatgttctggctgccgggaaaaaccaataaccacacaaagacacccccacaccaacagcccccacgcagatacccctgcaccccctacacacagacaccccacaaacagacaccccacacaccaccaccagggcctgctatctgtcatgtggttttatgctcgagtcaggttagaatgtggtaccttattgctatcaagagtctgctttgtcagtcttaagatctctgctttcacattagtgctggtcagttgtgcctgaattccagaggaaggaagcacagtggaggttacacagtctgagggacatggtcagaggaaattcaaaggagctacatttgggacagggggcctgttccatcctgaactggatctttttcac

SEQ ID NO: 467644 - DNA, 2365 bp, Homo sapiens
tgcctgcgttagctcattgaatggaattgagaacaccttggtcagccaagcgaccacctcttttaccctggctatttgcagatagtcctgggggcttctcatgggtctccaggaacaacagagtctgcctgcggtgggggccctggtgctgcctgtggagatgctcgcctgcttcctgggatcatccccagggaactccctgctccaagccccagtccgcttgcagggagccaagccaagacaacacagaggcagagccatccccagcagggttctcaggagagtcgagatgtgatccccatgcaagcgcttctgaccaagcagcagagtcctgctgggagatacgggcagcggcgcatggtgttccagagctgcgtctttgcagaagcctccgtgcctctggagggtggcgaggacgtgccgcttccccgctcggggtccactctgcctccacacagaaccttgccctagagacctgctgatggggaccctgatcagaaggacaagaagccgtgtgccgccctccttcacaccgaggaaagagaaaaagacgatttggccaccagggagatatttgtaaacctgcctcacccagggcaagcccacccttgtggttttctactgggtgggctttccgctataaaaggtaaacatccccccacccgcgtctttccccccaggaggggctgaccctgaggcaggatggagacaggcaggcgaggagggaggtcccagaaaggggaagaagctgtttcctttctctgggcttcacgtgtgtcctccaaggaagctccaggtgtgggggatttgtctcctgggcctccttctccctgggaatgaagagctattcgagcccaggtcaccacaggagcccagagctgaagttagggaatcctagtgcccatatgtcctgccgcgcactcaggcaagcaggcaggggacaaatgacaatgaccaacacgcttccccaagtctgtccttcccggggctgcgggacatcatcgtcaggaactagaagcaccaactggctacagaaaatctgggcttaaaatctgggactgcagcaaatcccagacgcaactggactctgcctggaaccgccaccccccgactggactgcctggaaccgccgccccccgactggactctgcctggaaccgccgccccccaactagatagactgcctggaaccgcctcactgcttgtccctctctaggaatgactccccagccgggctggtggccttgtggcctggtgtgcattgtcaaggaaaacagtttctgcagaaaagacggaggcgcctccagctggctaccggtcactgatgttgcctccatgttcctgctgctctccttccccttccctgcacagccaggcctccagctgactgcttctgcatccactgcctgcgtgctggctttcctcacctcgcactgccagggtcccccaccgtcctttcgtgggggacaccctcatctaaagatgcgggagaggcctggagttcgtcacaagcagaggtgtgcagcctcctcggccactgtctgcaactcctcacaggtggtctgctcctacacacacatcgtctctctgtttctctcacacccgtgctcacgcacgtccattttggtggcttcctggagcttgcacagctgtcatctgaaggacagcaaaggcagcaacccaacccgacacacctccctccctgactgcacagcagaggccctggccggggctgagctagacgcactcctgggtgccactcggcctctgtagttagggcctaaagcctaagctgagcagcaggaggtggccctgacagtggcctggagacagaggctcctgatggttgtggggctccaaggtggagcatgatgggctcctgatggtggtggggatccaagacagagcgtgacggggaagggaccctgtgaggcaggctgtccttcctatcagcgttgtcctctcacagtgcaaagcaggcactgaatgaggccaccatgaagggtgccttgtgggtctatgcagctctggccttagtatgcgactctggctatttatctatttatcaaataggtactttgttcatatcattatttaaaggcaacgtgtgtgtatgcaagcgtgtatgcatacacacccttctactatgcctaacccagaggagggaatcaacaactgttacttgattgacattacatgaaataactgaggctgattctagaataaaatagactttctactgagaaatgccattgcttccccattcctttggcaatggggatgagtcactgacggccatactacattcttctgaagtcactgccctgcatctgggcattacatgaaatcgatgactcgcctgcac

SEQ ID NO: 467645 - DNA, 1159 bp, Homo sapiens
ggagtctgtgagtttctggggaccatgtgtttgtgaggttcctgttctcaggatctcatctgtatgctcctggggtccttgttctggaggcctgtgttcttggggtccctgttttcggggtctgtgtgtttctggggtctgtgtgctcctggagtctatgggctgctgattttcatttgcttctggggggtcatgcactcctggggtcatgctgactttgcagacatgctgggacctgtgttccgcttcctgctacactttcccctccttcaatgctccttattcatcatgcctgccttgctcacccaccgagggcgaggggagtatttttggcagctggcgtctccatgtgatgactctcagggcagctttgaggatctgagcttatggcctcagtggctcgatggcagttatagtgcccctaacagctgttactccttgcaacagtggatcagcaatgaagctgagcttgggcttaatggaaattgtcccttgaacggtttgaatttggaacgtttattctccattaatttcaagaaacaaggagacacaaagctcttccctatcatccatttcccttacatgcccggttgcttccagacctcctcaaaacttgttggaaaactcagaccctggcttggcttcagagaccgctgcttggagtgcagggatactttttgtagattcctcagggctcccacagctgtcaacagtaatgagagtgaagactttcattttgcctactggtttgcaagattctcctgtatcatagcatcctttctcaaaggctgaaaaatgataaaaagcttttgggggggaaaaaaaaaaaaggaatgtcattgagcacacttttgtatattttttcatgatttaaatgccttcttttgttcattgccttttctttcctattattttttctctgctgcattatctgtcactttcgcacagttggcagaagtttttatgaaatatttgctggatatggtgttgtaaatgtcttctctcactcagtcagcttgccttttcagctttaatgatgacctttaatgaacacaaattcataattttaaaatagtcaagcttatcaatcctacctattttagttcataatttttattttctatttaagaaaacatcccccactccaagccatgaaaac

SEQ ID NO: 467646 - DNA, 924 bp, Homo sapiens
cgtggccttcctataaggacaccagtcattggatttagggctcaccctaatccagtatggcctcatcttaactcaaaacatctgctaagaccctattttcaagtaagatcccattctgaggttccagttttactgcttttcagccactaagccaccctgggggccatgtcttgttctccagatggcctcaccccacctctgtcgaagcgttcctgcctcaggcatgaaagccaccacgtggcaaaggatgaactgggaaaggagggagtgtttgtttccgtaactggttataaggagaaggtctggaaaatattgctagaccaactcaaaattacacagttttccagagcttgtataccttcgaagctgtatgtctacgtgcaagtgtacattcgcctaaagactgtggacaagagcctgttgatccatgtcatcttcacgctgtggccgtcaagttttcctgccttctctaaaggcatgcaatgcttcaggatcacagtaagtcttgatatctgttcaaggaattaccctgcccaccacagatcaccatggtatccttttgcagaagtgtgttggctattcttggccatttatttctccatgtatgatttacgataatcttttcaagttccatatggaaaacgagtctcctgggatttgggttaaatttgcattggatggcagatcaagctcttttaaataaagttttgttaactttctctgagagagacttgtggatatttggttatgtttatttctggatacttcgtatttatatcgctgtcacaagtaacatcattgtaagaacattcatttgttcttcgagttgtaagaacatttagagaattttgaggagaggcccatgtgtttttgaatgtttttatacactgttgtatttactttggtaatattctgtaggatttt

SEQ ID NO: 467647 - DNA, 655 bp, Homo sapiens
cctaccggatgctgactgacggagctcacccgtgcaatcgatgagtctggtctctccgctctcggttctggagcctgagccttgttcttctttactcacacctctgctggtcatcccccaggccatctcaggtaccggccacactgccacgtgtggttctaggagagctcagacctgcctgattctggccgttaggaccagaacccagctgtcctcgctgggggagggcagtactgacccccaaggtggcaacattcaggatagggagaaccatccagacaggtgctggatgatcctggcagaagccacagacctgcccaggtttgtaaacgagaactggtgcagccagctgctgagaagacgactgctctcacaggccagttgctccctgtgtgatataaaaagagttaaaaaagaaaaacgaaagcaactccaaaaccgagctgccgctttgggtagaaacatcccatgtgtttccgtgtgcatccacccatatggcatggcgagacgcctcctgcaggcctgcccccagccctcctgagtcagcagctctgggaccttagacttgacattttcaaatgtgatgtcattctatgttgcctttttagacccaaggtcttagcatggtatgaagtaaatgactgaaaactacttt

SEQ ID NO: 467648 - DNA, 766 bp, Homo sapiens
ttcttccttttgcatcaactcgatgccttttgccagcaacggtctttagttcagtttaagaccacccatttaagctggcactgccagcgggtcatgccaatctgtctctgccaaacccttttggttgtagatgatggcaagtttggaaataagccaaggaccctgtgcactggccctgctcaaggcagctcagctgcactggcccgtgggaatgcatttgacctctgtctacagcgtggccaggatcagctgcactggctgtttcaagaactgccacatcgcacctctgctccactctggatcctcagccaaccccgactggaccctctgaacaggcgggatctctgtacccagtatctttacatctcaagatgtcctggttggagctcaagggagctgtggagctgtggttttggtcagaagcagatggacgtctgcagggtctgcatagtactagcgagagctgcctgcctgcatggtggggcgtttcatctcttggcaaagctgcagcagacgttggcttcagagcaggcgggccaggagaggagctgtggccagacagccattgccaaggaagggtctggggctcgtagggtgccacagatacccacacccggtcagtttgtcacaaagaagcaggtgtgagtgatgcaaagccttgtaactttagagaatgtgactttgtttcaaaacggggtctttgcagatgtagttagttaagatgaggtcaaatggcattggcatggactgtaaatctggagtcctt

SEQ ID NO: 467649 - DNA, 746 bp, Homo sapiens
ctgcatcttaaattattcacatcaacttaaaaatatctgtgaaatgtttttatatctaaaaataaccttagcaagatttttctggtctgctttatgagtctctctggtcgggtcaccagaactgtgctgtgcactctctcccctggagagatttgtttgaccggagggccaggtgacttggcagataagctccaggcctttcagccacctgcagagaatcctgtcaggacaggcaccctggtggctgggccggtggctgccctccagacctatgcctacgggagctacatccctgccccacctcctccattccctatccctgtctcacctcgggagcttcccactgggattgacaatgtggaactatggtctgcatttgggaagagggaggagcaggagggcttggcagttacccgctggctcctctccccaccacagaagccagaaggcaagggggctattgatacggtccatgctgaacaggcactgaaccaaagagaagagctgggaatataggcctgcaggggtaatttgcaaatgaatacacctttgtctccttggtaccgctggctggcaacaacatagacaagaagtataattgcattagggagagttttgctgccattggtttttggttaaagggcgcagccaggtgccaagttcaagtgttcctcatcccctgaaggtctgttacctgccgcctcttttcaggcaacaactgctgttttatatatatgtaaaaaaaa

SEQ ID NO: 467650 - DNA, 625 bp, Homo sapiens
gaaccccagacacttagccgtgcaggaacgatggtgaacctttagcccgatcaggagcagcaatgggcacctcgctggatcaggagcacagcagacaccctgccggatccggagggtccaagtcagcggcgggtctgctacgccggcaaacagcagtggtggacggcgagcgaaagctcagctcgagctgtaacaaacacggaccagaagaccatgactgccacccacccacagtgacctttccaaagcggagcatttgctccagtccaagccacctgtcctcaccccagaaggaagtccactgcatggcaaagaagcccccatgggctctggctcacctgcagcttccccaccctcatctctgcccccaccctgtgtggcctgatctgcagccctgcagcttccccaacacagcaagtggcctgtatgttgtgggtcctgctcagccacagcccaggcgtcctctctgcagagccttcatccaccagactgtttggatactttacttgctgtgagcttctcacaggtaagaatcactcctccttcaatgcgtcttcccagcacccagtccagatgttcacaccaagtaaacactggagaatcattcactggaattgaagggggg

SEQ ID NO: 467651 - DNA, 623 bp, Homo sapiens
attacaccttgagaatgaagccagctaagagaaaagcccaacctacagcacagcaccacccccagcctagagccaccaaacccagccaaactacagcctgaatcctggccagcctcaagctaccagcaaccagcctagctgcggaccagcacctgcaagcactagaatgagaggaaaaggaatcccatgccctgtgaattggggtgagcctctgttctggggccggagccggacgtggtttcaaggctacagccccacagctccactccctctgagcagcacctttgcatgcagccaagcagccaggagtgtgacaggagagaccaagcaggacccatgccccccaggcctctggttggccttgctgttggacaagtccagtgccgcagagcctctgtggcctcttctggaagcctcctggaatgaacagatggccgtgcagagtggctcggggcggtcatgcttgcagcaaggctcagcaaccctggcctctgtgcctgtggcctccccgccccaaccaagcccccccaccaaagcacaggcttctgggagaggcattctgcccttttgaggctcaccctgggcagcagagggagaggagagcaaacaaggtggccaagcct

SEQ ID NO: 467652 - DNA, 960 bp, Homo sapiens
cgccccccagaaccccctgctaccagccatggtcaatcccaccatgttcttcaacatggccgtcaatggcaagccctggggccatcaaacagcccttcgagctggtggtggcttcacacgccgtaatggcgctggtggcaagtccatctacagggagaaatttgatgatgaaaactgtagcctgaagcatacaggtcccggcatgttgtccaaggcaaatgctggaccaacactcgacccctaccccgcccccagccctgtcacccaccgtggcaccgccctcccgcggggacaattggcctggaccaagaatggggagcctgaacagtggccggtctcccacccgctcctccggagcctgcaggggggttcagcctctgtccagcagacttcctggccccaagaacgggccttgggaaggggctcccctgactccaagttgacagcagcccgtcccttctccttagcccaagccactctggcaatggggacctgcctccctcacgctaaccaaggaccggtctgggatggggagttggagatgggctgtgaggactcttctctcagcccttaagagtccagaacttatctgggaacacatcagccaattttctgttccctttcttgccaggaactgcttttattggaagaagtctatgtatatgcatgccataaaggttgtttatgctgtcatagctagatttttattggttgtatttttgctgcacttgcttgaaaaataattattttcaaagaaaagaagaattacatatccagtaaactaaataagactcactgtttattagagacctctgacagctcctcaaacacgaaaaaagatttccaagtagtggatggacaatttatgtgtaagtttatttgtaaaacagatttcaaaacatacttcatcttgactctgccaataaaaatacattccatttcttttcagaagtatgtctt

SEQ ID NO: 467653 - DNA, 697 bp, Homo sapiens
cctggacgggagcccgatgggggtcacatgctgctctatggagctccttgaggcaaagaagtgggggtccatgtaccccacacaggacagcggtcacccctgggccacccaatcatggagggtgactccaggtacctccagtttgcgggtagcacagcagccaagagggctcctcgaaagccaggacttttggacaagggatcccgagtacatctgtcaattactatggatgccagtgaaaccgcgtcttaagtggaaccatctggaaagacaaggaagctttgtcagagtctcctcccactctgttgccaggaggctggcccagcaccaactcaaggagaaactgtgggtccctgggagagtgggggaaggccccttagggaccatgcctggatggggagattctcacgtgggagacaagccactggtggtctttgggatcctgcccagagggaagcgctgcccctcatggctccaagctccagtggccgtaccagaagatcaggggtgggggtgccgtcatgagcaggatgagggcagcacccctgagagccgctgcatgcacagggctcaacagcaaggaactctcatcttccccatctgcaactcagtgcccattaaacgctaaatccctgctgtcccctctgggcccttccaagtttgcactaggaccaccctgtctttctaccaagatgcc

SEQ ID NO: 467654 - DNA, 1831 bp, Homo sapiens
gttacagctgctggctctgagtgagatgagctcctcctgcatcttcccaagggtgaaggcccccatagccatgctggtggtagcatgggccctgggcggacccgtggccaaaatggacgagggagagaggaaaggctttcagttttcccctattcagtatgatactagccatgggtcctttgtgtatggcttttattgtgttgatgtatgttcctttaatacccagttttttaagggttttaatcatgaaggggtgttgaattttatcaaatgtttttcagcatcaatcaaaataatcatacggtttttgcccttcattccattgatgtatggaatgaagggcaaaaaccatatgatcatttggatatatggagatgtctacctgtatctttactttgtaggcaacagattattgagtcttgtttctgaaaatccattcagccattctatatcttttgactggggagtgtagtcaatttatttaagatgattttctctggtggcgtgttttaacttcttgctttttattttttgcatatctgttgtatgtttcctgatttgaagttatcatgaggcttgcaaataatatcttataatccacgattttcaactggtgacaacctaacactgattgcataaacgaactaacaaataatcaaagagacaactaatagaaactctacagtttaacttcatcaccctgctttttaactttttgttgtttctatttatattttattatactatgtcttgaaaagttgttgtagttattactttcagtaggttcatcttttagtctttctactcaagatatgggtagtttacacaacacagttacagtgttataataggctatgtttttctgtgtactgactattaccagtgagttttctaccttcagatgatgtctattgctcacttaacatccttttccttcagatcgaaaaacttgctttagcatttcttgtaagacacatctggtgttcatgaaatccctgagcttttgtttgtaggggaaagtatttctccctcatgtttgaaggatatttttgacggatatactagggtacatatagtagggtatatactggggtaaaaaattcttttctttagcactttaaatatgtcatgccactctctcctggcctgtaaggtttccactgagcggtttgttgtcagacatggagctcctttgtgtgttatttgtttcttttctcttgctgcttttaggatcctttctttatcactgactgttaggagtttgaatattaaatgtcttcaggtagtcttatttgggttaaatctctttggtgttttaaaaccttcttgtacttgaatattgatatctttctttagttttgggaagttctgtgttaactagacctttgaataaactttctgcttctccctctctctacctccagtcactcttacatttgcctttgaggcagttttctagatctcataggtatacatcattctgggaatgtgctgggtcacacttgaagccagtgtggttctgagtcttgccccagtcctgtgtgcctctttccttaatatgttgtcaataccaggatggactggggcatccaaaatgttactttgagggtcccatcctttgcacagagagctcattcaagttttcaaagcagaattttctggcctaagggccaagggcctctcctctcctctcctctctttccttccttccttccttccttcctctcctctcctctcctctcctctcctctcctctcctctcctctcctctcctctcctcccctcccctcccctcctctccttccttccttcctctttctttctttccttc

SEQ ID NO: 467655 - DNA, 623 bp, Homo sapiens
gcggcatggtgcctctcgttctgatgttaaacgtgtccaccgtggatcttccctgcaggaatggaacacctggaggtcaggacccacctgctctcttcatctggtttactcagttacagagccaggcacaatgtgggggctccctgcctgtggaaatgtggttccagctgtgcagagctaaccctgggaagcaaaagcacacatcaaagctggcggaacagcccagcatgggacaggggcccgaggaatctgcacagcacaaccgtaaccccaagttccccaaggaacttcgcaagcccaagctgcagaacttactcaccagccatggagtcctatccatagaagacaggatccatgtgagcacagcaaccagaaaccctgtggttctgttaaaaatatttctgatgcattcattcaatctgtttttgtatatccattaagagtattccctcaacttgaaattgtatatatttgtaccatgaattgtactactcaggaggaagtcatttttataaaatgtcaataatatattccttgcatttaattttgaaatgatcagaagagatgcataatgacttctctccagccctgtgggccacatctctgatccagtgctccaggtg

SEQ ID NO: 467656 - DNA, 964 bp, Homo sapiens
tttaagtgagccgtgttcaaggttgcccagccagtgagagcgggagctgagttcaaggctgcactgcaggtaccagaggccagcagggagcctcgtccattgtcaccgatggcgctgctttcacattcaattcataacgatcttgctttcccagctgtggtcggctggaagcatcaagctggaaggaattcgagaggactcatggaagatggcatgatgacaacagagatgacggctgacagcctgacctgggggatggagacaaaactcacgggcagtagctttgctatgtttgctacgaactggcctttttccctcactacggttttagggatgacttctgtgaccttcaattctaagttgtccatggaaatgcacgggaacaaatcccaaactccagccaagcttccctttgatataacttttaactatgatcttccagacatcttccaaaacttcgtcatctggaaacaaggagatggccgcgtaagcaccttcagtccagccgtgaattcaccattggtatttaccattctctcctcattagttttggaggaagaaaaagagctgtggagtggccagaaggacggccacagagaaatgacaacagtcactgtcacactgaagcccgagtgcctttaccagggtgtgagcgatgtcaccaccgtttcctccttcttcccagccaccgttccggcctctcagaagctgattttttccacctccacctccttcctctgctgctgtggctgcactccagagcctgcccgcccgaacccttctccaaaggaatcgactcttctgcagttcccctccccgtggcctgaagacacagttttcctaatagagcgtttcatagcagcaaagcggttgtcgataaacccttcaggtcgagcagagcccgtgagtcaaaggaaatccgtgctagtcattgagcactgaatgacttgtttcaaactcaagt

SEQ ID NO: 467657 - DNA, 811 bp, Homo sapiens
ccttctgatgcttttgagattccttctgctctggtggagccatttgtgaaaaacaattcctagttgcaaaaggtgccctacgtattgcttcctggtctttgtcccctcttccccccacccccaatttcaggagtgggcggggacagagagcagtgctgtttgccacaagatggcgctctccatctgcggtccacgcagcatcctgtgcccgagcatcccccgcacccccatagctgaagcaaaggagtggtcaggtgccaggtccaggcacgtgttgcctagcaacatgttggggcctggagaagctgacatcaccttggaagagagcagcttcacgcccaccaacgaggggatcagtgcttctcatactacctggaccatcaaccagatacaagaaattcatcttacgttgcagctcagtgcacacataagtaggtggacatgtgtatattcatatttatatttacatctggactcaaatttcacttgcgaaatgggagttgggacctactccatggatgtcatggatttcagtcggcagggcctgtctaagctagggatggttttaggcaagggcacgtcatacgattctggccataagaagctgagtggctccttgagggtggcccatgggactggtttggggacctgattcagcataaactgaaatttgtgatttgacctctgtggttttggctacttgtaggtaacctagaaggctcatggcatatagtcatttgtaatttgctgagccacatatttagattttgtatgccataaaatggattctgtatgctgtgaatactgaatc

SEQ ID NO: 467658 - DNA, 727 bp, Homo sapiens
ggcctgtgagcagctgctggcttcaacgcttttggggtgggtctcagagccgcagggcgagccctgtccctgggagagctctggcttttgttacccttaacatgtttcttcatttgctcaagccctatgacccagcaggcctctcatccctgccactatggcctcccctgcatgggtcccctctttagcctgcctgcgctcctctaattttcagacattccctgcaggacccgctgctccctgctataggggccttcctttctctacctgccagtgcaggaacacaagacctatccctcctcctcctccccctcctcagcctattcaatgtgaagacaatgatgatgaaggcctttatacttactttattgtaagactacagtatacaatacaggataaaatcaactgtttatgttattggcagggcttctggtcaatagtggacaggtttttggaaagtcgaaagctacaggggattttgactgtgtgggtgtcggcgcctcgagcctccgcatcgttcaagtgtcaactgtactctatcctgcattcaaagaaacagcaacctcttggtcatttagaactatctgcaaatacagaatatatatgaaagtgctacagataggaaagcactatgtaattttcagatactgttattagtaataatggtgctctgccacaaatacttctcttgaaaacctgcagaatcatgggaaactagcaaagacac

SEQ ID NO: 467659 - DNA, 933 bp, Homo sapiens
agtggttcatgacggttaaagggtctcggattcaagcttagcctagtctccctacttaatgctgcgggatcctggaagaagatcctatgggaatgcagctgaccttcccgcttaatttcattaacggaggctcggtgagcagggtggaagcaccccctgccctgctggggccacctcgctgaaggtgggtggaggcggcgctgcctccgggcatatccatccacaggccactgaacggagaacggcctgcaccttcccctctgatgaggcttctcagcttgtgcctgtaatggacaatgtggccgcgtattatgaagccgtgattaaggaattgggggaaagggaatattgccaaattaccctcctcaaccaaggacccaattaccctcctcaaccgaggacccattcatactgttttgaagaagctttgagtgttcttttcctcatccgattgccagaactggacattcacttgctgcaaccatgtgctattccaggcaccaggaatgtgcagaggaaaacgtcagccctcgccaagctgacatttgtatgcgtgagtgacagacagcaaatcacgaataaacaagatactggacaagctgcagaggcacacactttgtgggacttttccctgaaaggtcccattcatctcttcggtcgcatctttgcaggccttcatgggaagaatattgttcacctttggctggggacagttctaccaggccctgctatttactcaagaacaatgcaaaacaggccaaggagcatgcgtccacagaaccatcacccggtttcacatccattccacatcacccctgatatggtttggctgtgtccccacccaaatctcatcttgaactgtagctcccataatccccatgtgtcatcagagggaccccggtgaggtcattgattcacgggggtgggtttttc

SEQ ID NO: 467660 - DNA, 3790 bp, Homo sapiens
gctgggagggcatggaaggccggcagcgtgaagcccctagtgtccacccagtgtacctttgaaatgctttctttcaggtccctctggaagggattatgtttccaggggtccttcgttgtcatattcccgcccgctgcattttgctctggactcatggctggaccttcaaaaaaggccgacatccactccttgccatcttcaacactgtttaccactttcaaagaggaaaacaaggccagcagctgtgtgatgtgggctgagctttttggcattctctgtttcctcctccataaagtgaagactctcaaagccattaactcacctactcgctcacctacacagccattaactcaccaactcacccacccacccattaactcactcacctacccacccatcaactcacccactcacctacccacttacccagtcacccacacattaagtcacccacccacccacgcattaacccacctactcacccacccatccacccgttaactcacccactcacctacccacttacccagtcacccacccacctactcagccattaagttgcccactcacctgcccacttactcatctagtcatccacccacccactcattcacccaaccatccacccattatctcactccctcacccactcacccactcacccacccgtcactcatttacccaatcacttacccacccacacactcacccacccagccagtcatccactcacccacccgtcactcatttacccaatcacttacccacccacacactcacccacccagccagtcattcacttacccacccacccacccaattaactcacccactcactcaccactcactcattcacttattcagtcactcattcacccgcccactcattcactcattcactcacctactcactcacccacttattcacccactcattcactcatccacttgctcatcgtcacccactcacccacttatttactcactcactcgcctacccacccactcattcacccggccactaatctactcacccacttattcacgcactcattcactcacccactcactcatttatccacttatttactcattcacccactcacccacccacccagtcacccactcactcacccactcaccattcactcattcactcacttatccactcattcacccactcactcattcactgactcattcacctacccactaattcactcactcacccactaattctctcactccaggtctcctcggcacttctggcagggtgttatggatagagggatggactgaagaaatttacaggattatcaagcaatctagtcccactggagaagaaatgcaaaactctatttctgagcaataacaaatataatttaactccacccactgattcagtggttgaataattaactaacatgacttctggagatacagattaaaataaatagacacaatctatcagatgtcatcattgcacctaaaatatatatggaaggattttgttcctgccaacagattatgaaacaagacagatcttaaatcactggcctctatttgaacttacaaatatttttaattttaaaagtgtttagtaactttcataagtgaagttgtaacggtgtgacaaaatggaggagtcactgagctggacaaatattttcctaatggttttgcttttttcattcctttaaatatcaagtaataatatttttaatgtttttgtaaacatgagatgttttaatgcttgaaaaattgtatctcataaataagctgtattatctgtcaaaaaggatgaaaatataactttacatttctgttttaaagtaattttagtgcctattagctataaagtaacagttatatataatttagagtatgtagtcactcgaaacaacttgacattttcacacaaacacagaaccgtaatcatagtcttgggatttcattggaagtatgcaccactacaggatattaaaataacttatggggcactgtaattcttgttttgtatttgtccaagtagttgtgaagcaggctataaagtagcaaaataaaaacctaagctccaactccagctaagctgcgttcttaaagttatagtcatcttttcaaattaagtgtgattaacctagctgacatttcttggtgtcatctttgactttttcctttcttaatgatattttctgttttggtgacaaattctatttatcgtagcttattatatgaggcagtgtaattgtttccctaagataaaaactctgattgcgtgtagttgcaattctgctctttaattgacaaagggtacattacttgttgcttttaagggagtgtggacatgaaagaaatttttgcttttgctaaaacaaacaaaagctgaattcttaagggtggttttgcctactgttttaatttgagtacatagacaagaatcactagtcgaccggtgtgaggctgaaaatgtttagcaaatggcaatgtgtatacaggatgtgtgtggaaatgaaactgagtattcagtcatactccgctggcttaaaggacagataatttggaaacaggctggtttcaagtgtatctttgaggggtctatgagaggagtattctgcgaatattgtaaaccagatgtaagggcaatatttaacatacttaagagaaaaaaccatttaccgcatcatttatagagctgacacataattacgcttgcctcattaaagcaggcccaacattatcctctttctggcaatgcatatcaccgtatgcccttgaatagaatgaaaaggcatttctttaaaatattccttaattgtacttttgcattaattttgattggcctttagctcattggtgaggtctcccagtatcatgcgaagcagtaacacaataaatgaaaattcatccataataacgagctctatagttaaatattattcctgagagaaaggccaaggaaaaaataatttttgtgtggttgaagatgggcaccatttataatctacatattgcaattaaaaccattcaaggatttgacttccgttaattttaattgaagtggtatgcgggtagggattaggtgagtgcacagacgtgcacaaaaattaatatgaacccggagaaatgtcttttctccataaaaggactgaccaaatgttcacagatggaatttgagaggacccttattgaataaaccagtagggctcagttggatcattttggtagcaattccatatattttatgttggaaaagacatacccctttctttttctttataaattattctcaggcctgattagttaatgtctttaatttgcatccgtgcacctaaatgaaagtaaaaacaaagtagcccaataaatgtactttatagatgatggtttaaggaggtgacaattcttggctaacagatattaattaggaatattaatcatcgacgtctctggggtcagctgagatgttggggacaaaagcaaaatggaaaagaaaagaaggggacacagtgtgaggaggcgcttagaacttttcaaatggaagaactaatgagaaatttggaactgcgagataagaaagctctaaaaaacacctccacgtagtttcttctggtatttctgaagacaagtacagtgggtctcacaacaggtgtgcaataaaacattctgaataaacaaaaagatgaattgatagattgcattttaaattttaacacagatttctccatacatttagataaataacacaggaaagttcaaaagcacaccaccttagatttcagtaatttgtgatctt

SEQ ID NO: 467661 - DNA, 597 bp, Homo sapiens
cccagtgggtggcatgaagcctggctcctcgtccagctagccatcagaagtcagaatgacctggaagggccaggggcagagctgtcgtgagcagggcctgggagtggttatgttattgctctccaacaccatcagaatccaccaggcattttcctccttcctcctgccagcatttgctgggttcctgaaagtcctagcgagcaggatcccaaatggcagagggatgcaccctgatgtccatagtgtgcttccccgagccatccaggagcaggggcctgtggtggagacacatcctgagctgcctgcctcctgggctccatactctatgagagttgctgagcttctcgtgctgaggagctggctgtcctgggaaggaggaaggtgttcaaagcagtccctcagccctcgtggagatgctgccagggctttgcctcagagtgagcaaggtcttcccgcagcctgaaagatgcccacagttctgtgtctgtgttggggaggtcagtctttggttgtattcaggccttccactgattggctgacgcccctcacatcatagaggataactgctttactcaagtccactcatttccatgtgaa

SEQ ID NO: 467662 - DNA, 663 bp, Homo sapiens
tcacctccaaggtccagtagatacagaacgggaggaagcaagttcttcctgctcctttcctggatgagcctgattttggcatgtggcagatttatgaactcttccgacacagacctggaaagaagccgcttgggagcagagcccacggtgctcctttctactgaactcctcaatacgattcgatgcagctccctcccacgccatcgaggaataggacttggagcttctgtccaaaagcttcgagagtcatcggggcctcttttggtatttcagctcaaaaaagatggaaaggccttcttctcctgtccagggagcaacctccctgaggtcaccaatgatggcttgcatccctgggcaacctccaggcacagtgaggacaagttaaatggggaacccacaaaattggaatttgcattcgggctgatgacgatggaaagacaatggtaatgaaacagaacttcagtttgatgtctggaaaagaaaaacaaaagccctgaagctcagagcatattttttcatgtcctggaaatgtgcagtctccagctctctgggtcgtttcgatgtggcgttgacaacgttggcacaggtagacccttttttcaggaagccagtcaaattcagaaagaaaatctagattgagctgttcttctctgctggctatct

SEQ ID NO: 467663 - DNA, 638 bp, Homo sapiens
catagatagatccttttcgttcctgacttcatgggttgaattctcatggagaacccccaaagcccccacccacctccaccctgcctgcagggcccttgtcattgccctgcacagggacagctgctctctctctgtgctctgacttacccgctccaccttggttttggctggatgtgtggccatcagaagctcagtgctatcctcctgccaactctaccaatagaagagaggtctctcacaccaaggctatcagaacagcctcagggaagttctcagtttgggccacatatctattcattcattcaatcagtaagtcaaaccagcaaaccagccattcattcgaacaaatatcgactgatcatccccaacatgccagacacattccaggcgcgagggacatggaggacgcttggggacaatgccgagggggctaaagccaatagtgatagtgctgactaaacagtcagtgggccttcttggtcaagagtgattgtcctgggaatggagggtggcgttcaagcccagccccttggttgggacagtggagagcaggcaggacactaaaagggggactgcactctggggtggataaatccctttcaggctccaaggctagtcttgtgaggtcttgaggagaa

SEQ ID NO: 467664 - DNA, 2457 bp, Homo sapiens
ttactcagtgagaatggaggattgaagccacacaggacgctgtgtgaggattcagtggactgttccggaatggtgtctgagacgccacccagtgcccctgggggcccaggtctgcaggtctatgccaagccatgcctgccctcctggtgcctccagggtacctgcaccttctgtggctccagtgggggccttcccatggccctaaggagcttggagtgtccaggacctctgctgcaaacaactgccttaggcctcccaggcctcacctgggggtcactgatgcaaaaggtggctcccccttcctgtggtccctctatagcctcaggcagcttctgaggacacttgatggatccatgagggctcttcaggccttcagaaagaaattcaggctggatgcagccatggctgtgcactgggagatggtggctttccaattgcaccctgttccgacaggtgccaagtggactgtgctaggaatgcattcacctgagtgctatccactgatccaaagagaattttacattatctgatgggacaaaaagaagagcctcagactggagccacacttgctgccagtccaggacccaccttcatgcagtggagtagctccagtgcaagctccctcatcctttgcatcttgtcacctggtctctggagtagaagatggcacagttgtcctgtgctggttaatgctacaatgtggaggtgatggcaggtgacgtggtccagaggcctggaaggcaaaacaagagacccatttattctgaatccagtgtggtaagaatcctctgaatcccacggacccagtgagaccttgtacaaccctccttgcacccactggaagcgtgtcatcttctcttaaagactatataaaccacccataatcgaatccaattaagaggagatagtctagctttaaacaaatggtgaaccaacagagcatcctctggtgagctacaaattttatgccttggcactttcagatgttgtcaggccaagcacatacccaacttggagccaaatacactaatgctgagaattagtttcaaagcacatgagagactgggaaaaagagaatgatatttaggacttaatagtttaaaggcccagttcactctataggaatatgagcagacatatcctactggcaatggtaccgattaccttttcatttcataattaaaacattccaggagtttgaatttacaggacattaactcctttttagcaaaccttataccatgcacccttcctttgccccagttaagaaaaaatgtctccatggagacagtcaatgtttttaataaaaagttgataatccatttttcccatatgttaaaagtaaaactcaagttagaacttatgattccatgattctatgtgttccatgtggagtttttcctttcttgcagtctgagccagagaagtaaagacgatttacaaaatatagggaaatggaatcatactggcctgtttgaagcgacacttcacacaagtatttctgtgtgtagtgctcatcaaataaaatttcctcttctttgcaaaagattccagtctcactgatgttttttccttttggaaagtaacagatgaggtcatgtagctttaatttttctctcttccaacagttatgaaaacttaaagatgagagtcacaagctttaaactgaaagaatccactatttattagtggtttgaacagaggagggcgagtagctgggagtggtgtacttggattttatacctggctataaacccagtaatagaatattacatctttttctcaaatagagtcttatatcccctcatttttctcatagtctaaaactaaagtcaagggagttcttagcacttgtcatggtcatattaccttttactttgcactgttcaaaaatgttgtttttgcaaacactttactgattgcgtgaagacctgatttactttattttagaaacaagagtaagatgctgaggtccttactgagtagctctcattctgtgatgagaaaaggcagcgtgagaaggagaacagaacaggcacaaaccgtcagagcatccctgaggacccaacccatcgcacagccttgactctcttctcctcttgtttctctctcatgcctggagccttgcaggctgcgtggaaattgagagtcctctgtcacgggtatgcgtggccttatctggctccaaggaaggccacttttgtttccaagttgccattccattcagaagggtgtttaaacttagcatgtgctcccactgaccaaagagaggctggaaatcgcatcactaaagtcgtatcatatatgtgcttctattttaaggcattggaggaaacacaggagaagaatgaagataatttccaggttggatatggatccccaaccacagtaaaatgaatgactctttccagacacacaactgtgctccggggagggagctgtccgacctgtggggag

SEQ ID NO: 467665 - DNA, 749 bp, Homo sapiens
ttcagtccttgccctccctgaaggctgtggcttcccaggagatgcagccaccaacagttagcagcagcagcttggcagcctcctttcatcagtggaacccctttccagccctggttcccagcagtggcctctgcagcccatggagcctggttagctggtcaccaactgcctgtccccagcacaggggtcttaagcctaaacccatttgcccacttgctgtccctgttcccttgggtccaagagggcatgggttatgtttttctgtgtgccctgccgggtgtcgagcctgcagcaaggcacagtcagtcaggcctcggagtccgtggagagtgaggaccgctgcggagcagtcggcagccaccaagtgaaggcaccaagggctgcaaggccgagccctgaggaacccatggtgaggaggacgggccgcccagcaaggaggtgtgaccaggccacattgtgttgggagttcagcggcatcaggctgaaggagtgtgcactggccatcagggcccaaagctgcagccacagaaaccaccgcatggaacaaggcagcagctgggaatgcctgtgtggcccaggcctcaggggcttccaggtgcaggagagaagaggtcagctcaacaaaatcatgtgctcattgcacgccttcatcccaacagacgccaaggacagtgacattgactccatccagtttgtcccttattagtgaagcaggaagaaggactgagttatagcagctcttatccttc

SEQ ID NO: 467666 - DNA, 847 bp, Homo sapiens
gcaagctacactcatggactagtcaagaaattcagaccagagaaagccttcaatcatggtttggtaaaacaatacagaattgcaagtagatgaagagcattaacctgtttgttccagttgggttgctgggaaaagaaatcattttccacatcatttttaatattactctttgtccacccatcccgaaggtcattgaaagggaaatcgttcgcttgttcgttcattctattcagccatctttgctgagctctgctctatgccaggtacctggaagaagcacctttcctaactctcattttatgcttgttgatattaagatgtcatttgaaagtcatactcagtttgttacttatcagagtttttacgaagcagtacaccacggcagaaagacctcagacatcgaggttaaagaggtctccgtttgtattctagctctgacatttgtgaagtcatatgcagaagacgagatgccgtaatgtgtaaggcaacacacatcctgctgccttcctgggaagcttattgttaagcactttgtcttagttatttcaatgcaacccaactctataaatccctcaatgacatggaaagggtctgaaatggggaataatccacccaacccagctctggctgagggcatgaactccttctctttctcatttatcctggaggggtaatattaatatacttgattcctttacgagtcagtgaatgttaaactctaacctgttctagtatattccactttgaatgtcactatcaggctattctacacagaggtgggatggcacgttcaggaactggtgacacccctttaaaatgccacttgttatttcttaggatagtttcc

SEQ ID NO: 467667 - DNA, 760 bp, Homo sapiens
gacttcttgtgacccacagcatccgcgagggtagacggcccaacagctggtctgcactgactccctaggggcacacgctccatttttgcacagatacgtgccaccaggtgccatgttggtgtgtccttgtgactcctcctccaacattcttctgcagatggcacaaggttttctgcagttcaaggaggagaatctgtgccccatcaaccagacgatcccccaaggcccgtttagtgggaaacagcaggatcaggcgggctctgcccaccccaggaacacaggcttggaggtttactctccttggtttgtactcccaggagaaaggaagcggcacccagagtggagtctgcagagccaggatctctctggagcagccctgatgaagtctccagggtgctatccaatgccatccaatgtgccaggtgtgacaatctatgccttgtcacagctgcatacatccctgactcagaggccccacctgactcccacctcctgctttagcaggaacaggaacaaccccagattgctgctcaaagactttgccagcagcgtgtcagaagtttctagtgagagataaaagctggcccatcatgaagcctggagaagatggtgagagagtggactctcaacagtggtgtgcaggagccacgcagctcgcaacttgcacctttcatcttgtaccacctctgtgttctgtgaagcattacttagaaatgacctgatgctccttcatcctctcctttctctccttattttcctt

SEQ ID NO: 467668 - DNA, 2346 bp, Homo sapiens
gaccttctccctgtgcacagcactgagggcccttcctctgctttccatgggaggacagggtcggcagagattggcggatggtgcagtggctaaggcaaatttgcaactgacccgcactgcactgacctgcacttgaggttcgtcctgttccagcactggtgtctctttctagaggtttctcaatgcattgcacttcttccagctgcctctcactctgatgtaggtaatctgcatgaagcgctggcaaatgcaaatatgatctatttgtcatcaatgagaaagtgaaaccccaccccagctggtgccttccccacatctgcccaccatgctttgtgctctgtggggctggcatcctggcctctcttgccctctggcttccagagggtgtgggccatgggaggagctggcaggagctctaaagaaagaggagagagagatcaagatgtggactctcctggtgcctttcttgagaggcttggccaaagccctcactgggctggcaccactgtctgtgcctttaccaggcccaggttggcaacagcttcctgctgctactagttcccagggcttcaccattccttgctcacttcctcactctgccgctggcttggtaaacagtacttcaaggagaccttctgcctgcatctgccagaacctgactgctggagatccttctctgctttccgatgagcccagcctccagctggtgaccgtggccattgtgctttctaaaggtcactagaatcttctcttttctcttttgtgcttaaactgatgcaattcccccaatgaatgtgttgtattaaatattaggcttcttaatctactattttattaatatatcttaatatttaatgctaacattttatgtggagttctcagttgtattaatctagtaaattttgctaataaaattaattatttttctattttaccttttgaatagtaaagattatgggggagtaaaaataattagatttcactggggtgagtgatgggggagaacactttattttcctgaaaatggttcctgttcaccttcctcttactattacctaagtgtcctatagttatctcatgtgaccaaaaatggactgtgaaatgaaaacggatgggtacctgtgaagggcttcttggacaagttttaggatttttagggttggaaaagccttatagaaaatggatgatctttgggtttataaataagaaaaggagggcctccatgctttctcaagcaagagccacctttgctaagaggccttccttcctctccaccccatccctccatgcccaagttggcaggctcagatcttcccgtgatctcatctccagatgacagattcagtcctgcagccagctgggatatgtgcgctgcttccagtggatggcttcgccttctctgctcactgagtgtttgatgagccttcctttcttcctcttccaccttcaagagtgactctctatcaggcgagttgtggccagcagcacttggacaggaggggaagatcccctgctccagccagtggtccctggccatggtgggaggtctgcgtgttgtcatgaggatctcccttccccgaacctgggccctcctgctctcctcctacgtggctcagagccccttccccatcctgaatcccacccaggtcagcttggacaatcctacatgaactggactttttcctctcttgctggcttcaagaggaacaccttaaatctctagtgatggaaagaacacacatgggctgggggagtagagtgtttccctgtttcaacctttccatggtggaacgtggtgctccatggacctggcctgcctctccccaacagcccttgactctgcctctcgctttacctatgtgttacattcctgccactggaacaaactcaagtctccctgcctttactcagtctctctttgctgcctagaattttctatttccctctccctctccactttgtttccttacttaaaatgtgtttttctttaaattaatgaatcatacacaaagaagaaaagtactgaccattatttcaatcaacaagttcatatgttgtccctttagttcagtcccttttctattacaaatatttttggtataatttaaagcatgcttcataatttaataatattcagagatagatttctaagaagcacatgaagcttaaacttcagggaccctagctgtggctccatcctgtactggggaattttattctctctcttaaaggccacacaagttgtgtagtgctcaggcccccaaaacctggatctgcccccgccccatcttcattctatgcatgagtttccccacggtgtcacaagctgtttaggaacgggattcc

SEQ ID NO: 467669 - DNA, 632 bp, Homo sapiens
tcccagggcacatgtggagggggatgcctggaggcaactggggttggggagaggatggaaggagcccagccggaatgctgcctgggagcactgggtcaggggtccctgggaaagatgacaaggtgactttgagccatgccgattctgagacatcacagctctgtgtggaaggcacgctccacacatggggtctctcagtaacagtgagtctgcacgctgccttctcactgacacggagggagaagcccgtgtggactcagagagctccgattctcaatgacaaccggtaccgtatccatgttaacacatcaataaaggcccaggcggttttcagtaaacccaagcccttcctctctgagatccgtccaatctatacagcaagatctacgggactaatattcttcaagctgtggactcagaggggttaggtgacttgtcctaggtcacacagcagggaatgcagtcataacacagagatcccattgtgttctctccctcaatcacactacctggctccagctcctgcacaaatatgtttaatcttagaagttcagagtcctgcaagccatttgggttttagaattcatttctttgatgagggttctttccaaattataaaattcaacttatct

SEQ ID NO: 467670 - DNA, 1237 bp, Homo sapiens
ggctccagcggctctgtccgctggcttgctcagaaatgtgggcctgcccatcactcagtcttgatgcctcttcatgaagtctcctccacctgccactccttccccttgctactacagccactctccgatcccttctgcactgcaccttgaatgaccctccagcagttgattttatgcccttggtctacgaggagagttcgagatggaaccacagtccagtacgcagtaaacgggagcccatggaagctggggcatggatgacccagagaaagtgtgggcgaggggaaggaggaacagatagggtgctcctcaatgcccagagacacctagaactatgcaaaagcatgctttggtgaagaggttcagcagggtcctgccctgtttctctgcctctgggaacatgcaccatgctggtggacgcaggccctcgagtgccatcctgggaccccgccagccctgcagcggggacaaacaaaagcccgggaggcctgaaaatgtaatctgcagcctcccccggctgcgtgactgccggcgctccatcttcacaaccagcgccgccggccgggctcttccgctcttcggaattcagaaagctacagctaaaaatactcacctgctaaatatccttggccctgcccttttcccaaagctgcaccttcagcctgccttctgtgctgctgggactcctcctggggacttgcaacgtcccaagaacatgggtggagtcaaggctcggggggtgtcatccctgctgacctatgatctctgcgtggtatgggggctccgccagcagcagagccgtttctgcccaggaagcctaattaattagtccaccaatcagtggcaaaaagcaaaccccttgcttgagtcctagtttacatgttttttctcctgagaccatccgtgactgtgaaaatcagaggccatgcgatccgacgggggtcactgatgacaagaacctttccagagggctctgggctacactacttatgtttctgcttgttgcaccacttccaaggccatttatgttcccttcacaaacacagcctctgcctcctgtggctgaacttgcttctcgtttttgatgaggacagttctgacctataggcaatcaccccttttgttccgtagaaagctttctcaggttgtggcccacttctaggttagttagccactttgtgacaaatgctgctcttgaggcatccctgggtgagtggtgaggtcactggcttggctc

SEQ ID NO: 467671 - DNA, 782 bp, Homo sapiens
tgtcttttttaaaaagtgaatctgaaaatggactttattttcctgtattcattcagcagaaaagacaaacattcaaaaagcacttggtggagacttcagagagcagtgcccatgggtaatttgggggcatctagaggaggggttgtagaaagctgggggcaagaggccctggtcaaggagagtggaggtgaaggaaagccgagcagccctaactgcctgtctccaagagggagtgtgggctatagcaagtggcacaccaacaccgaaggtcacaaaggctgtgcccaaggacaccccaattactcattcatcgatgggacaccaggcaccatcctgtgggtgggcttggagctccctgagaaggtaggggaagccggcccgtgctccctgggatggacctgtgcaggcttggctgctgacatctgtttcctgaagttggtgttatcagccaagcatgaccccttcgtgcaacattcacaaactgtacattttcttggtcacaatgtctttgtaatagttgggccttatgctgaaaagtcagagtggagttggactcctgtccaggcaatattcacagaagacaagaacttcttaaatccacctctgagttataaagaaaaaccgagtgatgttttctttacatcccaaagctattttctttaacatattgtaaggcttggacacttgtaaccattttaagaagaaaatatttggtgctcactgaaacaaaataaacttatactgcatttttctatgaaaaatactttttgattttacaaata

SEQ ID NO: 467672 - DNA, 1137 bp, Homo sapiens
gggcagggaccaaggcactcagcaaatatgtgttaagtgaatgatgcgtaagtcagcagaagctcctagatgttcagggcatcaggaaggatactttcagtcttgctttgctctcacggaaaccctgagaggttttacatgcaccattgtgaaaggaaaaagctttgtcactattcatgatattgttcgtgatacagtaatgttgctgccattcacagagctagtccgggctcttcacctgtgtctcatttcagtcctttttgaacctttgcttgtcatgagcacaatgaaggaaaaagtcatgattggaggaagaattgaaatagcagacaattttcagcgccggatggtgaatggatgtgagatggtcaatacctgtgttcaggtcaacagtgtttcctgtgctgcctgtgctgttcttgtgatagcgaataagtctcatgagatctgatggttttataagggagagttcccttgcacaggctctcttctcttgtctgccaccatgtgaaacatgcctttcacctcctgccatgattgtgaggcctccccagacacgtggaactgtgagtccattaaacttctctcttttgtaaattgcccagtctcagcccgacttccttttgcttttggttttgaaggaagcatttttactacttagtaatgtttgagcaaagtgttttgtgaaggagaccaaacacagtctttggtgcaaggatatgatgaaggttcccaaataaaaatgcacaggcccctcgtgatgcgggtccctaagtgccagctgtcattctccacccacctgccgtcttaaaactaacctttctgtcacctctgcgtgtctcctcccttgtcctgttttgcagaaccaagctgagtcagtgtttcaagcaggggtgacatgttaacagcttaataatagtataatctcaccaataataatatgctgtcaccctgtctgaagcacaatgtttacaggagacgtggtaatgtatgatgacagtaatttgaataaaaatgaatttactgctcttgtctcatttgcagtaaattttcacatctttcatgcacaactgctgttctatgacctctctcatcattgtgtttgtggcggtggtggtggctggctttaaagtgaaa

SEQ ID NO: 467673 - DNA, 660 bp, Homo sapiens
ctctgggactgtcaccccttgtagacaaatctatggttattagctatgcttttaggtaaatggattgccaatcatcagaaacaagccaacaatgaaacacccagcctggcagcatcagaggcgaaggctgggtttccacccatgggttgaggaacagaagatgtcttgtgtggttaaaggtgataaagactggttccactcccatgatgcctccagtgcttggcttttttgcagctttattgtggtaatgacttttcagaaaagaactaagaaaaacgcagctctcaaggttttgactggatctgagctgacactgaggctctggcacgcagaggaaacgtcatatctgacattctttcactcattcacattcattttgcgcatgtgccctgggcaggattctagcagctggggatgcccccccgagcaaggaaaacaccacccttctcttagggagcttctagttgggattttgttcagctgaattttaagaaagtatgaaaatttgtattctggatacaatctttccctttttctttctaataaagaaatgattgataataggtaaacattgtgtaaaatacagaaagcacatctcatgatcaagcaatcaaacattttcctaacgtaggtcgtgcatcttctctttaagggatttcc

SEQ ID NO: 467674 - DNA, 1312 bp, Homo sapiens
tccgtgggagccaggtcatgcacatggctgtgtcagcccagatttgcaaaggcaacacagaaggaagcagtgggggtgtcactcgcagcctccccacatgccaagctctgtgctgccttgctgcgaggaccaatattgtaaagacaagggctgcctgcacggtcactcttgggctctgcagaagccacacaaacacagacacaaagaggatgaaagaggcagcaccagggagagtgccctgaaggagacccgccgccagccgctggtatgtcagggaaaacagaccagtgcacgccaagcgggaggaaacagatttactgcccggcaggatgaacagaggcctggtcgccacggaagctctgaaaacacaccagtcactcccataacacatgcctggaggcctctgaatctccatgtgttaggccaccagtcacagacattctccacaaggatggtcctggtacctccagcaacatggtcctgtggatgggatccaaggcgagctcgcacccgctctggcagcaccatcatgggacaaagacaagcactctgcctggtttggctacagcgaaccttccaaaaaagattgctaacacttgcactggacttcctatggaggtacttgtgaagcatttcacttacagggtttagttgaatccctgttttacccattagaacacaggggcacagagaggatgttcttatctttacttcttcctagagatgttgttagtcgggtgcagaagtgtatgcatgagtttgcttgtttatactttttagtggtgtgcccagaagcccaagctacagtgggaatttaaggtttcttacatacagagtgcattcttacctagtataaaataaaaatctgggaccagagaggccatacttgcttttacctcttagaaaagcagttcctgtggcccgacggttagcaatgcacactgacacatgtgtgcgtcagtgtggaaacttttcatgaccatcttttagtgtcctgagctgagactgagaatttcccagagggctcatcagtgacaagggattgatttatacttacaactgtaaaggtaagaaggagagtagacattagaggctgagtcaagcaccagaacttttgggtgatggcatgagcgtgtgtttgtgggggtggatacaggcagtgatgggttggaagatgcaggctgtggctgtattttgcctagcatttggaagtttacaaatatgttttgaatcctaaagttagcttaatgcctcaaagccagactgaagttgaccattgtctctaaaatttgggggatctatagccccagcc

SEQ ID NO: 467675 - DNA, 638 bp, Homo sapiens
ttgtcagacagcccgtaggagggtccctagggcataagccatgcaggcactggcctggggtctctatttcaatccaaccacctatttcatatttgtttgtctgtcatctgacccagacaactctaaggcttcttgtacatcacatgccatccatgtcactggtgacttgcccactggcatctctgtcattccaaagctcttctgtgcacgctgtgtcatggtgaccctggatggacacctgtggggtggtggaaaggccaagggctccattgcagatagcaagcaccctccatatccacctgcacaggcgccaagtgccagcccctctgccaatgatgccagagatgatgtcattgccaggacccacggccgctctccaaggctttccgcacagactgctgcagaggccccactcccggggaccactcttgaggtccccatgtctttgcattaaggtctcaggggagcatcattctttaaaggtccagcccatgtctgagggatgagggaggctggcctatgcagccattgggttcttggcttgaccttgtacctcactggccttgcacacccttcctggagtgcctgggcccacgcacagcctatgggggggggtgggcacagtgggcaagccttga

SEQ ID NO: 467676 - DNA, 1148 bp, Homo sapiens
acgccaggactcccttctgccaagccccttgcatgcatggctgttccagactgagtcaagctctgaagaagggatgttggtccacccagggacccgatgccctgatttggtccctcccccaggagactggaggtctgagacactccctcaacgagcattcccaccagtgcctggagccagggagaacaggacagctgtgccctctggacagtgcctgggctgccgtctgggttttctacctcctctgtacttgcagaaggtaggcccagcaacagcatcacagagacatcaggaggcccaggctggagccctcagctgctggaggtgctggcttgtcctcgtggtcctgaggtgggaggttcgtctgagcaggcactcatcagacctgcaccgagagctccctctgtgcaggaagacacatgacaccaggttcataaatgaggatgctgcctgtgacaaccacgacaatgatagtgacagccacagcctctccagctctgtgcccctcctaggaatctcatccacctccaccacagtcctttggtgccaggcatttctctccctatttggagatgtgcaggctgaagcccagaaaaggatgcccggcgagcagctaagaagtggagtcagccacattcatctgactccaaagcccacactggtgccctcggtcaccccattgcccacctccatggggggagatgacccaggtctgcccacctgccaagtgccccaccacatccctgcagccaaggactccagccacaccaggaagggtgaagaaagccccttgccttgccgtgagcccagcaaaggcctggcagccatggcagtgcatggttttgaatcctcacacggacctggcacactgagagcgcagaagcactgcccgcatttgcagatgagaaagccagggctccagggggcctgcagattccacaccctccagtgagaagaggaccgggctcccctgctcgctgtccctgaagccatctcttctcgcgtctgcgttctgcttttgggaaacttgattccccaggaggatgtgcattctagtaaggccctcaggagcccaggaggccgggctgttctgcaacctgcagagatttggggagtttggtctgctgcccttccccatccagagcaac

SEQ ID NO: 467677 - DNA, 692 bp, Homo sapiens
acagccatgttctgaatgacgatgttttggcgaaccactgaccacatgtactgtggtaggtctcataagattaaaatggagctgaaaaattcctatcacctagcaacgtcatggtcatcagaacacagcacaacacattggtcatgtgtttgtggcaatgctggtgtaaacaaacccgctgcactgccagtcaggtttagatacacaaatacttaccattgtgttacaattgcctacagtgttcaatacagtaacacattgtacagggtgaacattcctgatgcttttcagtggacaagagagctgatggcctctgtgatagttgatggccccacaaatgggccatggctttacacagccagtgccgcctgcagagagtggaattttccaggcagtgatgataaacagaccctcactgcttgaagatcagaaaagaatgaccctgccttttgcactgagagagaggagatttcatttgggaggatgcagtccacatctttatatgtatgcatgttcttattgaagaagaatgtatttatcaagctcttactgtacaccaggcattctccatgaattaagaccttataggttgagaattggtaaattctaaaagataactacattggcaacctttttaagtaattaaatgggttggttcttatcagaaaagtgtaggttctgttaataatcac

SEQ ID NO: 467678 - DNA, 1268 bp, Homo sapiens
gggatggagaccacaggaaagcatgcagttggctttactatggtgcaaaaggaatgttctcattgccaggcgctggctggcagcccggcttctgcttcgccaggagtccgggcatcgcggagattcatcttcgtcctggcacccaccatgcggtgcccagccagccctgcacttggtcggccctgctcgagaatccaacctggttccattttcaattttggaagcgttgttgcggattaaaaaccggtcaaatgatgggaaagagtcagagagaacagctgctctgtccccgccatcctgccaaggcctaaatgagcctccaggaagcttcagagagatgagggatgcatttcccagcaggagtgatgcatggcccaggaatggcaagtcacgtcgggggcttgtggcaccctggggaggacctgtcagtgcagcgccaactggctgccagtgcccatgcacacacgatggaaacttgatcggtcaagtttctgatgaaactttaaggacagtaacaatagggacatatgacaaccttggctgttcctaatcacgtggttaatctatttagctcttcgtaaaacgatgcacaaggacgggatacacgaagcaaccagtcatttgctgtcacctgagtgttgctacactggtctgtaaatatttattcatgctagcatttggaagtcctgctgtactcatctttggacatgctttggcagaaagcacagatgaggttctgtctttgatggtctagctggggagtagaaagggaagtctacttaatgtgaccacttactgcttttttactccaacctgtgtatccacatcagaactaaactcttccattacagaggactgcctctgggtccttctgataactgtgccgcggcacttctgcctgtgggtctcaaaatgactcattttcccatgagttgtgtttataatcttgtacagtttggggaattaatctgaaaaagagactgggctggcaataaaaatgtagcaaatgaattgctaattattataaccatcgctctgagcttttgttggttacctgctgcctgtgctgtttctgttaaaaaaatagccatttattattatggttttgaattaaacatgttgataaacaaccatatttagaatcatgcagacatctgatgtcaatggacatttgtgtttcaccttgttgtagtccataaaactcattctgaattttaatttgttattgaggtgtaatacatacaatagaatgtgtaaaggctattact

SEQ ID NO: 467679 - DNA, 730 bp, Homo sapiens
ttactttcatcctggtgcctagcacctatgaggcacccagaggaggcatgtgcggggagagaaattgcatctgtgaggccggacaggagctcctcagtaaggccaccccctccggtccaggcctgggctgtgcgttcactgtggactgcagcccggggcggcagcagccagcagaaaagccaaagctgtttacagctgtgaggagccaaatcctgccaacaaccaccagcatgggcacagggaagagagaagcccctcccattcgcttctactggggcttgttaggccatcgccttgggggccggctgatcagcggcagccagcagccggcggcttcggcaggcaggaacaaggacagcctgtggctactgcagccccactgcccggccatgcttcatgatgggggagagtgccttgggaggaatatacaggcaaatcatgttagcatcacagagcccacttaattccgtatgggttggtatttggggaagaaatcgaggacgaattggtgttggacccaaagctgggcagggaccagtgtgcatggcaaggttttaatgccaaacccctgggcccccttcctggctgcagcccctcatgtcttctccatgtgttgacactgaaacctgtcttgtgctaattgctgactaggcatgaatgcatggcaattgttggcttgtttcctctcctggataactttttcctccttttcatgttagatagagccttt

SEQ ID NO: 467680 - DNA, 731 bp, Homo sapiens
ccgtgctggcgttgcttgggtggtgttgcaagccttcctacatgattatctactttgtgcagactcgaagtgtcctgccctgctcggaagcctgcagagactccacagctagaggtggtgttaaggttaagctgcacacggctgccccagtcaccctgtcttcattgtctatcctagatgaatccttgtttgagaagagccagcaagtcattaggaggcatccagaagaaggcactgctgtcctggaagatggcatctccatgcgtgttattgcccctgaagaccttccaatgggacaagatgtggaggtgggagacagggctatggggctcctgacccgatgtaagtgtgtttgtgcgtacgagtgtgtgcatgtgtgtgtaaaagtgtgcatgtttctgtatgagagaatgtgtgtgcatgcatgcatgagtgtacatgtgcatgtgtagccctaatgactccctgttttttacttcctatctttttctcaggtcccagggattcataaagttagggttaaataaataaagccatggccctggtgtgagcgtggggcagtccccagtctggcccaaagccatcttttgtgcctggcctgcagcagagcctcccggccctgcctggcctagacctaccaggttcaggcagctcggcgccttgccctgccctgccccatttcctctgcccacaagcccatctgccctcctctctctgccccttgctgtcct

SEQ ID NO: 467681 - DNA, 726 bp, Homo sapiens
gagtggatattattattatttaggcttttgataaacaatgataaacttcgtgggggtacggcctttccatctattgcctgtaactgatcaatatgcccttattccacccccaaaactttggggactcccagagaccccgctgcccttctgagctgctgctttccaacttaggaattgcccgtggggtcctcacggagtcccccgtgcagctggactctcgagctttgtttcctgaacagggaagaaggaagcaggtggggcacagagcggctctgacctgccagacaccaccggaccgctcaggcaaaggggctgcgtcctgctgccatggaggcaagggggatgggtcagagtgcccggtgtccactgctcagcaggacctcagttcagcttctgttaaagaaggtggaggaccaactcatgtttcaaatcgtgggtcccacaatgaaagtgaacagggaggttacactgtcctccagaatgcaggacatactaagggttacatagtgattctagtccatggaatctcccacatgatgggttaggagtccaagggagaaggacggtatctggggtggtcaggggtggttaatggatgaagttgggtcttaagtgtatattgtaagaaggatttgtagggatttttgaggtgtgagttcggggcagagaagggaaaagcattttggaacaggcaacagcatttgcaaatgcctaaggtcagcgaat

SEQ ID NO: 467682 - DNA, 556 bp, Homo sapiens
gcaaagcccttcagccctccagaaggttccacgggtcccttctgagatgccaggcagacccacgggagggggcagggagctgtgggtattggtggccggtgtctctggcacctgcaggccatgctgcccgccgcccgcctgggagccggcagtgctgagagtctaatggagggcatggcggaaggtcctatgcagcaggggccccaaggagtggggactgcaagggcacaacaatgggtgactcacctggggaccctttgggagacaagcttgggaatgtaccgatggggtgttctgcacagctttgtgagcaccaaacttaggtacaaagatcccatagagaatcctttaaaatctcactatgccccagggacaaagtgctcagcacagtgcaccaccacacacatttgcgttgctcagaatccaagggacacaaaagagagactcattggccaggttggacacacagcattaggcttccagcccctgtcttggagtccccccgccagaaggcccagactatctcctgtttgagaccaacaccctccccgcccct

SEQ ID NO: 467683 - DNA, 984 bp, Homo sapiens
ttcttccctgtcaccgcccgcaacccccactcatgcctttcctatccatgcatgcttctcattcaccgatttttgctgattgccccctcttagggtttgcacagctggccctgctggctctgagcagcggcaggccacagcaggtctgttccttcattacggcagctgcacaggaggtcgctgtctggggacagtctcgggttcctccccaccagggctttgtagagattcacgcctcaagcccaagtgtatccgggagcaggggcgaggcagctgcagctgcctcaaatgaaaatgaaagaggcatttgttctcatcagtattgcttagaagagaagaggactggtcctggaggtgttttcagagagtttttccaaacaggaaaagttttgggtaataggctgtcttcccagccaactcctaagagacctggttgtgggtctgtagtatatcaaaactgttttgaccacaaatatttattgtacatccacgagtgggaacagcactgcgtgcacaatgctcactgtgcatctgcccgtgttccgaatcacatccaatatgacttcctggcagcgggttggcgtctgcgtattgttactgcagtggttgtctacctgagccttgtctactgtgagctggaacacctacctccccctctggagagcaggaattggaggaaagtcatgtacttaggaaacatttccaagtgtgaaatgagtttggatccgtatcacaacattgccgaaatggtggctctacagcagtgggtctccaccagggcagattttgcccctatttgcatctggtgggtaaggccccgggagctgccacatcttacaatgtataggacagtccccacagcaaacatcacctggcccaagatgtcagcagtgctgaggtgtgcttatgttttttatttgaagtacatttaggttcacttgtttctgtttgaattccattttgagtgccccccttctcttgttc

SEQ ID NO: 467684 - DNA, 1572 bp, Homo sapiens
tgaggaaccacaactaggagctgcatccccagagggcggcgctccgcatgcaaacagtgatctgtttcacggcgtcctgtgtgttctagaacaagagtgttgacagcagcggagggtcggctaagtctggaagtgagagtgtcagaagagccagagggtcaaggacgagatgcgagcacaggagacatctggaccccagattgagagcaagggctggcaggtggagtggcagcatggagcaggatctggcacagcatcccgggtctcactggagcatgtggcaaggagctcatccgccccacctggaacagcaatgaagccacaggaagaggaggagaaggaggtgctcatgacagagccaaaggaggagcaggtgcttatgacagagccacaggagaaggagaaggaggtgctcatgacggagccacaggagaaggaggaggaggtgctcatgatggagccacaggaggaggaggaggaggtgctcatgacggagccacaggaggaggaggagcaggtgctcatgacggagccacaggagaaggaggaggaggtgctcatgacggagccacaggagaaggaggaggaggtgctcatgatggagccacaggagaaggaggaggaggtgctcatgacggagccacaggggaaggaggaggaggtgcccatgatggagccacaggagaaggaggaggaggtgctcatgatggagccacaggagaaggaggaggaggtgctcatgacggagccacaggagaaggagaagaaggtgctcatgatggagccacaggaggagcaggtgctcaggacggagatctggtcccaccccacctggaacagcgacgaagccacaggacggggaggtgctcatgacggagacctggtcccgccccacctggaacagcgacgaagccacaagaggaggaggtgctcatgacagagccacaggaggaggtgctcatgacagagccctgctccaggccaggttcccggcgtggggctgtccactgcagcccatcagctcctcacaccagctatggcaggaagaaggcacaggctgtcatgccgtgctcggccagcatcaatgcagggagttgggcactcacagctggtgaggggctgctcactttttggtgtctccctgtctgtctgcctccctggtgtctctctgggtgtggtgggctcatcatgtttgcctcccaggcccttccagcagagctgggcctggggtctgtagaccccacacagtaccgggggagttgtggagcagcccagcagccctagtcttttttctcaacatccctgagaaagagatgaagcatgctgaagtctttctagaaggaagaaggcttctaaaaagccaggtgccccagatgccactctcaatgggtcctcctgcctggaggagcatctcctccttgaagtactgttcagcccagaaccagctttctcccgggatgttggcttcagaacttggaagatattgtggaaagttcttgagggggagaactgtgctggctgttctctgtgccctgccacctggacctgtttgagtttttgctttgcttggtg

SEQ ID NO: 467685 - DNA, 984 bp, Homo sapiens
cagacagaccaccctcagagccatctcctctagtcagcaccatggacagcagtcccggccccaggccgcaggacctggggaggggccacatcactaaaggagaatcagctgccactggctccctggtgttggcacggctcagggccagtgggagagctcctcagagacagggtgtccacctcacacccttcaacccccagcacccagccctccgtgggggctctctgcagtttgtgatccaggttctgttctcaggacaagcacaatcaccaacaggcatcagctgcgctggctcctggaagtcagccctgcgccacgcccctgagcagggcggctctcacgagcgggaccacctgctcctcctcctgaccatggctggagcctgggtccctgaagtcaccagacctgcagttctgttgatttttgacacaggatcaaagaagcccatgctccttcaagttagtccagattgcatgtgtaagagtgtaattgtgccagtgtgtatgagtgtgagcctgcatgaggtgtctgtgtgtcattatgccttcctcttcgtctggcagccagagctgagacctgcaccagtgctggagcagctggtagaatcaagacccatgggtccatggaggaaaaggggaagagcctctgtcctttggtaagaaaaagctacctaatacttatattcacattcaaaacagagaaaatgaaaactactttggcgagaacaggttgtttcttagtggggaattccattctgactaatccaagtctttctaacttgtaattcaagctatggcaacattaggtaatcacgaatattgaattttccccttcttttcagaataagtcagatgcttggtaactgtacccactgtagggaagtgaaaatccccctgctgttttttaagatcatggaatgcagatctttcaccagcttgctaagacaatgtatgattgatcttcgtgttctcagaatgcagggac

SEQ ID NO: 467686 - DNA, 1247 bp, Homo sapiens
gatgcatgtcactgtggcagccattgtgcacacccagctttgtggcccctcaccgaccatggcagccattgtgcacacccagctttgtggctgatcaccgaccgtggcagccattgtgcacatccagctttgtggctgctcagcgaccgtggcagccatcatggtgcacacccagctttgtggctgctcaccgaagtgccaggaacagcctgagaccaagtcccgactagcatgagacagcctgacagagctctaagggaggaagtggagctggaggaatggtgtcgcagccagagacccggggacgcaaccttcggacaattgtcagggtggaccctccagccacagaggaaggaggaagcctacagccctggggacagctcagtttgggggtcctgatgagagaggaagaaagcatcaccatcacccagaaatatctcacagtcaccagcccccacctgcaccccactccctccctggcctcactgtcgggagtatttttaaaatgcatctgccttgtcctgagtcctttgcgaccgtatagaggagatccttctggtgactttctggatccaaaggagactaagagcacctgttgtttctcttgcaagtctacgaaaagcaacccaggagagaacgaagagagtccaggctctggagtggccttgggagagcccacgtacaggcacttggtttgatttagtgtttaacctttttgctcccgtgctaagtcctctaaacttgactcataacagaatatgggctctcccatgaggacccaggcctcactaccaactggctggttgaagttaacctagggttgaaatcgattggttctcccagtccatagcttcattgactggttaaagttaacctaggggttgaaatctactggttctcccagtccgtagcttctttccccttacccatattatatttctgaacccatgaatatttgaaaggactcccagggaggacattaaaacaccaagcttactggggcacagggacctggttctggattcctgttctcccgaatggacgccatccgatggcaaagttgacatccaagggagcaaagtcgactgttccgaagccctccatgtttacagatcttaacattggtgaagcagcaaggatgttcttgttaggaaacatcctgagagccctctgctaaaatactttctcaagaaacagagacatctgtgaggcatagctcttcctgggtgatgcgcatgtgcaggggc

SEQ ID NO: 467687 - DNA, 634 bp, Homo sapiens
gggctatgtgaatgacatatctggacaaaacttactctggtaattcatgggcttcagtttcaagaaatcagcagggagagagcagagttattgtttgcattagtccattctcacattgctatgaagaactacctgagactgggaaatttaaaaagaaaagaggtttaattggctcatggttctgcaggctgtacaggaagcatggctggggaggtctcaggaaacttccactcatggtggaaggtcaaaaggaaggaggcacatcctacatggctggagcaggaggaagagcacagggggaggtgctacatacttttaaacaaccaggtctcttgagaatcacaagaacagcaagggggaagtccatccccatgatccagtcacctcccatcaggcccttcctccaacactggggattacaattcgatgcactgggccatggtgttaggctagtgaagcacaagaacagaccagaatttgaaaaccagtgagcattttccctcacagatgcatctttctgaaattgtagtcatgcttggcagctatgattatacagatctttttaaaaaaacacttatttaaaataacataaactttatagaaataatgctaagagagtatagagatttcccct

SEQ ID NO: 467688 - DNA, 667 bp, Homo sapiens
aaaaataatgttttgtcaggtgacaaggtctcaaggtgtttgcagctaccttccaccagcctttgaggaaaaatggcttaagtctccttgtctgaggcatgtactgagagaagggcaggcctgttttcagtccttggggttttattttgcaggccttggcttggaaggttgcagctgtgggctgggacccagctctgtcacctcagtcacttgcattgcatttgatatggggcctcctggaggcccgatgacctcacctgtcaaagtaatgacagcccttctctcacagcgttgttgtgaggatgaactgatcgctagcagtggacctggaacatggcacatgcttaaagagcagttcttgttattaatgataatcttgggctctgccgagatggaaaatcaggctaagagaacacagatgtggcagagttcctcaaagcagcttttctggcagaaacctaaatagaaaatttaaagcactttttaagagaaagttatgtatgtaatatatattatatataacatgtatattaaatgttatgtataaataaaattatatataatataaatatatgcaagtttatatctgtcacttaatttttttaaatttaaaaatactttttaaaatttaagttaacattgttttatttgtatgtattcatggggt

SEQ ID NO: 467689 - DNA, 661 bp, Homo sapiens
tcctctttctctctccttaatcctacccagaaaggggtggtggcagtaaatcggtcccccacgagcatggaagaggtgctgaagcagctgcaagtgcaaagccctgagaaggaggatgcagcagaagtaagggccctccaggtgcaggctgggtgcctggaggcctggctacacagctcagcaaaagatttagaagctgccgtaagtggggaccttcaggtgcaggcagggtgcctggaggccaggctacagagctcggaaaaggaattagaggctgctgtgaatgcaggcctggggctgtcgtctcagctggagacccccactctgataccgaggaggctgttagtgagaccgaggggtctgctccataaagaaggggaagatgccctgcctgcaggggtccccccactggagaacagggggccccaacaagtgacatgctcagagatgtggattgatttggttttggccaggattgactgagagaaaattgataaacagccaaatgaagtactcttaactttgtgcaattccagaaaatgccccaatgggagaaggacattgctgcacaacctggtcccacctgggcgcttcagctcaaagactccgtatgtgctacagccaggtgggggtgtaaagccttttctgtatgatgagggaa

SEQ ID NO: 467690 - DNA, 710 bp, Homo sapiens
gcctacctgtgagggcagcgccgaccaggcttttcttgcccgctagtccacgtaatgcggtcgctaagaagcccgcagcagggttttcgcgtgaccttcatagggcctggccaggccagctgaggggcgcgccgggctgcgcttccatcgaggaacctccgcacatgcaatcacggttcagttttgcctcaagggcatggcgcctcagctagtttttggctgtaaacaaaccgcggccaccgccaggctaccgggttaccagtacctgttcttcggagtcatggccagacatctggagttcatcgccaggactgtgatggcacaggaagggaatgtggaaagcgcacacaggaccctaaacagaatcctaactatggatgggctcattgaggacattaggcatctaccctacgtcgtttcccactctactctctgtcctggaaggctgaactgtgtagacaacaccaaccgctcacccactggctttcagttgggtctggacaatggggaaccacagtggattagaaagaaggaggaagcggagatggttttaagaatcccaggggatcttgccggctccaaacctgctgcttctggaaacacctgtcagggaagtctggtcctcagctacactttgaaagtggctgcattcacttcatccatgaagtgaacatggaggaaatgcctagtgaattgctggactgaaaagc

SEQ ID NO: 467691 - DNA, 826 bp, Homo sapiens
ccagcagagccagcatgtaagcaatggccatctttcctgtacttaataggtggaagccgcggctctgtggcattcctggcatgtctgcccacgctcggctggctgcctctcctgtcggaagctctgctgcacaggctgagacaacaacaggacgaccagcccgtgtccccacagcagctctcaccaaccaggcgaggtgctctgtgagagtccccgagggcttgggcagaaattcatgctgccccagcaggctcaaagctagctcagaagtcgcaccaattccagggggttttccaacagttttctctcccgctctttatcttactcctgttttcccactttgggccacatattctccacctcaatacccaactcacctacaaattgaaaatgtccttgcttacatagctcctttcacaatcgctccaggctcccaagtggaatatccaatcccaccacctcggcacatggctgccagagttgcccgagccaaggaagagcacctggagagtctcacggggctttttgctgcccgagacccagatgacctacgtgggttacatgttcctgcctggcagcaagagtggctgggcttacaatctagtgatgatcagacgcttacacaaatgcaagcagagatgagctccaacatggagtctgggcaaagcacagtgaggcacagagaggagtgtcaaagtcagcctgagagtgactggaaagactccgcaggggctgacgctgacttgaatggagactcgaagtgtgaataacagtttcccagacagacaactatggaggtgggagtattggtgacaggttcaagtga

SEQ ID NO: 467692 - DNA, 846 bp, Homo sapiens
ctgttagaaggaaaactaacaaacagaaacaaatagcatcaacatcaacagaaaggacatctacacgaaaaccccatctgtaggtgacggacatcaaagaccaaaggtagataaaaccacaaaaatggggagaaaccagaggagaaaagctgaaaatcctaaaaaccagagcgcctcttctccaaaggatcacagctccttgcctgcaatggaacaaagctggatgcagaatgactttgacgagttgacagaagtaggcttcagaaggttggtaataacaaatttctctgagctaaaggagaatgttctaaaccatcacaaggaagctaaaaaccttgaaaaaagattagatgaatggctaactagaataaacagtgtagagaagacctcaaatgaactgatggagctgaaaaccatggcacgagaacttcatgatgcatgcacaagcttcaatagccaattcgttcaagtggaagaaaagggatcagtgattaaagatcaaatgaatgaaataaagcaagaagacaagtttagagaaaaaagagtaaaaagaaatgaacaaagcctccaagaaatatggcactatgtgaaaaaaccaaatctacatctcattggtgtacctgaaagtgatggtgagaatggaaccaagttggaagatactcttcaggatattatccaggagtacttccccaacctagcaagcaggccaacatccaaattcaagaaatacagagaacaccacaaagatactccttgagaagagcaaccccaagacacatagttgtcagatacaccaaggttgaaaagaaggaaaaaatgttaagggcagccagagagaaatgtcag

SEQ ID NO: 467693 - DNA, 935 bp, Homo sapiens
cctacggtgtaacctaagttgtctgagggcattagtggggtttctacttgagagttcagtgtccccacgggaagtatcaagacctctggcagccgccaatgttctttctttcactatggattggcatattctgtatattgcatataaatggaatcacaaaatatgtgactgtttgtgtctggcttctttcatttagcataacattttcaaggttcatctacattaaacaggaagatgaggtatcagatgtgcaggttttaacatcaaatttaatccttttaagcagcagcaggccagactgtgagagcacctcccgcacccgtgaactcttcctccttcactttggctccaacaacagaagactccatctttgcagagggacagttgccccatctgaaggctgcacaacttttgatgatcaacatccttcatcattttcagggaatgacagcaacacaaagaaaacaaaagacttgttgaatggctttgaccaaaatgctgatagtgatatggacaatgaaatccaggctaaagtggtctcacatagagttgaggaacttgttgggaactggagcaaaggtgactcttgctatgttttagcaaagaggctggcggcattttgcacctgccctagagatgagcaaaactttgaacttgagagagattatttagggtatctggcagaagaaatttctaagcagaaaagcattcaagaggtgacttaggtgctgttaaaggcattcaattttaaaagggaaacagagcataaaagtttggaaaatttgcagcctgaaaatgggacagaaaagaaaaacccattttctgagaaatgcaagccagctgcagaaatttgcataagtaataaggagccaagtattaatcctcaagacaatggggaaaatgtctctcaggcatgtcagaggtcttcacagcag

SEQ ID NO: 467694 - DNA, 665 bp, Homo sapiens
aatcaatggatggaagtggaagtggcacaactcaccatcacccctagtgatccactagcaaaatgtttgcttcctgttcccgtgacattctgttctgctggcctagaggtcttagttccagagggaagaaggctgccactaggacacacaacaatgattccattaaactggaagttaagattgcctcctggacactttggtcttctcctatctttaagtcaacaggctaagaagggacttacagtgttggctggggtgattggcctggactatcaagatgaaatcagtctactaccccataagagaagtaaggaagactatgcatggaatacaggagatgcattagggtgtctcttagtattaccaagccctgtgattaaggtcaatgggaaactacagcagcccaattcaggctggactacaaatggtccagacccctcaggaatgaagatgctgggctaggatagtaatacttgagggtatccttattttttttttttaatttaaaaagctactttttccacgaagttgttctctcagttactgcttctattttttttccttcaaaattctcatactttttttcattttatgccctcactgagatctatgaatcatagctgttaggaaaggccaaatatgtattatattgaaaaaaagcatat

SEQ ID NO: 467695 - DNA, 830 bp, Homo sapiens
ttccacttgtggccgactgccactactactacttgagtaacagcagttactgttactgcctgagaccatcactacagcagttactactgaaaggctaagcatgaggaagaagaagagagaagaaaagggctccctgtttctatggtccatgctgagggttagatctccaggggattccacagctctccagggacccatcattagcctgtgcttgccaaaatcagaccaggttgtgaggtacatttatgaagaatctggtggtgcagtgattcaagagcagagaatccccaggcagagcagtggcccaccacaggggaacaacaagtatggttcccaatgcctcagttcagaacttcaagttcccctggggttggtctttgccagagtcttgctgcttttctcttgtgaacaccagcttctccccatggacacgatgagaggtcctagttttcttcactcagttttccattcagaacttaagtccaacccaaatgtaaaaacacattgccaagaacaaatcctagaagcaataatgcaggcaagtatattaagaaaaatttacattacttaaaaagatatgcttttttaagtctctctgggaacattattttcattccaacagtaaatatggtaatgacaaattttcagaattagttcactaaagcattctcattatggaattatttttggtagcattttattacacagattgtggttattgtgccttttaaatgtatttcataattcttatttttccaaaatttaaatgtttattattttatttaataaactagtatgtcatttgttttcaaaacctgagttaatgaaga

SEQ ID NO: 467696 - DNA, 840 bp, Homo sapiens
attagttcagaaattgactgacaggagtggccacccaggaaggacagcatggggtctcggaacccccagctgctgtgggaatcaagcagacctgagaagtttaggttttcaatcaggcgatcagttagtgttactggacagctaaagggatcattttcaaagcacaccaatcttctttacagtttaaatggctattatcaaaaagccaaaactgacgatgccggcaagcctgtctcggagaactggtacactgctggtgggaatgtaaactcgtacagccactatggaaaacagggtattaacttgctgggtacatcaggtaacagacctgttaacggtttcaatcccactgttgggtatctacccaaaagaaaggaaatcatcatactggagatatatctgcactctcatgtttattgcagcactgttcacaatagccaagatatggaatcaacaattccactgtaaggcttatacactgatttggtaagtattctcttctctactttctgtgtaaatggatattaattcttccttgtgtttcatgtaatgcatcaatgaagtcttctgggacaggacttatatgtagattttaaagtacaaattcaattgttttgaatatagggctaatgaggctttctgtttcttgaattagttttgttactccttccctgccttcctttgattaatcaaatattttccagtgttccttttaatttcctctggcagctctagctatatgtgtctgcattattttttactcgttactctaggggttatgataggcatctttaatttaggacaatctacttaatattaacaatttttgcaagaggatag

SEQ ID NO: 467697 - DNA, 2871 bp, Homo sapiens
gctgtgtgatcttgcaccagctgagatgaacagagagagtggtgttggggacagcagcccagggcagcccaacattcaggagaaggtgtctggagggcttcctggaggtggatggcctgtgctgaagcccaaaggctgagtgagagtcttgtgctgtgcccctgggctgaggcagggctggtactggcgaggctgctgtggggtgagcctggtactgcccggggttggggagtccctctcactcagcctgtgccttccctgggagtgactcatttctgctttccctgggctcctcagcttcccttcctctagcctggtcctaacatggtctctgggccaaagtctagggccaggctagggcgaggagtcagtggggatggaggtcaatggggatggaaagtgggggtctcatccccttcctgcctcttgttgtgtgctctgtgcaccgcgctgtggatctggaggccctctgggctctgctttccaccccccgccacaggtccccttctctgctttgtccctgggccttgtgcctgtggcccatggtggccacactctctgggggctcagagctgctgggagcagagcagcgcagacttccaggatcttcacaagctgtcctggtcctgggaagctcttgggacctggagctttgctgctcctccctttgagcctttcagggactgggacctggactgtcagaatctcactgctgccctgggccgcttcctctccaggacagctctctgtcctgggtttcaggggtgcattgtggcctgaggaggtgttctctcttgctggtctattaaacaaagcctaggttcattaacagtgggaaaagaccctcacctcatgatccaagctgactcattcttggctttccacaactgcctcttgccttattgttcatactacttcctatttctcccaaacatatcatggtctttcatgctttatctttgaatgtccttcccacccaatgacaaagaggaaccaccacaactccagcttgtctggtctttggtgtccacagtctcagcacaagtaagagtccctgtttggaaagctcaggcaaaggctttaaggatatagtattggcccagctggggtggctgcccatccctgaaccaactgggtgtggctagaggtttattaatactattgatctttgaagaaaagccagcttttggtttccttgattttcctattgtttttctgttttctattttatcatttttttgctttgatatttattatttcctttattctatttactttgggtttaatttggtcttcttaagacaaattcttaaagtagaaacccaggtcactggattgaccctttaaaatttatgtacaatgaaactttatctcttcttacagttttgacttacagtcaatttaaaaaatagtattatagccaccccacttcttttttgattatgatttgtctggaatatctttttccatcctttcacttttgagctacttatatctttggatgtaaaatgagtcatttaccttgaatcatgttttgtaaaatttattactccagcccctgtctttggttggagagtttaacccatttacatttaaagtagttattgataagaatatacttacttttgcaactttactatttatagtttaacacatttacatttaaagttattattgataagaatatacttactttggccattttactgtttatagtttaacccatttacatttaaaataattattgataagaatatacttacttctgccattttactatttatagtttaacccatttacatttaaagtaattattgataagaatatacttacttgtaccattttactatttgttttcagtatgtctgttaattacttttttgtccctcattttctctattaatggcttcttttgtgtttagttgattttttttggtagtgaaacactttgattcccttttaatttccttttgtgtatattccttggatattttctttgtggttaccctcaggattacacttaacatcctaaatttataacaatctaattagaactgataccaacttcaacagcatacacaactatgctcctatatagctttatttccttgtttatgttattatgacaaatcacatctttgtcaattatgtaccaattaaaatagatttataattaaaaatgcatgtgttttttaaattatgtaaaaaataaaagtagagttataaactaaaaattcaagaatggcttttatgtttgcccgtgtagttacctttgcatttattccttcatgcagctttgagttaatgtgtagtgtcctttcatttcaatctgaagggctccctttggcatttcttacagagaagatctagtggtaagaaatgcactcagcttttgtttatctaagcatatcttaatttctctttttaaaagttgtggtaaaatttatataacctaaactctacattttaaactatttttaagtgtattgttcagtggccttaagtacattcatattgctgtgcagccttcaccaccctccatcttgagaacattttaatcttcccaaactgaaactctgtacctgttaaacaataactctccattttcctctccccccggctcttggaaaccaccatcctactttctgtctctatgattttgatgactttaggtatcttagataagcagaatcatacaatatttgtccttggtgactggcttttttcatttaacacaatggctctctcttttgaaaaaggacagtattgctggatttagaactcttgagttttttagttttttttttccagcacttgaaatatgtcgtcccactgctttctgccttgatttctgatgacaaattggatgtc

SEQ ID NO: 467698 - DNA, 1031 bp, Homo sapiens
ctgcctactggcaggtcctcttcctcttcttttgggtttgcacctgttcctgatggcacccacacctgcatcgggttccttgatatgaaccaccaccactgtcagatagcagcagcagcaccgagaattacagttgatatgcattctgctggagttgacatcttcacacccatcctgggaagtttctccagctctattgatttggctggtggttccaccatcagtgcgcctgcagggacctggggacaagggagtcttggccatgccgtccacagcagtcagccttccagagtcccagtagtggatctggagggcccaattgtctccaaagctgcaccgaacctggctgaggtggtcacaacagaggcagagccccttctgcagctgacggctttccctctctcggtggctgagactgttcagctttccctaaaacgctccagccggccacttcagtgggtgtcacatcctgtcccccagcctctgccatagacatcccgttctcctgcaaaggcctggctgaagtactctctttggttatcctgagaaattatcctgaagggttcctgcaagtgaagaattttagatgagggtatttatcagagccaagcattaataataaatgatgcctgatttttttattagaggagccacataaatgtggctgcttcaactttttaactcttgggaaagcttgaagttgcaggctactctgctgtgggagagtgccagctaatcaggtcccattcatatgcaaagcacttgctaagctgagttcatcaaaatgcagtcgtttcttaaaaaaaaatatttatagactttccctccctgcaaaagactgcaaggaagatggatagtgaaaaatacaaattgttaatgccctgaaaaggaagtctcatcctgagccttgctaaagcattccctattctttgagaaaaacttaaaaatgggcatttgtactctagatttctctacttccctttactaaactctctccctcctcttattccagtcacttcgcagtatctctt

SEQ ID NO: 467699 - DNA, 3231 bp, Homo sapiens
ggcacctgtgccttggggaccctgaagtggcctcaacacgctcactccccactagccatgcagtggatcatacctggcaagagggctcacatcgccaagcttcaggtgccccctctgcaaatggctggctctgtcccctgtttctgtgatggccctgatgctgttcctgctgcctcccaccccctgccctccctacccctgttccttccgggtgaggaggaggaggaggaggaggaggagaaggaggaggagggggagggggcttccacctccagccctctggctgcatcctccctgtggccactttcccagaagcaagctctgagcaggtcctgccttcaaggctccctgctgctcctgggatcaaaacaaagcccctcagctgatcatccaaagacttctggggactccaccctccctttcctcctaacagccgtcacccaacctctcaccccagtttacaggagaacttgtaaagatgagcccctgagcgtgtcagccctagaagcggctgctggagcgtccgctgtgttcctcctccacacccgtgcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtcatgttctacgacagcgagtatgaatctccaatgtgatcaaaagctgtgttcctcttttctgacatggacacctttgctacctttggtggggttgaagttagtttccaaccagactgctccttatcagtaattccataaagtcgccaagtgaccagtagctttcatctggaggaccactgcagctgttcccacttataagtgagaacatgctatatttggttttctgttcctgtgttagttggctcaggatagtggcttgcagctccattccttgatagttttatcatacaagttacacaccttgccctatggaggagctgagctgccaaggcttccccaaggtctccttgcacagtcacaggtggctccgaagagccatcatgccttctaagctggacagcttaactggttttcatagaaaatatctgtcgggatctcacccccagagtcttcctgaagtaaaattccgtggaagaaagggaattatcggggcaaatgttactttaatcaatgccccttgctgacgtctcctttgcggcccctggcaaagcaggccagatgactgaactgccatgctgatctcattaataatacacattggatcattatggcattagtttaaattgaagtaatacatactttttccagacaaaatgagtaagtgagtttaattgctaggaaacctatggaagaagtttgacaataactttacctggatgagtgttttgggttttgttcttcgatctaattacaaagtaactgtactttggggtgtgttaattgcagtgtgccctagaagattaaagtttattaactctgaagttccctcacccctccatcagattccagagtgcgtctggagacatgaggagatgcctgatgcaggcctgcataaaggactggaaagtgaggctatgctgactcccacacatgccccggtgtgctgctgggtcctgctggagttgagggagcaagaacttgtccagatcgtcccccgtttcctcttctcaccacacaccattgtgcccttgcaggaccgatgcgggctcctgttgatatccccctcctgccagacccacactccccagacctcctttgctccacacatgagagggaacaagggagatgttgtgttgttaaatactagaattccaggaagggtaccagcgagatgtggctgcagacttctggaaggaccactagtccagatgggacctcccctcctcctgctccctgtctgctgccttccagctccggctccttgctgctccatgagcgtgcccggcacaacctgctgcagaggctttgggctggctgtttcctctgcctgggacactcttcctgcacgtgcagacgtctgcaagctgcaccttcggggctttgcttcaattccatctgtcccgtggggccttccctttccaatttatttaaaaatggaactctattttctcttggcacctctttctccctttttccattgaatttattcccatttactcatcttttgatgtctgtctttccccaactagttccatgcagacaggcagttttgtttgcttggttgagtgatactggacccacagcatttagaacagcacctaaagcttagtaggtgctcattaaatatttgatgagtgaatgagtgaattgatattttgggggtgtttcattgcccatttattggcccagaagcatttgtttctttccttgagtttaccaattacagcagtaatatatgcttcctatggagtccaagtatgtgcaaaggcaaagcccctccctcctccactttcagtagagcactggcttgttcagcctgctgtgtttctgtctataccttcctccttgtcaagtgtgtagactgcctgtgtatgccaggggtcaggactggaatgtagtttagatgtggccagcccctgagaaagttcttcccatagcttcaagtcaagaatgactacaaaacacatatgaatcacagtgagatggcaatggtgctgctgaggtctggtggggagtgggtcttggcaaaggaacctgtttctaggcttagacagcgggctggcagggggatggggtagcttggcagaatggaaggtatggacaggacaggcctagcaagggctgctctcctggtgggctgcagctcccattttccctctggcctggtttgttggggaatgagctggtccctgaagggagcagagcctgagcccttgttggcatggggatggcatcagcatagctgaacgggcattctagccatgcagggactcagccttgtgctaggggaaaagtggggtttagatctatgcagcttttctgcttattttctaggcacctttgaattaacttatctttccatctgtgcaatgaagaactagtgcccaacttgctgcagtccatgtaggagccatacac

SEQ ID NO: 467700 - DNA, 742 bp, Homo sapiens
ttcctttgaaggaggcacaggatcgagtgtttcaaacgtgtgtctttgacaagtcattgaaatacatggaagtatgatcatcaaaaggcatgactacccagataagcgaagcagcagccattgcacgcagagcaatgttgctggtctcctggctcgctttgttggcatgaggcagcggctgcagtcacaggtcccttcgctcccgcccatcttcgtcaggtgctctcaatcctgggccagttttccttgccaacagcccatcctgcttgtcattttcagtggcttcaggccctccagcagaggcaacattgagccccatatgggctccaatccatgctcccagattagtgctttatctgctcctccaactatcccctcctttgctgacctttattatcctatctcccacagttgcacaaatgtaatccctatgatgaatcctttattccatattactcctaagagttctgcttcctggattgaactattgactgataaccagagcaagcaaattgctgagcagcttcccaagcccagttaaacagcaatgtgaaaagaatctccattcctgcatcccttagggataggatattgcttttgggtgacttgttagtgtagagggagggaagaggggacattctaaggactctgaatgtggcccttcccatcataatagctcttactacaatagtcagtatgaagatttcttccatttctaaatttacttttccattatgctctt

SEQ ID NO: 467701 - DNA, 963 bp, Homo sapiens
tctgctcctctactcactgtttcgattaatgctgtaccttggtatcccagacaagggaacaagatatagagataacaaagggaatgaggaaaaggaggtttcagcattccagaccgaatatgaaaagaggctcggcaggcgacagggcatagccaagaatgaaaaaggtgggggaaatctcacaagatattctccacttcttcagcttgactgtaacctcatggaagattctgggccagaactgccctcctggttatgcagcccccagagtccccagtctcaaaagctgggagataaagaatgtcgttttaagctgctgcagtttggaggaacttacagttggagccagaagagtacacagacaacttcaggacagcttaaggagtacaaccgagtatgggatacaatgagcctagacagctttgtcaagcctggtatcaacacgcacatctggagttcccacctccttcacagcaaatttccagatctctttgaatgcccaagggacacacttcttgaagcctactccatggatgcatttctgaatgttgatggtgtattcttgggccaccaccttgctgatggcagaacagcctttcttctttccacccttctttgcagcagccattgtgccaggcccaagttggaaaggagccagatgtctttacttaatagtttttctcctttagcagacatagtcttataatcctatctatttccagaaagggtttctgccatgtggaaaaaaacatatgcaacaaagtgaaataaaaataagtaagggaaccaagaaaaagggaaataagagtagaaaagacagaatcagaagagaggttatcacacaaaatatatacaaagaagactatactttcaggaaaaatccatgcatttgccttaaaacttcttaagagtcaagagggaaaaaaacaccattagttgtaattctcagtgcctaggtgattt

SEQ ID NO: 467702 - DNA, 617 bp, Homo sapiens
tcttaagtcccttggagaaggaaaaacctacactactataatgctcctctctttataatggtcattacgtgacctgtctggcaggttcctggaaaatctcactcataagacttgtctttattcgacccgactcagggagcactcaccatgaacagcattttacccaaaggcttcagacacccgggacctggaggaggagacaatcctctttgctccccaaatgctgtctccaggctttatgactcctactgtccttcaaagttcacatcaacaaactttccatctgctgcccctctgttgctggcatctatctgtcttgatcctccccctcaatcactgatgactttcacactgggcccactctcttccacagttaactttggacttgttaccaatgtgaccaatgattttcatcaatacagccgaagtctaaatatgaatatcactgtggtctttgcaggaacctggacaagcaagaagatcatctcagggtggacaagtgtcattggagctgggcagcatgaatttttgagtaataccttatgtccatgagaagtattattaatagaatccaattctgtttcagcatggccttagaaagaggatgggctatcttt

SEQ ID NO: 467703 - DNA, 1062 bp, Homo sapiens
tgctgtaggttgcacccttagaattttggggggatgccagcttctctgggtgctgctgaagaagtcttccccaacaactgtgcgtgcagaggtggacttaccttgaagctaacgacactcacatcaggtcccctcagtgcagagccccttcccaggggtattgtggcttccttaacagaatcccacagcctggaagccttaaacgatagaaatccattttctcacagttctggaggcgggaagtccaacatcaaagttctggcccgtatagtttctggtctggtaggggtgggcaatagtacctgcctgcacacgggctgcaagggggcctggaaaagcaagtctctggcacagtcatcccgagttcagacccatcaggtgggaaggtcgtcaaatgcaggaaggagctttcgatactgtgcagtccaaaagaacaataaatgtccttttcgaggggccatctgtgtatttttattgggttactccattttcccattacagaaacaggttgcattcagacctgttgcaaaagccattgttaacatataaaatactgctgttattttctccttttattcttctttatcattcggccccactcgtctattccagttacagagggagtaataaagcatttgctgctgttccaccaaaatagaaaattatctgctggccactcttagactgaaacagaaatgaagtgagaaattctactgcctgggtaaacacccacgggatttcagtccataagttggagaacttttttataaaagcaatttctcagtcttttttacactaacttatacagataattgtggatcctctagggaaaatacttagctcaggagttctgaaattttgatatgggagcttgtggccatctgggcttgggaaatgactgtacagagaacgtcttgggagagagagagatgatttggtgataatgagggaacagcttagtcgtgttcttctatctcatcaagaatcctgtttgcaggagaacaagcagcatattaataaaggctgatttttaaaaagtacctatatagtaataagttgatt

SEQ ID NO: 467704 - DNA, 569 bp, Homo sapiens
gtaggactataattagtcctgatgactataacgtccttagtgggttcctatatctgcccatgctttctaaattgtccctacattatattttcaaaatacccaacttgaggtcatttttttcccctcttgagactctcaaccctggggaatacaggtttgtttgttttacatttcttcatgagagacgcaacagcatgtatttcaatcctccaatgacctctgttgtcatttactttgaaactttttttttttttgagacagagttttgttttgtcacccaggctgtggtacaagtcaaccagcaccacagacagttcacgttgctttgcattgcaatgctacgacttcctaacttcaagagacagaatttgtggcgatccagttttcctggcatcacggccctgtgtttcaatctttcctgtgatgtggatggagacgatgtgagagcggcagcaaaaagaaaaaacacctgatgaggtaacgcgtgtgttttctgtagtgccgtctgggctatttaaaatgtatgtcatggctttttaatgtgcaagctttgaaaagattggtaagag

SEQ ID NO: 467705 - DNA, 576 bp, Homo sapiens
cggcagctctgggaaactaatactgtcacccaggaaacttacaatcatcatggaaggggaagcaaacacgtcctttttcataaggcagcagaagaagaagaacatgcagaggaaatgtcagacgcttgtaaaaccatcagatctcatgaagaaactgaggcacgaagagttaacaacttgcccaatggacacagcaggcaagtgtaagtgtggtaacagccatgcttgtccccagcttgtagaaagtagcactattgctgacagctgccaaccattactgcctctcctgagtcatgaagatgtcttcaagaacacaacattctgccctaatagagctctgacgaagggctctcccctagttgctgtatatttggctgccagaaggcacttggctgtcagtccccttcaggaactgcctcagctgaagagccacctcacccatggtcatgccccttccccagggcagaccaacccaatgaatggtcaacagaggtctaaagacacagccccctggctaactgggacaatgctgaaggactatcccagcatcagagcttcgcacagggttgactgagg

SEQ ID NO: 467706 - DNA, 651 bp, Homo sapiens
cagaagtcacctgtcttctgcgtcgatcatgctgggagctgcagactggagctgttcctgtttggccatcttcttctttcttcctaaaaataattattgtgcccccagtaggttctggtgggctttcatacgtaagatcccgcgggtccaagtaggctacacggaggaactgcagcaatgttgtgaggcacataatcttttttctttttttccaactcaataccccatctgccttaagtgtaaaaaaaaaaaaatacaagaagctgtatggcagcaggaactaagcagagttttctcctctcatagctggatgtgctctaggcaaggatatgattgtaatgcctcatttgtgaggatggaagattacagaaacaaagacaacatgacccgagctattccaattagaccagggtcctttcatgctagccaaacctcctccaaaaaaggcaccctggtcagttttcataagtgcttttgtttatattacaagtttccaaatgggaaaggtgacaagatagagtataggaaggctctattgtctacacatcaataattctgaatttaaaaggagattgcatgtctttcagctatccttagaggtgggaaacagatgaggatttcttatgcttaaattctgccgtatggcctctc

SEQ ID NO: 467707 - DNA, 1301 bp, Homo sapiens
agcttcatgacttaagtgtggttatcacaccggtaattcactatgagctctccagaaaggcattcgttcatctttcttgggacaatgctcagtgtgtaccaagcatatgaaagtgaatctgagtatctggcccttaatctctccaaactgtaccagtccgaatccaaatgtcacgtcagtccctattcccgctgctcttggccttggactctgcatgtctgctgccaggacagagtcgagctccatgtggctgtgtctatgagtgacctggactcacctctctttgtcaagtgctcctccaggaagaaagggagagatggaggactaaagtatcagaacattcagccgcacccaccaaccttcaagtatcagaacattcagcccctcccaccaaccttaaagtatcagaacattcagcccctcccatccacctccagggaaagggtcgtcagaggcactggagattaaactctgtaaaaactctgggacaatggaagctctgctctccctcctccaaaactcaccctctgcatctcttcatctgtatgcttgctaatatcctttataataaactggtaaacctaggtatttctctgagttctgggagctgtcctagcaaattagttgaacccaagtggggactgttggagctctggtttgtggctaacagcatcttgctatgttcttttaattatgtgaacccttttagctctccttaagaaaaattccttgttcctcttccagcctaggtttcatgtattcttagatttttgcatcacagatatttttaaccaaggaaaagaggagcacttagggatgagggtgggcaggggtgttaagagaagtatagtattcaaaaaattacatgagatattcaatactttatcacaaaataggttttgtgttagatgatttttccaaccataggctaatataaatgttctgcacatgtttagggtaggctaggctaagctatgatgtttggtaggttaggtgtattaaatgcattttcaacttacggcattttcaatgtatgatgggtttatcagaagaaattgaggagtcatttctgtgtatgctgcacatgtgacactgtgtgtgtgcgtgtgtggtgtatgtgggtatgtgtctgtgggggaagggccttgaggatgagtccagagagttggaggaacgtggagttaaaaccactgaattgagccaatcctccagagaacatagtgtcttatctctaaactcgcaggctcacaatctaatgcatttatgcattgtttaattttggtgttcagttacctgctgct

SEQ ID NO: 467708 - DNA, 1972 bp, Homo sapiens
agttatactagcacctaatgtggatggagccctccccacaagccaggcacggcgctaagggctgtacatcactgcctttagtttccccgatatccctgtgacatggagactattagcaatgggtcctggtttcctttcaaattctcagggcgaatctgatggtgtaactcttccttttgaaggaagcctcaagtctctgttcccagccctggctgtcaattggggtcagcagggccaggactcaaaaatgaagtttcctgactccaatttcctggactttaccatggcccttagttcaggctttcgaagggctccaactggacagtttcaccccggcaaaccctttgatagccatctccctgaacacttcctgaatcagacgatctggttcctagctcatgctcaatcctctgggggtgctaccactgaccccaccctggaccacaggatcagaaacgatccattccaatgcagacagtcctcagagcagactgagtaacgctgccctgcaatccagcccctggaaactactattctactttctatctctatgaatttgatattctcggcaccttatataagtggaattatacagtatttgtccttttgtgtctgtcttgtttcacttagcatgtcttcaaggttcatccatgttgtggcatatatcagaatttcattctttcagggatgaataatattccattgtatgtatataccacattttatttatcccttacttgtcaatggacacttgggttgctcctaccttttggctattttgaataatactgttatgaacattagtgtacagatatctatttgagtccttgctttcagttcttttgggaatatacctaggagtggagttgctgagtcatgtggtaattctatgcttaactttttgaggaaccaccaaactgttttccacagtggttgcaccattttacattcctacctgtaatgtacaagagtttcaatttctccacatcctcaccaacagttgttattttccgttaaaaaaaaattatactcgtcgagtgggcttcatttgtttttcaagactctgaagtcaatgaggcctaaagttaacatttcttagatctgagtggttggtacatgagaactttttatattatgcaatgaggaccactgtctggggtccactcttctcattgttttacatttgaggaaactgaggctcagaatctcaaaactggaagtgttcactgaggatgattgagcctctcagccaatatgtttgcaatactccagcatttttagaaacaataaatgtttggcttaaagcaagcaaaggctgagaggaaagcacactggatgcttttgcaaactactcccccaccctccagattctgatatgtcatccttcaccctccagaagagatcaagaattgaccctccctcatcacctttcttactttcctcctgaaatcacacacccaactcttagctaacctactcttagctaacaggccctttgcctcccatttcctaccatgatttctagcccatgggtgtagactatttcagagctgtttggaaacttagagtcaatactgaacccaaccctgtggcctcacattcaagatgcgggaacccagggagatgccagccccagagcccagacacagtatcccagcaagggctccttgtccctctgcttctcttcagggctctgctgacctatctcactgggcagtcctaaccccacatcatcctgagtaagtctcacagcttcgctgaaatttgcctgagttgttctggttcctggacatttgccaaggtcttgatcttggattcacttccttgatgatttttttttcctcttttttttgctgactcttcctgtgattgctaagatcttcatttctcagatgaggctcaagcagaaatgcagctggaccagaattggcagctccacggattcctcagagtccccagaccagggtagctc

SEQ ID NO: 467709 - DNA, 1094 bp, Homo sapiens
aactttccttcaggtctaactggttctgcatacacaatgaggatgaattcgggggctaaatattgggcacctgtcagccagttaaaagcgactagcatggctgccagacttaagaaactaaagacacgggtgtcagactttctgggaaagggctctctaataacccccaactctttggagttgggagcgttggttttcaagaatgtgtcggtaagggccactaaatccgatttttctcggtcctctttgtggtctaggaggacagatcaaaccctggcctttaatttaaagaatgtggctttagccacagcccgagagtttggagatacctggtatcttagtcaagtaaatgatagaatgacagctggggaaagggacaaagtctctcccggtcagcaagccatccctagtgtggatccccactgggacctagactcagatcattgggactggagtcgcaaacatctgttgacctgtgttctagaaagactaaggagaattaggaaagagcctatgaattattcaatgatgtccaccataactcaggaaaaggaagaaagtcttgccttccttgagtggctacaggagccttaagaaaatacactcccctgtcacccaactcactcaagggttaattgattctaaaagatatgtttattactcaatcagctgcagatatcaggagaaagctcccaaaagcaagcccttggccctgaacaaaatttggaggcattattaaacctggcaaccttggtgttctataataggggccaagaggagcaggccaaaatggaaaagcgagataagagaaaggccacagccttagtcatggccctcagacaaacaaaccttggtggttcagagaggacagaaaatggagcaggccaatcacccagtagggcttgttgtcagtgtggtttgcaaggacagtttaaaaaagattgtcctatgagaaacaagctgccccctcacccatgtccactatcgctgaagcaatcactggaagccacactgccccaaaggacaaagattatctgggccagaagcccccaagcagatgatccaaccacaggactgaggtgctcagggttagc

SEQ ID NO: 467710 - DNA, 1282 bp, Homo sapiens
ggttaattcactgtcagcttttgtgcgggaacatcgctttggcttgtttgaagctcaaggagcctaagaagtttgcttgctaaggtgaagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggacaaatggggaatgatcaaagaatgagagacatgtgaaaatgcggactgccgaggcaatctttatgaggttcaaaatctggtagttttatacaaggtgttatttggaactggattatttaggttagagtaacagattgttgttacctccattatattttatcctttgttgttgcttgactacttattctgtttggctgtatgcctaatgtatattttttaaaaatgagtgttaccct

SEQ ID NO: 467711 - DNA, 767 bp, Homo sapiens
gaaaggcttgggagggtatgaggagggtggaatggggagagattgggtatggaggcaattttgtttgtcacaacaggggagtgggacgtgggtgccgtgggcatctcatgggtagaggctagggatgctggtggaatttgtgctgttattgaaaggcaacttcagttccttcttgttctctcttgccctttggccttctgccatgggatgacacagcaagaaggccctcaccagatgccagctgtttggtcttctactttccagccttcagaactagagactattctggactatcctggtatactcagtgtaataacaagtattcttatgaaagggaagcggaggaaatttgactacagtagtaggagatgtgatgatggaagcaagtggagagatgtgaaggaagggaccatgagccaacaaatgaggacaggctttggaagctggaaaaggcaacttttaccatacattgattattcttatatgaaagaattattattaatgtgtttaccaaatgatgattttctatttcatcatttgttttacattattaactgaactttttcactgtaaacaatcaggaactttttcactgattgtttacatgatttgcttctcatttttcatttatcatttcagatgttgtttccttttgtgtgccttttgtaaagcaatcttctctgaacctgtaatagggattgttttaatgtaataaattctggatattaattttttgttcattattgatacagcaaatatcttctcat

SEQ ID NO: 467712 - DNA, 2203 bp, Homo sapiens
agacacttccttgtaataattctgagatggttctttgcaaggcaccagttccccttcagcttttgccatgattgtagccaagcagatgctgccagtcttcctgtacagcctgcagaaccaagtaaagaggagccaagtaccagtagccaagacaatgggaaaaattcctcaaaggcatttcagagaccttcatggaagcccctcctatcacaagcccagaggcctaagaggaaagaatgcttccatgggtgaggcccatgcttatagccttgtgcaaccttgggacactgctccccacatcctagtcactccagctccagccaaggccaaaaggaccgaggcaaccatcaaaagggacccagttcacaacaaggagataaaccttggtagcctctttatcccttggttccgacactcttctccctcacttagagacgtagaggcagctggcaatagcaatagggggatcccaccacatccctatctcacagagagacatcctgcagccagccctggaaaatcccttccattcttcccaggagatgacagcttcatgaatgttattgctcctgaagacattccggtgtttgtcaaagatcagatggttgtagatgttcaggatacaaaatcaatgtgcaaaaatcacaagcattcctatacaccagtagcagacagagagccaaatctcagtactcttttggcctttgaaaaaatacagacctgcgtaagtatttatatgcaccaatatttggagaaaatatataaggaggaagacgagagggaagaagaggcagatgacgaggaggaagaagaagaaatccatgaaaaagctactgagaatcagtgaatacttctaataaaaaatggacaccaatttaaatctgttgctatctggaaattctctttcttcaccacatatatttaagaattactaaataaatgttagaaatcaagcaaaaacataacttgtgactccccttgagtcacagtttgaccactgttgctcatccagggcaacctgtgaagagtcattatctagaaagattcgcctgaataaggcagacattggaccaaagcagcctcaccctatgactaggactcgatttcagaaaactcagttctggcttctgttttgggaaacagtttgtaactgtgtttaatatcatttgaatatctataatcattcttatgcaaatagcatgataataagtattaacattaaagacagaagtttatatttgtcttatattatctgtccccttccaaaaggaacttaaatcttaagtcaaatgctctatgtaactttaagcaagttacgtattctctcagagagtcgagttcatcttctgtaaaagggggatggggaaacaatcaaaaacttttctcataaggctattattaagtacatattagcattactaaagtgtttgtaaaacaatgaatacatttgtataaattgataaagtttttaatttaatatatgtttatacatatggatattatgtattaaattatgttttaaatttaaatatatttgtctgccaacacatatgttattccatattaaaatatcttttcaattatttcatggaattctggaccaacagaggtgcaaacattaacctttagatttgactctgagcttcctagaagaccaaacaaaaagacactgtcatttatataatttttattatgataagctttccagtattgaatttattgccacttaatttctcaaacattaagttaatttcattatctgtaaggaaagcattatttctaccttctatacctagagagtttttctgaagatcctcttagataatgaaaatgaatatgctttctgtgttgatagaaaccctacaagcaagaatatagtatattctaaaataatgtttcttttacaataattttcaacatataagaaaataaaaagggaagatttcattcaaataagggcatttcaccagcccttttatgattatatatagtaatagttttttactatttaaatggctgaaagattctgcatattagacctttattggctgcatagcttgtgaatattttctcccatgctgtatgttgtctgttatactttgttgatagtttcaggctttaaaccaataacagtaaagaaggacaaagaagggcattatatattgataaagagttcaattcaacaaaaagacttaactattct

SEQ ID NO: 467713 - DNA, 1648 bp, Homo sapiens
gaacatccaaactatatcaaggtctataatctatctcaagttaattcttgtaaagacttccctgttctccgttagattgctttggtcaaaaatcagtcagcaaagctcactctcccaagttgaaacaacttatggacaagaagttattgaaattaaatggtggcagacatgtcaaagggatattgcagggatttgatcactttacgaatcttgtgatagatgaatgtgtggagatggcaactagtgatcaacagaacaaaattggaaaggggagggaggacactgggttctgtcctgaaatccaggccactaagggatatatccctgaacttggacgttctcttctggatccctcatctccggttgctgttgttctctacagcatttctaacaatatcagctatggtgttgatcattgcaatggaccacggaccaccatttcttttgcacaaaggaaagtcatcaaggaaatcctggggcatatactgatcaacatcaaactcatcagtgtgtcccaaagtgctcattttaaaccaaaggatctataaaatttaaattcttttaaattgaagtagccattttggaaagacagaagcataagtaaataatattgaactaggtgatgagataatccagtatttggcctgattaaaggtaaatatttgtcagttccaacattgaatacttggcattatttgttgtgggaatatttatttattatattggaatataataacttttaatatatataatacactaaatacataatatataattaatattataatatataatattaatatattatagttgaatattttatattatgcaatgtttattatatatttattatatgtcaatattttaatatatcagagagaacaatacatataatctttggagttcagaaaaagtgaaataggcctgaagttcatttcttagaaggtgcctagatatactagaaacatgaagaatgaaattaataaactcgtaggatgacttcttcctttgccatgaatcgttgagggttgtaattatacaaatttggactcacagacaagtacttttacattttgaaatgtttcaccaaataaatattagtttatttattaatatttatttaagtttctttctttttctctctcccactcatttatttgttacagtatttgttcaaaaagtacaaaatgtccacgtgacaggccccttacctggtactaagtaatataaacatgactatgaaacattgatttccttaatctcaaggaggcaaccctccttggagcagtccatcatgtgactaattatcatgcaatagcgtcagagtgagacatatgtctaaagtgtgggtgagccaagagtaagtgataatttccagtttaggggttgaggatgattttacagagtaggtaataaatgaacgcaagcttacctggtagggaatagggagggaaaggtgttgcagaaatagcacaagttaaggcatggaggtataggcacaactagtttgttggcagtgctctaagtcagaggtcctcaaccctcaggccacggacaggtaactggtccatagactgttaggaactgggctgcacagcaggaggtgggcagcagatgtgcgagcgaagcttcatctgtatttacagcc

SEQ ID NO: 467714 - DNA, 1263 bp, Homo sapiens
aaactgccggtttacactgtttctccaagccatcacagctgatagctcctgaggagaaactacaaaagcaccagagacagggagtggtttttggaagcgggacttgtcgcggagaagagaggcgagaggaagtttgtctgacaggcattaggacccaggaagcaagggtcaggatagataagataggtgggcgagtctcacttgggcaacgtaactttgagagttctgcttacggtcgcagggtcaaccaacttgttgttgggaccccggagctgaatggctttcctctctgtcgaccctcagctcagcccagaagtacaggaaaagcggaagctggttccaggcaaaccaacgctcccaactccgaagagtcaggggttgttacagagccctttcccagaaagtctgacacctgtctttagtgcggccgccgtgctaatcacttttaactggccaacaggtgcccggtatttagcccccgaattatgttcagatgtgtctggagtttcttccttctggtgggttcgtggtttcgctgacttcaggagtgaagccgccgaacctcatagaatgaagccgcagaccctcacagtgagtgttacagctcataaaggtagtgtggacccaaagagtgaacagcagcaagattcattgcgaagagcgaaagaacaaagcttccacagtgtggaagagcacccgagcgtattgctgctgctggatgaagctgttggatgttgcatcatatcactagtataccatgtggaattactatcacttgtgcatgccaacaggcttatacagttgtacaaaaccatcgatacgtaaagtagcacgagggagaagtgtgatgaccttttgtcctctgtattgtggaaagcccatgccaaaaggagcaaagatttccacctagctcaatggttggtgtgtgagccataagataaactggaagaggtatactgggatcaatacagacaacaccagctgtgtttgcagcaaagaggctggaggacacaactgaaaaatatggcaccagaatgccagttatgcatggctgaatgtgcaaagaacagttggtctacaaaatgccttctgatcctgaaatggtgttgagaaagattgtgaaattttcgatatgacaatattgtggccacggaatatgtgtttagcatgctgtatgaagaaaagaactccagttctgaagggaagtgtgttcatgttgaagaagaaaaaagtgtgttcaatatccctgatgatgtctgttcc

SEQ ID NO: 467715 - DNA, 521 bp, Homo sapiens
ctgcattctatctagaggagggcagatgatacatgaatatataatgaaggaatttcactatgtttatgcatatcaaaacatcatgttgtacaccttaaatataaaaaagaaagaaaacatatttgatggaaatgtggtttctgaagccaaaaggggccaatttggaaaaatatccaatttgaccatcctatcagttccagatgaacctctgtttcctgccaaagtggaacttcagccagtgcattttatttccattcccaaactcatctgcatcatgtggcaatatgtattaatgctcatcgagctaccacttggatcagggcctgccacattgaaagacacggctctcctgttgtcaaacgctgcaccttcccggcagctgcgcacaaaagagcctgtgaagaaatcagctgggtttgcgtgcacttaaagttgtatataattccggtgttaaatttattggaagactgagcgtaatgtaaaacacagagtaaaaacgaggctccgtgtgtcagctttac

SEQ ID NO: 467716 - DNA, 821 bp, Homo sapiens
ccttccgagcttgtgcatgctttctcctcaagaagaaggtgccttctatgatgagaggttactcacccacagcaggtcttatgtccttctctggtcgagaagcatccagagcccctgtgtgtgcttttatgacacaaaactatattaagttgaactgtctgaaattgttgctattctaccatgtcaagcccctgagtgtgacaaacctgcctctctgctcagttcttctcacaccactcctcatacctgctgctccagccacggcaaaccctggacacactgtgcctttgcccaggctgttgcctctgcctggaatgctctccccattcagctctactcaccaaactcctatccattccacaaaagccagcttaaaagtccccttttgcaagccttctctgaccggcaacaccatccagtccgttattcccaccatagggccgtatgtgagctttctatgggttctactcattcatcataatttatcttgtttatatctatctctaaagcaaaaaagggaattcttagaggacaattcctatttacctctgaatcatctgggcctcccactgtgctcatagtaagttcttaataaatatctgatgaatgaatttggcagaaatggaattctatcatactgaaaaactgaaaactgatagagactctaaaaacttacctcttcttctcttcattctaaaataagtataaatgtaacatatataatatataataataaaataatatctaatatattaattaataaaataaaatatattatattaataaaataaatataaaattaataaaatatataatatata

SEQ ID NO: 467717 - DNA, 577 bp, Homo sapiens
gtgggatttaatgaggtgacctggcaggagcgcttcaccgggggcctggaggtggtaagtgccaagaaacagtggccatgttcctgtggtctcgagtgatgttacaactccctggcaaggtgggcagtggcacccgctatggagatgggcacgctgacctggttgctaaagtgactcacccaaggccacacatggaggaagctgcagcgcgagtgtctactgctgccttcgcaattgaaaagcccgatccccagccggccaggagtggtcggagcagggagaaggagtggctggccctcaccttgcccataaggagaataaaccagtactaccagtgtgcctgcttggaggttcttggctgctggaggaacttgagggcagggctgggcttgctcctctctgggtcgggcacagcctggagctcagtgactgtcacacgagaagtcctaggccagcaagtatgggagttggtgaggggcattcagtggccactgaaatgaatctctcattggcggttgagcccttcttttcctgctttttcccattttcttccctgagagtggactctgttgatatg

SEQ ID NO: 467718 - DNA, 962 bp, Homo sapiens
accccgtctgggaggtgtacccaacagctcattgagaatgggccatgatgacgatggcggttttgtcgaaggcttctctcgtgcttcccccagcacctgctgccatagtcccactgcactcctgttaccctgatcaggactctgctgctctcccaggttgggcccttgttctctggagcctgtgctgccctctctttttgcatttactccttttattttttcagatgaggtcttcctttgtcacccaggctggaatgcggtggcatgatctcggctcactgcagcctcaaccttctgggctcaagcaatcctcccacctcagccctcagcccccgccccaggagccgggactgcagagacgttccttaaatgtctgtggtctttgcatagtcctcatccttgagaaggaggtgtccaaagctctttggaactgtgtgtgtgaaagaggcatgtggattgtgtatgtctgtgtagttggccagtgctaactctggagaacgttaaatgttaatttccattgttttgttttgttttttgttttggagagagtaaatttttctagtacatctggctgctggggaaggggctgaggaagaagggcctcccaatcctgtgtacagatctaggcttaacactctctttgatgcccacagctcatctgcacctttagctcagccagtagttcataagtccagagcttctgtacttcactatttcccaagatcattatttcctaaggtaggtggcaggggaactgaagtctccttatatagacttctatcaatctccccttttcagtccttgcctgtcctcttctctgtggtctgtgcctttgggtcaggagctcctctgaggctctgcagggtgaattggcttgttctaactggcacgccctgcctgcatttaggttgtagctccttcctcttgttaagtgtttctgcttctccatctcctttctgatt

SEQ ID NO: 467719 - DNA, 1022 bp, Homo sapiens
ttgtaatagtaaatggttaccaatgtaatgcttctttttcactttgtcaatggaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacgggccaggtaaaattctatttcctagaatatgcttaagtgttcacctgtaaaagtgaaattctgatggataaatatcagggctgtattgttattttccagataaactggtctttcatctttccttcagtatcatttgcagtgacttc

SEQ ID NO: 467720 - DNA, 544 bp, Homo sapiens
ttctgcagctgcagcactgcctcgctccccatccagctctgctgctttctttcgatggaaacatgaacatctctaagcctggacaacctcttaataaacaacagaaatacattggagagaaatacagcaggggtgggagtgaggagaaacctttaagagacttacctgttgaagatcagaacctgcattctccatgctgcgagggctggatcctgagtatggatggagattcacgtcctagaggagcttccgagcgctatggtgcatggtgtttccgtgaacctgaggggccgtcttggggtgttggtgaggatgtggagaaattggaaccctcgtccactgggaatgtaaattggtatagccattgtgggaaacagtgtggaggagacagaaagagaagcaagttcctgttaattcacaagtcactggaacagctttactttattgctcccttatttccctctgttcacaagatgaattagacaagtcttaatatacacgaatgagcaatatttccaacctggttgatatggtttggctgtgt

SEQ ID NO: 467721 - DNA, 569 bp, Homo sapiens
gacctggcactgaaggttaaaagttcatgcattgctgtgaagttggtacattgctcatccaggtcatggggttggaggccagatgtggatgtggggctgcagccctgattagtgctaaagagtgtgcaattggcgtgtctcttatctctgagaagctggagtctgtggttgaaggcccgagggccctcgggcaaaccactggtgtaagtccaagagtccaaaggtcaaagaacttggagtctgatgttcaaggaagcatccagcacaggaaaaagatgaaagctagaagacacagcaagccagtttatccgaccttcttctgcctgctttgttctagccatgctggcagccgattggatggagcacttaatataagatctatcctcttaaactttgaagtgcataatgctgtgttgttaactatagacactgagttgtacaacagacctctagagcttattcatctaacataaccaaaactttatagccattgaacaagtccccaattcccctcacccacagccactagcaatctcttgtattctctgtgctatgagtttgactatttt

SEQ ID NO: 467722 - DNA, 652 bp, Homo sapiens
tccctgaagcccaagggtaatgctctgctctgcgtggcttgtagttatgagctgtcagtgggggctggagcatgggaacacagcaccaggagggggatccgagggcatccgggtggggctgtataagcatggtgccagcatctgctcagcttctggggaggcctcaggaagctttcactcatggcagaaggccatgggggagcagacatgtcacatggtgacagaaggagcaagagagagagaggaggaggtgccaggctcctttaaacaacgaatagaactggaagatagctcagggagaattgatgctttccctgtctggactgtatccctcctgggctgtggttatgcatttgagactgaacagggctggccagtgttgtgtgagcccaggtactggaaagcctctggaattgaaatcaggattgtgtttaattctttatggtcctgtgcctgtcagcagctggtttcatttatcttcaatgagagtctacattcctcaaccatccacttatgcccagttgactgtaagaccaagggacccatctcagacgtgaatctctgaaagcagacttgtattttatgtagttctagcttgtgcagtggttcagtagaaggagctttcttgtcctatgtttgctgcatattgtgc

SEQ ID NO: 467723 - DNA, 968 bp, Homo sapiens
ctggggaagtggggaagaacttccatgctcagaaccgtccctggccactcccgagcaccctcagccttcacctgcctcttgaccctggcgtctctgggagctgaggcagcaccctggacccccgagctgggggtcggcagcgccgtgaccccatctgccccatttaccatgggctgcaagatggggctcctcctggggtcctccacgtgtgtttctggggacagcacatcaccggaggccaggacaggctggggaggcaccagtagccccagcacccttgctgcaggcagggcaaccgctgagactccaggggctgcaccactgccctgtggccgggcccctcccctccttctccaggtccctccaaaagtgctggggatgggcacgggggaagtgacaggactcctggctctcccttcagtggctgaggacccccagtgcccacaggttcagagagggaggtctggcgggcgctgcggggcagccccgacctggcacctaggagaggagccccttccgcgtttcgacgctcccacccacagcacagagagacccgccccagcgctggacattggggtgtgcgggcacctggtccaaacccgttattctaaatttgacaagagaacaggggccactggcctgcttttcactggtgagctgtgtttcctggacccattattgatgctggggtctaatgacattttctaaactcttacagcttgtattaaaatatcgaaacctgagtcccttgatattgaggaaagtggtcagttagtcaagccatagagttggacagtagatgcttgcccgtcatcaccaagattgttcattgattttgaagcaatacttcaggattgacaaatgatagcagcctgaaatactgtgtgcgcctgtgagtataatgaacattcggtgagtgtgtcaatggtaacatctcctccctacaaaagatcatagtttctcaggtg

SEQ ID NO: 467724 - DNA, 2042 bp, Homo sapiens
agggggtccaggctcagggggctccacacctgcacctccatctcatctgctcctctacctgctccaccctcaatccaccagaaccatgggctgctgtggctgctctggaggctgtggctccggctgtgggggctgtggctccggctgtgggggctgtggctctggctgtgggggctgtggttccggctgtgggggctgtggctccggctgtgggggctgtggctccagctgctgtgtgcccatctgctgctgcaaacctgtgtgctgctgtgtgccagcctgttcctgctccagctgtggctcctgtgggggctccaaggggggctatggctcttgtgggggttccaaggggggctgtgtctcctgtgggggttccaaggggggctgtggctcctgtgggggctccaaggggggctgtggctcctgtgggggttccaaggggggctgtggctcctgtgggggctccaaggggggctgtgtctcctgtgggggttccaaggggggctgtggctcctgtgggggttccaaggggggctgtgtctcctgtggggggtccaaggggggctgtggctcctgtgggggctccaaggggggctgtggctcctgtgggggttccaaggggggctgtggctcctgtgggggctccaaaggaggctgtggctcttgtggctgctcccagtgcagctgctgtaagccctgctgctgctcttcaggctgtgggtcatcctgctgccagtccagctgctgtaagccctgctgctcctcctcaggttgtgggtcatcctgctgccagtccagctgctgcaagccctactgctgccagtccagctgctgtaagccctgctgctcctcctcaggttgtgggtcatcctgctgccagtccagttgctgcaatccctgctgctcccagtctagttgctgtgtccctgtgtgctgccagtgtaagatctgaggctctggactcaggcctcatgtgagtcctgctaatcctgtcttccaaagctgtgacctgtccttcattgttgagccccaaatcattgctcagggtccattccctgctgtagaacgatgccatatctggctgccttttcctaagaagagtccaccctaattaatgtccattgtctctcctaacaaattctctccccaagtcaactgcaattgcagctgaatcacccctcacccactagcctcgcctttgctcatcttttcagaggcctgagctcctgaacccacttgcagtcctgtcttttccagctggagcagctgggcataagcgtcccacctgctacaagaaagttgcaaactaataaaaataccatgccgacaaactgaaacacatatcttgctgatttctctgttgttcggtgtcattactatggctatggctattgttttcttattcttgttatatttcggactcccacaacccaggccatcctgactgacactgggtgaccgaggggctggaaaagaaaacatgccgagaaaggcagtttccacacgaatacacaaaaatctatactgcattaatcagggttctccagagacacagaaccagtgggagattaggtacataggtagattagatagatagatagatgcatacatacatagataatagatacataaatggatagatagatacaaagatagataatagacatatagatacatagatggatatatatagagatacatagatgatagatagatacatagacacatagatacatacataggtagatacatacataaataaatagatgataggtagatagatagctacatagacagatacatagttagatagctacatagatagatacatacttacatagatacacagatagatacatggatacatagatacaaagatagatacatagatggatagatacatatatagatacatagatgatagatacatgcatagataaatagatacatagctacatagttacatagatagatagatagatagatagatagatagatagatagatagatagatacatacatacatacacacagagagagat

SEQ ID NO: 467725 - DNA, 1319 bp, Homo sapiens
gaccctctcacacagacccccttagagttaaccatgggctgctctggctgctctggaggctgtggctccagctgtgggggctgtggctccagctgtgggggctgtggctccggctatgggggctgtggctccggctgctgtgtacctgtctgctgctgcaagcccgtgtgctgctgtgtgccagcctgttcctgctccagctgtggctcctgtgggggctccaagggggtctgtggctcttgtgggggctgcaaggggggctgtggctcctgtggaggctccaaggggggctgtggctccagctgctgtgtgcccgtctgctgctcctccagctgtggctcctgtgggggttccaagggggtctgtggatttcgtgggggctccaaggggggctgcggttcttgtggctgctcccagtgcagctgctataagccctgctgctgctcctcaggctgtgggtcatcctgctgccagtccagctgctgcaagcccagctgctcccagtccagctgctgtaagccctgctgttcccagtccagctgctgtaagccctgctgctgctcctcaggctgtgggtcatcctgctgccagtccagctgctgcaaaccctgctgttcccagtccagctgctgtaagccctgctgctgctcctcaggctgtgggtcatcctgctgccagtccagctgctgcaagccctgctcctcccagtccagctgctgtgtcccaatttgctgccagtgcaagatctgaggctctgcccacaaacctcagtgggtcctacagatccgggctctccaggaatgactgcagctgtgtcctgaattctgaagcacgtctctgaatctgtcctcctctggactaaggcagcctagcgtccagggctcagtactcagccgctcagcctctgaggtcatgagggcttctggcatgctgggtcctgcccatcaaccctcccggaatcccgtcttcctttcctgaccccaccacttcaaccttctcagggcttcaagatcccacatccctgggcccctcctgtgagcctgctggaaacacgctgacactggaatcctccgacctgctgccgcctctccccggtccccgcaacctcctggctcctccccgcttcgtcttcatcctgcctgagctgccaccgctccgattgcttttggagttgacctagaggactcggaattattggagaccccaggatcctctcctgaggaggaggggcgcccagtctcctcttctacctccgacctggccctgtttctttccccagggcttcgccttgtaagtgcctaggctagatcttctaaata

SEQ ID NO: 467726 - DNA, 729 bp, Homo sapiens
agagaagaagcaatgtaggagagctagcagggcctgtgaggagttcatcgggacccaggctgacggggtcacatagtaggggagtggggagggccctgcactggcatttaaatgccccagcccagtactccagtcactgctgtgagacaggtggaccccacggccccaccccgtttcattcggacctccaatgacagtcctgctcccccagcaaccaggggtctgacacacttggtgcccagcgtgctgaccaccagtgaaggagggggctgtctgtgccttagtgcaggggaagctgcctgcatctcccacacctttgggctcttggacctcgccctccagggaactgctgccactgaacctggccctctgtttcttcttctggcccctgctgctggctgggccctggccctgcggcccctggcaccactggccaagtggagttttgttggcaaagctggtgtcttgtggtctcagcctcggggaataacccagcccccacccctgtcaccgcccacacccgccttccgggctgggacccagcccctggcatttcccaaatgtcactgtgactgccgccagccacccctgcccagccttgggccggtaaggtagctgagctggttggcagagcaggcccactgtggacatcgtgttcctgggggatggtagtggagcttagagagctgagagatccgtggacacacacacacacacacacacacaccc

SEQ ID NO: 467727 - DNA, 845 bp, Homo sapiens
gaggaacagcagggcagacctgggcagtcctgcacattacggcctcttgggtcctgtgagctgagcctcagtgtccccatctgagaaacgggcctctccgggctgtctccctgggatctctcatagcactggggctacatagggtccctcctcttactttcttaaaaggctggaaagtttctcagatcctggctgccccctcccctcttctcaccctggaccctcaagagccaagtaaagccaggtatggaaatctgctctcttccaagatggaagagggcacccctctcaccagcaggctgggcccctgggactgcccttgtgtccaccggccctgcgtgggagaggaggggctgcaaggaaccagaggggctgctgcgtgcaagcctgtcccccactccctgcaaggagctgctgctccaaggagtcagaggggctactgcgtgcaagcctgtccccaactccctgcaaggggctgctgctccaaggagtcagaggggctactgggtgcaagcctgtcccccactccctgcaaggggctgctgctcttccaggccagccccagctggacctggggtggaggtgagggttcccacagagactggtctggcacactggctggccccggccccgtctgtgcctacatcctgggtgggaggagggtgcttcctgagcccttcacagggtctgctgcctcgagatgggtctggtgcagccaggagcagctgaggcaggagagaggctccccgtgcttcctggaagtctgtggaagatgccagtgcctctcctgcccctgagaccagttaaatcagttgtccaggcaggggtcaggcacggtgtctttg

SEQ ID NO: 467728 - DNA, 622 bp, Homo sapiens
gcagttcctccagggcagtggctttcaagtgtgggtccttgggaacctgtttgaatgtccattcttaggcctctccacacacctcctgaattggcaatacggtgggggcctagtccaatccctgggccacacagtacgtgtgagaagcactcgactggccttggtgccgaggacgccaagcagcacttctgcaaaaggccacagcaccttttgggaaaagtgaagcaaaggcttctaagaagcaaaggcagacagagcaggcacctggttcattgtcagcacagtcggtgcttgctatggactggccctggtgctgcggacgccaagcagcacttctgcaaaaggccacagcaccttttgggaaaagtgaagcaaaggcccccttctcaaaggaacacctggggtcctggtcaatacgaagcattcactgttcaatccaaccagcataaaaatataaatgggaaagaattcccacaaatttgcattcaaaacttcaagaagcaaaacttacaatccatctgcaggccagtttagaccacgttaacacaatttcaatctttattcccaacaaggaagtcaggatactgtgaggaaggtgaggggctgctgaacaccccacaag

SEQ ID NO: 467729 - DNA, 669 bp, Homo sapiens
cgccgcctggaagctgaggacagagttgtttatgatgagcacccttctagaacatccaccagcgtttgcagcccgctctgggacagctggagaaaatggcctggaggctggtccaggggctctgaagcccctgctcctctccagcttccaaagaacctgcagcatccctggaggctgtggccagccattcccctggctccggggagctaattacatcacaggaaactgcggtggagctgaagtggagggagtatgtttatacccaaatgcaaagatactgcccagcacagacttctgtcccagggggccggagagggatgtcattaaggccagatcagccaccacccctggctctccctgccgggaattccctggacagcaggagacctcctacccggactacactccaggcccagtggcgagacagagacacctgcagggctcccggattgggggcggtgaaaacctgcacggtgcacgccccagcagaccatagtcctcatgccagctggccagcagctgcacagaggctggtgggaagcaacttcctgacacagtcacccctccccagaagtgccctgtgaggccagggagcctcatgtgaggcctcagaccagcagggttggaacagagctaatgacatggcagggaaacatgtggatggttagc

SEQ ID NO: 467730 - DNA, 813 bp, Homo sapiens
ggtgtggagggatccgaatcctctcacggtgggaatggatgatggggccactgctttggagaagagcatggcatttcctcagaaggttagcgtagaaaagcgcaaacacttcactgaactaactcacctgattgaatttcacttcctggtgcaggcgcattgtaccaaccctctctacttcagcctaccaggagggaggaaggccaccgtctttccttctccttccatgtcatcctcagcgtcggtgcttgtgcagtacagagatacagctgaggacagcgcagcttctaaccttgccatccccaaggtgcgcggagccctcagggtgacccagcttgctgacgagcaagcggaggccgagcaggtgagactggctgagtcagacctgctgccggggcagacgcaggacaaggctgcttttttgcccctggacctcaggatccaggtccgggacgccgcgggcaggggctctggaccgcgctactcgacccctcccccaccgcctgggcccttagcagaggattctgttgttatttgtgtggacagcaaggagaagcaatgatgtaaagaaatgccatacttgtttgaggcaaatgccagtctttcatagagaccttgcaattcaatgctaggtcaatggaaacagcagatatgagaaagagaaaggctttgcaaagaaaaataaaaacacacacttctcaaaagatagatgaagagtgatgaaaatgatttaccaaaggaaacagaaattgtcttagtccatttgtgctgttataacaacatcatggcctgggtaatttataaagaacagaa

SEQ ID NO: 467731 - DNA, 664 bp, Homo sapiens
catggctgtggcaacgacagttccatgatggcagtgggggtggcggtgggggtggctgacctaacacaggggagggcaagtggactccatggagagggccctgatacggggaggctctgctggtctccgggagcaggtcaggacctgagcagactctctgggctcctcaggagaccacccagggcacacccagccctgcaagggtctctacgtggtgccgtcagtgccctgcaccccctggtaggctgcccacacctgtacctgctgccccacccagcaaggctgcagagctgcgtggttcatgcccacctccaaggaccccatggggctgaaggagacagcagagctgcccagctgcaaggtgaccctggagagcctcgccaggagctccaggggtccatcaagggcaatgggagcaggaggggtggtggccacttcttgatggaaacagccctcaatgccacagagggaactggaggagcaaagtgactgaacccccagagctggaacgcaggcccccagcccagcctgtgggaggtgcagcctcattcccaggaaagggtgagccagagaggccctgcttctgggcatatcaggaggcagcagcccagataccagtggccagtcatgggctcctcagactggaagtgggaggacttttctc

SEQ ID NO: 467732 - DNA, 2537 bp, Homo sapiens
ttgtgcacagctcttttcagctgtggctgtcagccttgatgcttcctctttgatattgtgacaggatggagcatgactggtttggggtgctcattcctgactgtggagtaggatcatgggctgtgcccactgaagcagcctgcaggaggctcagcggggggatcctggtcacctcatattacccctgctcagaggccaccgtacacataaaaaaaaggagaaacaacagtgtggcctgccctcgccccactccagctgatgatagccctgcactcccagtttctcaggccacaggtcctggcgtctccctgggtgctggcttctctcatttccttcaccccacgcaccagcagttcccgtggtcccagaatctgacccctcacctcctgcccacctgctgcatctctgcagtggcccattctgcactttcctgtccaccagcactgcagcctgtcctcctgttctctgcccgagacaacaggattctcctgagatatgaggagcagacccaggagcaggaccttgcgtggacgtggcaggttctgtggcaggcccaggctcggggagtgacattgacggggaagaggtgctcaggcagaatcctcctgaatgggcgagtggctgtcacctagataggacacgaggggtggggggagcctttccctcatgggggtggcacttgccaaggctaagtgtgaagtccccaggccagaacaggaccctgcagggggtgcagtatggctgggccagggccgcctgccagtgtcttcacctgtaagatggactgataatggaaatggcaccagggcaggctgatgttatgccaggtgggtgtacagaacacctgccagagcccgagttccccaggcagaacttctgccctgtctgccactcgcctgcccccacgctgcccagtgactctcaggaggagaggagctgatgttcctgcacccatgccacagggatggcaacaaagaggcaagacctccctggagctcacggagaggcctggtctttccacctcacagctctgtcctcctgcagaggcccctcttcccactcctgtcccctcctcatgctgcttctcacactggaacaatcttgtccattagttgtcatagcaactgaggcagggcgaagtcatcctctagaaggggccctgtgcaaattatggcattacaccaacttattgccaatctttttaattaaaacattttgctttcaactcggctaatggcagagatcagtaaacagggggagattgaattaccgatattgaagctcccccagctcttaaaaggcttaattactggtgggaccacagagaggcaaggaggggctgccagcgagcaggtgggcctgacccaccagggccgcgtgaaggtgatcaaatggagctccggcattaaaaaattttaaactcttgaaggacagaatgagctactagaattgtggctacagttctgtttccaggaactatgacgtcatgttgctggctgctgaatttctgtttaattaaattgcctatttgacacctggaggcagaactgggtgttcatggtgtggctgactgataagccaggactccacttgccccagagacccagcctcttacccaggaggggagaagtagggggaatgctgcccccacccaggcagttcacatcctcctgacaggagcccagggatcccttcccctcagggtgtctggtagcttcacagcaggaggtgccctcaggtgatccccatttagggaggaaaacaaaggctcccaagagatgagtctcgcccagccagggtcacaaaaggactcgaatccagtccttgccaaggcttcttttcgaatcatgaatttcgctaattacagtcctctccttcctctcttccaggttacctgatgcccaggtaggaactgcagctatttttaaactgagatttcctacaaattaaaattgctttgagtatgtgtgaatacatggatgtgagtgtatatgtagttgagtgtgttgtgtgtataagtgtgtatttgtgagtgtatatgtgtgaatgtatgttgtatgtataagtgtgcatgtgtgtgatgtatgtcatgcgtatatgtgttcatatgtgtgtatattgtatgtgtatatgcatgagtgtataagtgtgtatgtgtacatgagtgtgcaagtgtatgaatgtatgttgtgtgcataaatatgtatgtgtgtgagtgcatgtcatgtgtatatgtgtttttgtgggttgtggtataagtgtatatgtgtgagtatatatgtgtttgtgggtgtgtatgtgtgagtatgaatgtatgtcatgtgtacatgtgtgagcgtgtaagtgtatatgtgagtgtgtatatgtgtgagtgtaagaactgtgtgaggtgtgtgtgggcacgtgtgtatattacatggacatgagcatagatacttctaggctctctgttcctaagggttggggatcagctagggtccctgtaacagagcagaatttgattcctcatgaatgaaattgacattacagaagcacct

SEQ ID NO: 467733 - DNA, 1186 bp, Homo sapiens
gttttgccctctctggaagtgagaagagcccagaggcaggccctcccttaaaagcccagtgccctgaatggaggatactggtgtcctggggtggccagggagaacatctgagattcagatggggctggggccttgcagagcccgggagggctgccaggggctggggctgcacctacctgaaactatgaaaattctagaagataatattggaaaaacccttctggacactggcttaggcaaggatttcatgacaaagaacccaaaagcaaatgcaataaaaacaaagataaatagctgggacttaattaacctaaagagcttttgcatggcaaaaggaacagtcagcagagaaacagacaatgcacagacaatcccactattgggtatctaccagaggaaaataagtcattattcaaaaaagatactttcacacacgtttatagcagcacagttcacaatatcaaaatcgtggaaccaacccaaatgcccatcaatcaatgagtgcataaggaaactctgatacatatattatatatctatatataaaatatatattacatatatctatatattttatatatagatatataatatataactgtatatttatatataaatatttatatatatttcatgtatatataaatatttatacatatttcatatatatttatatagagatatataaataaatatataaatatatttatttatatatacatatataaatatatttatttatatatacataaatatttatttgtatatagatatttatatatctatatataaatatatttcatatatagatacatataaataaatatatatgaaatatatatatatttgtatcattcttatgcctttgcattctcatagcttagctcccacacatcagtgagaacatacgatgtttggttttccattcctgagttacttcacttagaataatagtctccaatctcatccaggtcactgcaaatgctgttaattcattcctttgtatgattgagtagtattccatatatatatatgtgtatatatatatatatatatatatatatatatatacatatatatatagaatactactatatggaatactatatatatatatatatatgcacactactgagtagtattccatatatatgattatatatatatgatggaatactactcagcc

SEQ ID NO: 467734 - DNA, 559 bp, Homo sapiens
atgtgcaccatgctcctcgctgagaacatgaacttcagatttggtgatatgcaatacaatgatcccttcagatgctgggcagtggcgtgagcacagctctcggccaacatatgactgcaggccaaacagctgctactccaggacgctgtggcgctggctgattctgcccaactgtagatgcactaatggctgtgtggaggtcgcccacggaccgctcacccaggacccccaggagctgtggcctgtggtcagagcaggtgctgccacagcaccggagacccaggccctggtgcatccagggatctctgcaggctgcggttgcgaagcctcctggtccatcaaggccttgggctctggttccagaacactaggggttatttcagaaacaagtatggggcacccaaaacatgcagctccattttaatgagcagctgctgtcctttttcagctgctatgggcccactctgtccaggctgcagcctctgggcagcctgaatccagccaccagccgtgagacttgggacagagtcaccctctcaaattctgttttgttctctgc

SEQ ID NO: 467735 - DNA, 1067 bp, Homo sapiens
gaagacccttgcgatgaaaggaggaaggaagatgaagaaggaagactggctaagttctggccgcttcttcgtccgcctctgatatgcgggccatgtatgcaggggttggcgagggggcaggcagcaggtgtgacagagaactggacaggaggagtccgcgccgcatcagggtggccgcggggctgcttctctgcctggagggcgccgtgctgccccttcccggcctaagtccctctgtgattcgcaactcggtttgtagcctggacgtttctcccgcaaccaccccacctccaggaaatgccaaactgcttctcacagtggtttgtactagcacaggctccgccagccgtgggacatgggaaggagggctgaagtcatctgagatgagccaggcccagccaatccactggctgatcactgatgagccagttaagatcagccacatccagcccagagtagcagaagtgccccatcgtcctgtggactcatgagaaataataaaaggttactattttaggcccctaaaataggctcccatcttcagtgggagaaaggaaatttccagctgggtaacttctaagttttgaagtggtttgttacagagcaacatctaactaatacgccagttatctgagagtactccagacccttgaggctctcagtggcattgttttatttattcaagctataatatttattgagtaccttctatgtgtgattccttaagggtactacttgaaaacttcagtcgaattttccctttagttttaatgggaaggtcaaggttatgtttctgttatctctaccaaggtggagtatttcacatacctgcccaggtactcattgcagcaggctaagactttagcagcactttggaagaaccaagatataagcataatggttcatgaaactctctcttttaaattttaaggccatttaaaactatgaatgtactactgagcatagcttaggcattcttcttttggttccaaaatattttgtttttatcttctgttattttactcccaatttactctttgacgcaaaaactattcatcaaagagtgt

SEQ ID NO: 467736 - DNA, 1331 bp, Homo sapiens
tcatcggggtgtggacactgtatgttctgcacagatggaacatttataatactgaccatgaaggtggccacaaaggaggcttcaacaaatagcagagatgataagcaggacatgctctctaatcacaatgcaataatgttagaagtcaatcacaggaagactgccttgagcccagttacatctggaaaacacaataactcacgggcccgaggaaaaacggtaatggaaaatacaaaagatataaaccaagcaatgatagaagcagcatatattgactctcatgggatgcagaaagaggagcctctcccatggtcatggccaccacaggcctacatgggatactgccaggctaccaccaatgttcactttaagcccaagcgcccttcagtcagcttatggtcaatgctgccaggcctgagcagcacagagttcaatgcagggtcccataatcactgcactctccttcctccagtgcacagattttccatgccacaggaccactactggggagtggaggaggggtggcttcagggattcaagactgtgttttctaccttcctcggtgcctctttcagcgataggaagttaaaaccaggtaaagattataaattcctgtagggtgttctagtggcagccctcaatttttgatatgtattattttatcagtgttgagttacaagcagttgcatagtatgaagtcttatgtgtctcactttttgcactcaatattttgtttgtgagatgttacatgtagccataatttatttattctcagatattatacataatctttcataaatgaatatgtcaccatttttccatctctctgtttgtggatatctggcttgtttccaatctttggatattatgaataatgctgctgtgaccatccttgtacacaactcttgaggtacatgtccatacattcatgttgattatgtatctaggaatgaaatctctggggcataggatatgcttatgttaaattctattccatgatgccaactgttttccaaattatttgtacaacatgcactttctccagcagtgtgtgagtacctacttctcctccagtcttgccaatgcttactattgtcagtttttaaagttttagccatttggcagatgtataatggcggctcaaagaggtgtgaatttacattttcctgactactaatgtggttaaacaattttgtatgtgtgtatgaattccctgctgctatggtttgaatgtcccctctaaaactcatgtggaaacttaatccccaatgtggcagtattgagaggtgggggcctttaagaggtgattgcatcatgagggctctgctcct

SEQ ID NO: 467737 - DNA, 1764 bp, Homo sapiens
gtgaatggttcactgccatctaagtaagcaatgacctacgcgttcctgcatgtaacacggcgagcgcgtgtgcacacggctctgggagttctcgtgcagcactcagagctcagcgtgggcgagggcgtcacccttcagggggcgtccatggggccttggagaagggaggctccggggcgccacagcaagtccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcggcagagtcgttggacaggtttggacaccggctgtctctttcgggcctcggttttcgcgtctgaaataaaagcgcgcatcctggccctggcgcggtgcctctgccgcggtagaggtttccaccatgagcccagtgcgccttccagactcgagggagagggagtgtgcgtgcgtgtgaacgcgtcacactcttgtgtgaacgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgtgggatcccctgaggcgagcgcgcaccgctgtgctcgggctccggctttgtggggacccggccttcccggcccagaggagttccacgcagtagccacgaggtggcaccgcagactcgctaccgcggagcgcggcggctcccggctcccagcagcctcgcctagggctgtggccagggcggtcagtctcaggcccaggccgctgctgccaggaaaagcaggaacaatcgccagtcacgcctgctgatgcccctgaagtgcttatgctcccaggcatgggctgaccgcaacgtgcattctctccttttatgtccctactgtttggaaccctgtttttgtttttgttttttgtttttgttttgtaaatctgccgcttaaaatacccagggtggagctaaaagtacagacactgctcaacttacccctggctgcggcccgataaggccgctgagagtggaaaatgactgagtccacctgactaccgaatagcacagcgtgggggcctaccttggcctgctgagaacactgccctgagcctgcggtgggcagaagcatcaacacgaagcctgttttgtagtcaagtgtcggatacctcatgtaatcattgactactgtactgaaagtgaaaaaccgagttgccgtgtgggactcaaacgagggtttctgctgactgtggatggcttttgcatcactataaagttgaaaactgttaagtggaactgcggttaagtcggggctgtgtgcactagagacctgagttctgccgctccatagctgtgtgactttggacacatatttgagcctgagtgtcttctacacaaaatggatttcttagcataacatacacatgtgtacgcgcccgtgagcatacgcgtgtgtgtttgcatgaacacatctgtgtatgcacgagtgtgtgcacatctgtatgtggctgtcccctgggcttcccttgaggtcctggagctatgtgggctccagctctgggaaggtggacccccac

SEQ ID NO: 467738 - DNA, 694 bp, Homo sapiens
gaagacccttgcgatgaaaggtgaaaatctcaagctgaaatagaggcacgaccagaggaaaggctaatgcccatttgtgtgtgtgtgtgtgtgtgtgtgtgtgtgtgtgtgttttactaggaggaaggaagatgaagaaggaagactggctaagttctggccgcttcttcgtccgcctctgatatgcgggccatgtatgcaggggttggcgagggggcaggcagcaggtgtgacagagaactggacaggaggagtccgcgccgcatcagggtggccgcggggctgcttctctgcctggagggcgccgtgctgccccttcccggcctaagtccctctgtgattcgcaactcggtttgtagcctggacgtttctcccgcaaccaccccacctccaggaaatgccaaactgcttctcacagtggtttgtactagcgcaggctccgccagccgtgggcacccttataagcattatagatattaccgactcatgttaatcttcaaagcaatcttagaacacagcgactattctcatactgttttacagatgagggaactgaagcctaaagaagtcaatgaacttgaccaagatcacacaaattgggggtgtaatagagattcaaccatccagctccagagtctgcatttttaaaccaagatagcagtcagctgtgttcaggcatcacctgcactgttta

SEQ ID NO: 467739 - DNA, 662 bp, Homo sapiens
aaagaggatgcaatcatcggggtgtggacactgtatgttctgcacagatggaacatttataatactgaccatgaaggtggccacaaaggaggcttcaacaaatagcagagatgataagcaggacatgctctctaatcacaatgcaataatgttagaagtcaatcacaggaagactgccttgagcccagttacatctggaaaacacaataactcacgggcccgaggaaaaacggtaatggaaaatacaaaagatataaaccaagcaatgatagaagcagcatatattgactctcatgggatgcaggcccgatcccgtggttgctggttctgcgaggagattttgaatccccactagattgtcttaaggttcataggcatttttgggttttctatgtctttttcagacacgttccaagtttggtctcttcaggttactgtctgttttgtcagttattggcagaataatgttgtatagtaatttgtaaaatgtctgttatatttaaagttatgtctccatttgatttattgtgttatatgctgtgccatccctcttttcattttcttggtcaattattctagaggttggtttacttttattagtattttcaaagaatcaccattttaattttgttgaccctttctttttttaatttttaattttc

SEQ ID NO: 467740 - DNA, 1770 bp, Homo sapiens
gtgaatggttcactgccatctaagtaagcaatgacctacgcgttcctgcatgtaacacggcgagcgcgtgtgcacacggctctgggagttctcgtgcagcactcagagctcagcgtgggcgagggcgtcacccttcagggggcgtccatggggccttggagaagggaggctccggggcgccacagcaagtccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcggcagagtcgttggacaggtttggacaccggctgtctctttcgggcctcggttttcgcgtctgaaataaaagcgcgcatcctggccctggcgcggtgcctctgccgcggtagaggtttccaccatgagcccagtgcgccttccaggctcgagggagagggagtgtgcgtgcgtgtgaacgcgtcacactcttgtgtgaatgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgcgggatcccctgaggcgagcgcgcaccgctgtgctcgggctccggctttgtggggacccggccttcccggcccgcaccacgaggagttccacgcagtagccacgaggtggcaccgcagactcgctaccgcggagcgcggcggctcccggctcccagcagcctcgcctagggctgtggccagggcggtcagtctcaggcccaggccgctgctgccaggaaaagcaggaacaatcgccagtcacgcctgctgatgcccctgaagtgcttatgctcccaggcatgggctgaccgcaacgtgcattctctccttttatgtccctactgtttggaaccctgtttttgtttttgttttttgtttttgttttgtaaatctgccgcttaaaatacccagggtggagctaaaagtacagacactgctcaacttacccctggctgcggcccgataaggccgctgagagtggaaaatgactgagtccacctgactaccgaatagcacagcgtgggggcctaccttggcctgctgagaacactgccctgagcctgcggtgggcagaagcatcaacacgaagcctgttttgtagtcaagtgtcggatacctcatgtaatcattgactactgtactgaaagtgaaaaaccgagttgccgtgtgggactcaaacgagggtttctgctgactgtggatggcttttgcatcactataaagttgaaaactgttaagtggaactgcggttaagtcggggctgtgtgcactagagacctgagttctgccgctccatagctgtgtgactttggacacatatttgagcctgagtgtcttctacacaaaatggatttcttagcataacatacacatgtgtacgcgcccgtgagcatacgcgtgtatgtttgcatgaacacatctgtgtatgcacgagtgtgtgcacatctgtatgtggctgtcccctgggcttcccttgaggtcctggagctatgtgggctccagctctgggaaggtggacccccac

SEQ ID NO: 467741 - DNA, 1408 bp, Homo sapiens
agtaggctccatgcagcactgctgcagagggtacaggaagaggccaaaggtcataatgacagcgggagctcaaacaagatcccgcccttcctgtcctccatgtgcctgtggaaatcaaccaaccgagcctctgtgccagactgctgttttcttaagagaacaattttatgacagttacttcaatgaaaatgcaaagaacatcagatgctatttggacctcatgatgcagaatgtggagtgccagatcaccacatactattatgttgggtttgcatatttgatgatgtgtcgctaccaggatgccatccgggtctttgccaacagcctcctctacatccagaggaccaagagcatgttccagaggaccacatacaagtatgagatgattaacaagcagaatgagcagatgcatgcactgctggccattgccctcacggtgtaccccatgagtatcgatgagagcattcacctccagctgcagaagaaacacagggacaagatgctgcgcatgcagaaaggtgacccacaagtctatgaagaacttttcagttacttctgccccaagttcctgtcgcctgtagtgcccaactatgataatgtgcaccccaactaccacaaagagcccttcctgcagcagctgaaggtgttttctgatgaagtacagcagcaggcccagctttcaaccatccacagcttcctcaagctctacaccaccatgcctgtggccaagctggctggcttcctggacctcacagagcaggagttcaggatccagcttcttgtcttcaaacacaagatgaagaacctggtgtggaccagcggcatctcaatcctggatggtgaatttcagtcagcctcagaggttgacttctacattgataaggacatgatccacatcgcggacaccaaggtctccaggcgctatggggatttcttcatccgtcggatccaaaaattggaggagcttaatcgaaccctgaagaagatgggacagagaccctgatgacattcacacacattatttaggaacctgttttgatatattacaggcaggaagtgtttttgctaccgtgaaacctttacctagatcagccatcagcctgtctactcagttaacaagttaaggaccgacgtgtttcaagtggatatcagtaaaggatctttggagccagaaaaaaaaaaaaaagatttgttctcaatgagattacacacagtaataatttttaattctcaaatctgtttctttttaaaacttctgagatttgtatctcagaagttcaacctttactatatttttttacacattatttacagatcacacatcattaccctttgtttcttttctccttcaaaagaaattggttaaatggttgtgaccaaaatgctgatagtgatatagaaagtgaag

SEQ ID NO: 467742 - DNA, 679 bp, Homo sapiens
cagcagcgtgaccttcgctgcaggagaaatacgcgtccagttcgttttcgtcagagttctgctacatcaggcctgccgtatttgctgtacacaaatcagccaacttcccaggcctgggtgcggagggttaaagagagaaaccaccagtcacgtgtatgtgcgatgtgtttcagggatctgagttacgcaaccgcgggagtggagggctgcaggaacatgctggaacgcacctcgggtctcatgttctccgcacctctgacctcggcagcgaggacagcctgggagtccgcgtcccgccccgcgcagcaggcgcgcccggcacccgccccgccgccggcagcgctggaagggcgctctgggccacgtggtcctgcggccgccccgcctgctccgggtgggcctcaggcggcctgcccctggaggatcccgcgttgggcgggctcagtgtggatgagcatttgcgagttggtgaagtgagcccagtgtggaaaaggcctaggacctgtggcatcattctgagtgatgccaagtcttcactgtgggataaagcctacatgtgactgtgctggaactattttctgtaattttgcctcaaattatgcagttttctctttggacatttttacctattctgacagctcctgctttactctttccattctctttcttggaactagct

SEQ ID NO: 467743 - DNA, 916 bp, Homo sapiens
aaatgcactcgaatggaatacaatggattttaatggaattcactctaatggaatggaatggaatggactcaaatgtaatattgtggaatggactcgaatggaatgttatggaatggactcgaattgggtggaatggaatggactcgaagggaatggattgaaattgaatggactcaaaaagaatggaatggaatgcaatggactggactcgaatggaagggaatggaatggattcgaatggttgggaatgcaatgcaatggactcgaatgcaatggaatggaatggattcgaatggttgggaatgcaatgcaatggactcgaatgcaatggaatggagttgactcaaatggaattgaatggaatggacccaaatggaatgcaatggaatggaatggactcgaatggaatggaatgcagtggcatttgcaagaatggaatggaattggatggattggattcaaacggaatagaatggagtggactcaaatgacatgggttggaatggaatggaatggaatggaatggactcaaatggaagagaatagaatggaatggactcgaatggaaaggaatgtaatggaatcgaatggaatggaatgtaatggaatcaaattgaacagaattgaatggaatggactggaatggaatgaaatggaatggaatcgaatggaatgtaatttactcgaatggaatggaatggactcaaatggaatagaatggaatggaatggaaatcgactcgaacggaattgacttgagtggaatggaatggaatggacttgaatggaatggaaatgactcgagtggaatggaatggaatggacccgaatggaatggaatagaatggactcgaattgaatggaatggaatggacacgaatggaatggaatggacctgaatggaatggaatggactc

SEQ ID NO: 467744 - DNA, 1665 bp, Homo sapiens
tggaacggacaataatggaatggaatggaatggaatggaatggaatggaatggattcaaatggaaaagaattcaacaaaccctaatggagtggaatgcaaagaatggtttcaaatgtaatggaattgaatggactcgaatggaatggaatggaattgaatggtctcgaaaggaatggaatgaaatgcaacggaatggactccaaaggattggcatggtgttgactagaatggaattgaatggaatggaccggaatggaatggattggaatggaatggactcgaatggaatggaatgctacggatttgacttgaatggaatgcaatggaatggattccaaaggaatgtaatggaagggaatggaacggaatggactcgaatggaatggaatgggatagaatggaatggaatggaatggaatggaatggcatggattcgaatggaatgtaatggaatggaatacaaaggactcaatggaatgcaaaggaatgttctcgaatgtaatggtatggaatggactcgaatggaatggaatggaattgaatggtatcgaaaggaatgcaatgaaatgcaatggaatggactccaaaggattggaattaactcgaatggaattgaatggaatggaccagaatggaatggaatggactcgaatggactggaatactatggactagagtggaatggaatggaatggattcgaatggaaagtaatggaatagaatggaaagcaatggactcgaatggaatggaatggaatggaatggaacgaaatggaatggaatggaatggactagatggaatgaaatggaatggaatagaaaggactcaagtggaatggaatggaaaggaatggactcaaatggaatggaaaggaatggaatggaatggaaaagaatggaatggaatggacacgaatggaatggatttgaatggaatggaatggaatggaatgaaatggaatggaatggacacgaatgggatggaatggaatggattggaatggaatggaatggactctagaatggactcaattggatttgaaaggaaaggagtcaaatggaaaggaatggaattgtatgtacttgaatggaaaggaatggatttgaatgtacttgaatggaatggaatggacttggatggaaaggaatggactcgaatggaatggaatggactcgaatggaatggaatggaatggactcgaatgcaactgaatgcaaaggacttgagtggaatggaatggaatgcaatggacttgaatggaaaggaatggaatggaaaggagtggacacgaatggaaaggaatgcaatggaatggtgtcgaattgaatggaatttaatggaatacaatggaatggaatggaatggactcaaatggaatgcaatggattggaaaggacacgaatggattggaaagaatgatctccattggtatagaattgaatggactcgaatggaatggaatttaatggactcgaatggaatggaatgcaatggaatggattcgaatggaatggaatgaaagtacatggactcgaatggaatggaaagggatggactcgaatggaaatgagtagaatgaaatcgactagaatggaatggaatggaatggactcgaatgcaatggaatggacacgaatgaaatggaatggaatggaacgtactc

SEQ ID NO: 467745 - DNA, 1605 bp, Homo sapiens
tccattccccaggagggtccttctgatgcttgtcgactcagcacttgatggggcgttgggactccgcagcagcagcgcagggtgcctgtgtccctgtgcaccgtgtctgcgctcacggacaggaaaggtggccggagacaggggttgtgcaccctttcaaacactgcttttacttttacccacatcaaaatagcatggagccatgcagcaggctgttcataggtggaatgtgtctgctccacagcacaccaatcacagacagttctcaggccacagcccccaaggagcctcccagtgctgggtctcttctcctgcccccagtaaactatggtgagaatattaagcctgaagatctccccagatctgtttccatacctggtgcactgagagcagaatcaaggagttacagtggcctgggactcaagttctcttttaccatcaggaaagagagagcggtgaatccagcatttgccatctcgtgggagctcactgactatcacgagaactgtatggcggaaacttcccctgtgattcagttatctctgcctgatcccacccttgacaaatggagattattacgattcaagatccaggtgcactgcccttgtaggcaggactcaaggctgtttgtgactagcaatgtgctcgtgggctcagcgaaagtcaatattgctcacttggagactcagaaaaccagcccagaaatgaagagcccttgacgccgaggcaggcctgctcttgacggcatgcgccctgatcctggctatgtaattggaagatacttcattttctgtggctatcagatgcttttgtgaagcctcttccccgtctgcctctcagaactctgctttttactgcactatatgtggcgacaaatactgatggacagagattgtggaagcctcaggattcttcttggcagaatgtttaggagcccccaccttcctcccgctcatcctgtggttgagttgaacatgcctgacgctaaagacctggagcgggctgtgccctgaggctaacttcctgatcatttaaaggtgctcacttggcaacgcacgtgctatcagccctcgaaaactgtcaatacctgatctgcggcaatgccgttctcagctcttaaaaggcttatgtaaggaaattccttcttcagctgaggcctccagggaatacaattttatttgtacaataaggctcagaaaataagcttaacttgaagctgtgctacccagtggctcccaccttggccttgatggacaactgcagttacgagagaaatagcttcaggatgcaggaccaaatggtccctccaccatccttaccgacctgggctttctgatttacctggctgcctggtgaaagccttcatcaccaggccttaaatcaacctaacagggggagcctgccgaccctacctcatgcatcttcatttgtcttttgcaaatagaggaaggcagcagagtcgccaccttcttcttccatcttcagcaagtgacttcagaaaccccaaaacaaaactttgtgatggaaattcctcatgtagtttctgggcttgcattgctaacaagaaatatgtttatctgtgctgtctggattgttgactcaggg

SEQ ID NO: 467746 - DNA, 518 bp, Homo sapiens
ttaaagtaatatgaacaatgcacattaatttaaccaaaaatcataatttgaatggaagaatggggtcaagaagtggagctgtttctgggcatctgcaggccacagaggggacagtgcttcatacctcagagcagaaatctgagactctaggattgggcatctgttcctcaaatatccctctgcccctggctgcggaagaccatgcctgcccccgtggatgcgggctcagctggcctcagcatctcatttcccaatcccgtgtcttttctcattatgttcctatccttgaagattgcctccagccatcccaattcgcttccctctgttgtgcagaaggtttcatctctcttggaccttattcctcaacactgctcctagctcccattaggacatccaaagcctatcaaggttgctgagatgatgaggaacccatgggcttgtgcaatgcatgtccagatagcaagctgttctgagctctccaatatttcatgaaccatgagggaatattttcatctcct

SEQ ID NO: 467747 - DNA, 732 bp, Homo sapiens
gatttccctgagcaagacgacgtcatggttcatgccatggccttgatgtgtccttcccgatatggttgtaagtttggaacagaccctcaaggcaacgctggaggtgtctgttccagagttggcagctttggggtgaagctgaagctgccactgtggacaaaagcaccaagtgggaaatgcagacggtgctgtggctcggttttcgttgttgctgttgttgtttttgtgtacaccgtcagcatcaccatcactatcaccaacgacaccactgtcatgttcgctggagagctggggctcacccagtgttctgtggcaggttgccggggaagctgtcagcccatgggagtggtgaaagtttctgtatctgttccctatccttcccagcctctggtttattcagggaccctctgtgataaggaacctggagccaggctggttgcacaagaaactggagtgaggttggctggggcttcaaaaaaaaagggagcagaagctgaggcagccaaggaaaagaagtccaggcagtaaggaccctgaggtggtaaggtctttttaagttccattcttatttctagtcttgttgaattataataaaacagtattgcttgtaatattactattttttagaaaatttacttaatctgtctttgtaagttaacatatgattactctttgtgaattgcatcagtgtgctcaggctgccataactaaatatcacaaactgaggggctt

SEQ ID NO: 467748 - DNA, 1081 bp, Homo sapiens
agctgcctaagcaaagaagagagactggaatactagcatggacttgtcacttaagttctattcacaccgggaggatccagaaaacacacctctcaccacaagtataagaaataaatttgtgaggggagccctggcatctttgcagagctctgtgatcgctcttctctgcaggccagacctcacagcagaaactgcagtcactgagctgggaaactcacacaagggagtaattggatcctgggtggcaggagcactcaaccccaaaaggcagaggctgccggacacgggttctgaactgacattaattccaggagatccaaaaagtcactgtggcccaccagtcagagtaggggctcatggagggcaggtgattgatggagttttagctcagatttgtctcaaaggggacccattgggtcctcaaacccatcctgtgctcgtgtctccagttcaagaatacataattgagactgagacacccaacagctggcagaattcccacagcatgggcttggaaatcactgtgggctttgggtgaccttgggcaaaataagagggttaaatgaagaaacctgaatgcttggatgagaattgcaattaaaggtaagcattattgaagaacagttccttagcttaaaaaaacaaaatgaaagaaagaggctggttatatgacagttgaaaatgcccatgatgtcccagacaaaatgagtgaaaaaatgatcacagttttgaatgaaataagtaaaggaaaagccctaaaagcacctagattgatgtattagtctgttctcatgctgctaataaagatatactcgagactgggtaatttataaagggaagaggtttaatggactcacagttccacgtggctggggaggcctcacaatcatggcagaaggtgaaaggcatgtctcacatggcagcaggcaagacagaatgagagccaagggaaaggggtttccccttataaaaccatcagctctcgagacacttattcactacccgagaacagtatgggggaaactgcccccatgattcaattatctctcactaggtccctcccacaacacctgagaattac

SEQ ID NO: 467749 - DNA, 666 bp, Homo sapiens
agtgaaggcagcatgcaaggaagagcagatctcccctaccctggccatgggagcctgagcaagggctcagggtatcatcaccttggggagaaccgttaccccaggcagagcagccgggttgctctgtatctgagatctgcagactgccttgcacacgtggttctgaaaaaggcagtggagaggaagtggattggaggacacttagacggaaggacagttagaattcgacggctgactgtgttggggataaaggaaaagaaggagtcaggggagaacccacatttggagccagaagagcactcagtgcctcaggaatcattacgagggtcagatgacaggttccagaacattcttcctccaccagctgaactgtcagctcaccaaggatcagttatgtctgctcccaagttggtttatgccaaaacagctggtcagggtaaaatggacttcactggaatgtactgactttcttcaaaaaaattcattaaaaccctggcaaggttgatctgcatcagagacagctatgactaatatgaatcttaaaggggaattttatgccagtaagctgaggagttggagctgaaatttggattggtaaggccaatgacacatgggtcataaagtttgactataatatactgtattagtccattctcacactgctat

SEQ ID NO: 467750 - DNA, 510 bp, Homo sapiens
ggcttttctcaggcttggagcccgaaagccgaggtcatgagatgctgcagcgaggccaagagcatccaatttggggaaactgctcttcagggaagtgtttgggtgtgtttgctttgggagattcctcttaatggaggatttgatgactcgagtagagaagctgcagtagtcaggctgatgctgagcagcgttaaggaggtcaatgtcacacgtctgggagaatccacagggagagccaggggcctgtggccggggaagacctgggatgccagcggggtagctgggaggattcctggaacttcggtgcggttacccggccctggccttcagggcccatcccgctggtactggggtgaggtggaggggacccagtgggtgggaggcagtaggcgctgccagtctcttggtgcctgttcctcggcacaagtaccacaccatgctctgttaaaaggaacttcatagtggaataagtgtgcgggccacaacacattgttcagctttgtgtaattc

SEQ ID NO: 467751 - DNA, 641 bp, Homo sapiens
gtggcacacagcaagaccaacaatatgagcaaaacttcatggcgaccctttggaatccaatcccaggacaacaaggatgaaagaacaacggcagtgagagaagcaaaggaagaggcaaagcaaaagcaaggtgcattcctgagctggtctcacatccatagaagacagctggtgttccgcggcttcaggaaccactgtgtcctggaacagttcaccaggcagcgggtggagatacaaatcatctgtcaccaagtctttggtcacatttgtctgcttgctcctttccatccaagtttgccacagggttcaccacctactccttcatactgggatgtgttacctgggccctctggcagctgctggacagtcatagtcctagccccagccatgattcttcatgtttcctctggttttcaagagaagacactggacgatgctggggatatgggtggggacacagctgatgagatgggttctccattaaggacaggaacaggcctgatatttaatcacaaagtccaggatttagacttcatttgtggaagttaagaaggaggtgtcatgaagtgagctggtcgtgatgtccttatgctttctccaggtttgcacagtagatgctagctgtttgtcaccacctagta

SEQ ID NO: 467752 - DNA, 1100 bp, Homo sapiens
tcacatgcctacgatatgtgaataatgtcaggtcagctaaaaaggggctttgcctttgtaacttttgatgaccatgactccgtcgataagattgtcattcagaaataccatactgtgaatgaccacaactgtgaagttaggaaagccctgtcaaagcaagagatggctagtgcttcatccagccaaagaggtcgaagtggttctggaaactttggtggtggtcgtggaggtggtttcagtgggaatgacaactttggtattggaggaaacttcagtggtcttggtggctttggtggcagtcgtggtggtggtggatatggtggcagtggggatggctgtaatggatttggtaatgatggaagcaattttggaggtggtggaagctacaatgattttggcaattacaacaatgagtcttcaaattttggacccatgaagggaggaaattttggaggcagaagctctggcccctgtggcaatggaggcctatactttgcaaaaccatgaaaccaaggtggctattggcggttccagcagcagcagtagctatggcagtggcagattttaattaggaaacaaagcttagcaggagaggagagccagagaaatgacagggaatctacaggttacgacagatttgtgaactcagccaagcacagtggtggcagggcctagctgctacaaagaagacatgttttagacaaatactcatgtgtatgggcaaaaaactcgaggactgtatttgtgactaactgtataacaggttattttagtttctgttctgtgggaagtgtaaagcattccagctaagggttttaatataggttttttttttgcacccatgctgttgattgctaaatgtaatagtctgatcatgacgctgaataaatgtcttttgttttaatgtgctgtgtaaagttagtttactctgaagctatcttggtaaatttccccaacagtgtgaagttagaattccttcagggtgatgccaagttctatttggaatttatatacaacctgcttgggtggagaagccattgtcttcagaaacctttggtgtagttgaactgatagttactgttgtgacctgaagagagcag

SEQ ID NO: 467753 - DNA, 647 bp, Homo sapiens
agtctatccgtgttatgattatgttattttcaagtcatctcttttcccgaaagtccccacgaaagaaggctaagtggatgcagtttgttgtagaaagaacactcaaagccaggcgaagccttctgttcccaggtgaggggccaaggcgaggatggccgtccgtaatgaggtctgccatgccacgcctgcctggtgagaggaagggtgctcagagggtcctcaacccgtcagctccggaccaggcaagatcccgaggatgctaccggaggtggtactgggctgttggatgtggagaggtcccctcaggtcagccgggaaggcttgggaaggataaccggcagctggcgacctttaactcccttgtcctggccctctctcctctcttccctttcatgctgttgaaagaacagcaaacattcaccgacctaggaaaataagcttatttttaagcacgtttctctaataaaaatgactaattataccataggaaattgccataattttcatatgattcaacttaacacatcatcacactaacaaaaatgctagtcatttgtgtttgattttcagaatcaacatacaaatcaatcacgaaagatgtatttgcagagcaaggcataagtgataaaacttttcaaaatctaaaa

SEQ ID NO: 467754 - DNA, 1527 bp, Homo sapiens
ctgtgtttacccaaggggttggggaatggcacacacaaaactggtgaaaatccagaggtcagagggtggcattaacaccagtgtgccatatggtggtatctatgtgaaatccattgttcctggaagaccagctgccaaggaagggcagatcctacagggtgagagatggggatgggtcctcattgggaactctgtgctccatggtggggacacctggcacctcagcttcctttcccacttctccaggctgcatggaggggtgccgggcagggtcctcctggaagggaacctcctgcagcctcaagcaccaggtcatgacatgacatctatccctttcccaggtgaccgactcctgcaggtggatggagtgattctgtgcggcctcacccacaagcaggctgtgcagtgcctgaagggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcggtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagatggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagataaacacagagaacagccgtcttccgaggcagagactgagggtttctgcatggaggtcctttggacagaagagccctcaggtgaccttggtccaaagagtgtacccaccagctctgccactgggaaagaaacctgtaggctcctgcaaaggtgacctgggatgaagggcctggcccagttgttaagagctcacttcaagaagagcatgcttgtcaattccaagactcattttgaatcatggctgttgcctctcttcagttctggggtttacgtccagcaaagctttgtgcgcg

SEQ ID NO: 467755 - DNA, 1259 bp, Homo sapiens
cagccatggaagctgcttgtggtgtgtctggtccagccaaagccttatagtgagctagcactcatgctggcacctggagctgcctgtcccagctgcagcagctgaagggtctggccaaagtccagttatgaaggtgagctgagatgggctccctcaaaggagccatagtgtggggagccccgggcagagcccagagagaaatgccagccccgagaccgagacacgctccaaggagtgctgccaagagcagtagacacagccgctgaggcccacggggcacagtgaggctgtgggagagggtggcccctctgtggccatttccctgcctgtgctcacatcccctcctcaggcctgtctcaccagctcttgcagcccatgacccacattctgtctgactctccttcctctcctggctacagggatccccagtgcccctcaccattccttctggtctctcctctgcctcccggaactgttccccaggaccctctcctgggccagcccttcctgcccctccacatcagtggttccgaaccccggatgcctttgggatcagctgggtacactttaaatccttccagcccagagccctcaggcccaagtcacccccgccagctcctgtgggaccccttggatcagccaaccattttatcatcatccatcatgtcccctgtcaccaagggcctctggcatgttctgttgtccccatgcccaccctggcacccctcacccaccaacctgtgcccacgtcctgccttgagcctgtttcccctcctgagtggtatttcctcactccaggtgggcactggggcagctggcagacatggctgtgagcttctgtcccatccagagggaccctcccttccagattacccagtcaagcttgaccccatggtgtcaccgagacggaccaaaagagggtattgaagccacgcagtcccccgagccccactgagctgcaccagctttggagccggagagagcctgggagactgagcactgagtgctaggtcccttcttcccactcttgagggagaaatcagtgtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagc

SEQ ID NO: 467756 - DNA, 508 bp, Homo sapiens
tctgaaaactttcatgcatgccgctatggtctaaaccactcgtggcggcacaagggagcttgtttgttcctctcaccatgcgaagacacagcaaggaggaagcctctatgagaaagcaggccttcaccagacaccaagactgccagcaccttgatcttgcacttctcagcctccaggactgtgagaaacaaagttctgttatttataagctacctggtctaatgcatttccttgtagcagcctgtacggattcggacagtgggctcatgtggatgatgacggtgtctccattcaggactaatggaagagaagggggaaggaaagagccacagagacatgtggccatagaagaagggcccatgggatgcaaggttgctaatggtgagagtggagaagagcccaatgccaaaaaatgcaggcagactccagaatgtggaaaaggcgagaaaaaagatcccctagagcctctagagatgaaggtagcctttccaccacctagattttagcc

SEQ ID NO: 467757 - DNA, 580 bp, Homo sapiens
gaaactcagaatctgcaagtgacacgtgatggaggaagagaggggcaaggaggtgggagctcagggtcttccttgtctgtatggagatcatggggtggaagtgctggaagataattttcaggaaaagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagattaaatggctctcatttggtagccatcctagacgactgtcaaaggtagatccataggaaatgatagtctctgtgaagtgtgaagcagtcgtgtaataccgttggaccc

SEQ ID NO: 467758 - DNA, 905 bp, Homo sapiens
tgtggtatatatatacatataccactcattgattgatgggtatttgggctgggggctactccttgaacaccttcatgtgcagcaatgatgccaaagctaagacctccttgagtcccccggccagtgtctggattgtgcccttcccttctacatcttacttccagcaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgaggcaccagcgctcaataaatattgatttgtatgatgataaggatattgatgatgatgatgatgataatgatgatgatgacgatgatgacagggtctctccaaagaatgggataccagatttcagcaatacaacccttctgagagggcttcaaatgcctggagcaagaggtccttgctgtgggtcccagagacacatcaaccttctgatggggactggcgtcttcctggtgaagatgaaggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatggctacactttccttctgggtaaagttttcttaatttggagactccattaacgttgagagcaaagttggaggtgggagatgggggttgagagtgtagtttaggttgagtggagcctgaaaggttttgaaacttcttcccgtgttttaattttccctttgcac

SEQ ID NO: 467759 - DNA, 777 bp, Homo sapiens
tgatcagccctgcccagcggcatgtgtgaaaccccctcccacagggtcctcagatctgctctggcccctggagtgcataggctgcccctgggtgccaggagtgtcagggaagcagagcccaagggagagctggaatttccgcatgggaaagacgtcagtcagacaggcctcccagctttcctggcccctgctgagcctggcagaaggctcagatttgaggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaaatactgaaggaagcaagaagaattcagggtccaattcagtctacagttacccccatttttactaaagataatcacaataagacaaatttgtttactaagaacatttatatcaaaactatatttataaatataacttaaagatttggcaccacttattattggataatgtttcccatgcattttaacatattgaataaacccaattagtttaacacctcttttacaagtgtagaatagagcattttaattaacagacccaaatatcttttgttcctctacaatgaggagacaaaagtatataagcttaaacttatgttcaacaactaatatttcagcataatatcttatttggaagtggtctattaaatgaatattcatcatttcatttaacttactataactgtaatgttttaagt

SEQ ID NO: 467760 - DNA, 487 bp, Homo sapiens
tctgtggcttcattcttgaagtcatggctgatatggtttggctgtgtccccacccaaatatcatcttgaatcatagctcccacaattcccgtgtgtcatgtgagggacccagtgagaggcttaagttctacataccagagagaaagttggatctacacaaagaaatgaagattccagaaatggttaaaatgaagataaacgtccatttatttaatgctggttacatcattacacatgtcactggatcttctactgtgtggcctgtttccaataactctctccaagacacctggaaggtcatcctagcctctttcaaccactggcatctagattcttgttataggctgaatgtgtccctgccaagttcatatgtcgaaatttatagccccctctgtgatgacattaggaggtgggacattgggaggcgattaggtcataagaggggagccctcatgagtgggattagtgcccttataagaagataagt

SEQ ID NO: 467761 - DNA, 559 bp, Homo sapiens
ctagttaagtaggtggatgataccgtgttgaccaagatggcttgggaatgtacaatcctggcatctgaggaaacagacctggcaagaggcagtgttcacacgaatcatgagattcacaggaatgggaagccgaactcattcccagctccagaagtggatgctgatattttaaaccaatcaccagatgccattcctttgatgatgatgattaatttgtccaggggcagcgaggaaaaggaaacgagatgtccagctgttggccccagtcataagaggaagctgatgctgcggatgaagagtggagcaatggaaataatctggggtccagaaaccaaaatgggagaaggggaaaccatgtggcctcagatgacaaagcaagtaagaaatagagcctgtttagatgcccaggtccctgatgtctgcttcaagtggtttttcgtttccctcagcatcactaaagatttaatgaaagcagattgatcatagctaaatatgcttcctctgtcagaatgaagagcatttggcaatgtaaaaaaatagagttttaagtgatgaaagc

SEQ ID NO: 467762 - DNA, 943 bp, Homo sapiens
ggacatttcaattgtctctctacagcactggccgtccatgtggccaattcaacccactcaatttaacatagttgaagttggtaaagcccctgaagtatatcaaagtagttatattttgcattgtaaaggacccgatggacaacctgcgactattcaaccaattataacttctgtacctataaatttatgtgggagagatttattacaacaatggggagcacaagttctaattgcagaacaattatatagccctcaaagtcgacatatgatgcatgaaatggggcatgtccctggccaaaatcaagagtcgatttggataccatcaagacttctgaaaccttatcataagccagatgccaaggaagaggctctgggagtatcccaaggatcccccagttgcagccatgttgagattgacaaccccaactgtcatgagcaacacccatcgaacacagccacccacctagggacggatcaagaagctgtcacagatggcggaagaaaacctgaggaaagcaggacaaccactcactatgagtaatttaatggtagctatgatagcagtgatcaccattgccatgagtattccttcaataagggctgacacagggaagaattatacttattgggcatatttatcaatcttggctggcaataatgcctagatgtaatcactctatgacacagttacacatgctttctgatctcagtatttaccataataaatttgctcctataattgaggcatacccccctcaaaaacctatttgtaaacaaaattgaacctggcaagaaaaaatgaatgtacttgtttaagaagattgcattgcagaacaggtagaggtgctgcacaacaattcctatggaatccttattaattggtcccctaaggggatgtttagcttgaattgcacctctcaggtacatgtgcacattgtgcagg

SEQ ID NO: 467763 - DNA, 675 bp, Homo sapiens
agattaaaaatggtgccacagtctccaaatcaggcctgggaaaatgcctacaactttgtctggtgtccttccctttcagtgtctccaagcttctctccaagttggcgccaaggctttggaggaacaaagtgctctcccttagcctggttgcatggatccccagtggaaagaaggccacactacaaggcagtttgtgatcaacattatgggaatgacccagctaagagttatcggagttctctaaagaaagaaatccctggttcctgtgggaaatacgggatgagaaaattccttggaggagaaattggattcactgtttctaaaaagaaaataggtgtagtaacccagtcctctggaaaagttcagctacatccagcatcccatgttttggactcaacacaagaagatgaaaaggccattcatgtggatttctatcagctcagatatttgcaggcacaatgaatttccagagcacatcatgtttaaggggaagcttaaaataattgcaccaaaagcattgtccaagggagctccttttcttgtagccagttccgaaaaaatgtttttcttttttgcttaagttctattctgtttaagaatcttttctctaccattaaatttagccaaattgtacccttttgtctgtgagtctttgatgttaatagcaaagaagag

SEQ ID NO: 467764 - DNA, 2951 bp, Homo sapiens
cccgggcttccagctcagcccgccccgggccaggtgatcggccgccacatcccctgcgactgaagcacctgctccgccatgaacttgccaagagctgagcgccttcgctccacaccgcagcgcagcctccgggactccgatggggaagacggtaaaatcgatgtcctgggagaggaggaagatgaagacgaggtggaagacgaggaggaggaggcgagccagcagttcctagagcagtcgctccagccggggctgcaggtggcccggtggggcggggttgcgcttccccgagagcacatcgagggcggcggcggcccgagcgacccctcagagtttggcaccgagttcagggcaccgccaaggtctgcggcggcctctgaagatgcccggcagccggcaaagcccccctactcgtacatcgcgctcatcaccatggccatcctgcaaagcccgcacaagcgcctcacgctcagcggcatctgcgccttcattagtggccgcttcccctactaccgccgcaagttccccgcctggcagaacagcatccgccacaacctctcgctgaacgactgcttcgtcaagatcccccgcgagccgggccgcccaggcaagggcaactactggagcctggaccccgcctcccaggacatgttcgacaatggcagctttctccggcgtaggaagcgtttccagcgccaccaactgaccccgggagcccacctgccccaccccttccctctacctgctgcacacgccgccctgcacaacccccgcccaggccctctgcttggggcccctgccccgccgcagccagtcccgggggcctaccccaacaccgcccccgggagacgcccttacgctctgctgcacccgcatcctcctcgctacctactgctctcggcccccgcctatgccggggcaccgaagaaagcagaaggcgcggacctggcgaccccggcacccttccccattgagagtatcatgcaaggggtcaggggagcgggtacaggggctgcgcagagtttgtcccgaccggcgtggagctactgccacatgctccagcgaccgtcaagcctgtcgacaattttgcagcaacagcagcggcatcaggaggaggtctgcgccaacggctgcgctcccaccaagggcgcggtgctgggcgggcacctgtcggccgcgtcggcgctgctgcggtatcagtcggtggcaaagggctctgggctgacatcgctgccgcccctttggccggagaggggacctcaccagtttttttagtatcgcccacgccaagttccctggccaagtccgcaaggccctcctagagccaggtgggagtggggagcgacccgcagctgctcactccaccttgcgcggcccatactgggcgtgtgcatttgaatcccgctggagagcaaacacgaacttctgttccctgcaaaatggttagaaaaaaacagctggattacgttcctctaacaaccacctgaacgtaaccttcgcagggcgtcaagtcatcttctctcgccttcggttgtggcttctgtggctttccggatttgcacatttcctggggtactatgaacgtgagtggggtattttgttctggcattaaaagaaaatcaagcaagcaaacaaaaatcacagcctccgatgccaaacatgttcccccttcttcacttccttggaactggaagtattattcctaagtctagtgcaaaatgcttctactctctgtgtcttcctgatagggatgtttaatgtaagtaggatattaatttcagaacattgatttcttatctgtgtgcctgacgtgccatctttaatgttaaaattaaggtgttaaaattaagcctagttatatagacgaaataaaatgctaagtcactacactacatcgtttattttctattacgtctcattcttccctttctaaatggaactttttaaaacctacattattttccctcaatttattttcacaattcatatttattatagatagcagaagtaatccattttaatatggcctttaaaaattccaaatatttgaggttgaaaatgtcctggcttttaaaataggaaatttactatttatgagacttctaaaagaatgaataggagggcatgtaaatatattctccatttatttttcattaccccccaacaagctggaaaaccatttgagatcaatttggaatgtagtggccaacatgtactcagggaaaataaaaggctataaatatacatatatatatatatactacattctttaagcactagaattttcaaaacttatttcctaaaaaaaaaactctgaaaagacttggccactacaaaggtttaagtgttactcggcgtcaggggacggagtggggggaaaccagacaagaacgcccatcatgaattgctccccacaaagaaaacaaatttctaggaacttggccgttttcccctgtcccgagtggggttcccgattccgtgccgctttgagggaagctgctctgtgaatgtgagaaagtttttcccccagcccccatctactccccacccccagctatgaatttcttatttcaggagggaggacaaacatggagacacacatttttacaggagtctaattggccgatttttctccggcttctcttctccatcccgtctcttggaatttcttggcatgccctacctgagatcccctacgggagatttcctcttggctcctgcggttctgaggacgttctgaaaagttcccaagccccatctttggtagctgcccagaccccagcttccaattcttccctcttctttgcacaggcagccgtcagccccatagccccaccggcgtccagaagagaccacttttagcaaatccggcagggctggggcagtctaagagttcggaaacaactgagaatagaggggtcctatgtcatgccagcttctcgctggtttac

SEQ ID NO: 467765 - DNA, 2142 bp, Homo sapiens
ttaccctgccctcccagcccagccgcacgggccttgcacacatgcctcggcatattcctgccttagggctggtgctcctgctatttcctcttcccaggtcgtgctccccatgcccttccctgccagaatgctctcgagtgagggagaaggggaggacgtcaccgtacagttacagggacattgcctatggccctccctcgggagtgtgctgtgacaggaaccacctgtcctgcatcactgctgacacaggattggacatcactgcctccgaggatggaggagagatatgtaagatcttgttgcaattcctcagtggggtccacctcatcatgaatgaaaatgccaccttgtcccacaaccatgacacctgttgccagaggggaagagcgacctgtgaacacaggccctgttcctgccaggctgtgtgggagcaagcaggggactcaggagagtgagcaaatagaatctattctaggagattccaaaaccacctgagcaatgagtcttctcccaacatgaagaagcttgaatgccttactcatcgcagcagctggcccagccctgccctgcccagcccagtgcctcaggaagagtcagcaagctctgcctgtgcctgtggttttggtcctgtcctggcttgacttgtcctggtggagggcgagacccagaagctccgctcctgggaatgacagctggcgaggaggtactggtctcagcactctgccacagcttaggccgtcagcacgagcagatgccccattagggggcctgagaactgagaacggggactgtaatctgctatttctgtccatttgttgttgacccaggtaaccaggaaatatgggaagcaggcagattctggttgtttccacaggagttgagacttaaccagacaactaactctcctgagtgttccctcttgggtgggcacaccacagttcaccccgtagtctgtggtagactcagcattagacacagtgctggtgcttaagaaaagtttccatgaacaggcagtgtgcttattgagtgccagctgtgtgcaaggtatcgtcccaggtcttagaggctggaaatactgggaaacttgaggccaattccctcctgagtgggagtccctgcttctcgttgaggagcagggaccctctgcactttggggcatgtgagcaggttaacagatgtatgtatccctaaaatatgtatattatgtatagtattgttctttatgtttaacatttacataaatggtatactgtccatgtctttctgcaacttgcattgtttttactcaccagaatctaagaggtgtgaaaaaccatgaagtaaaaaacgattcagaaaacattgctttcagtccatgtaataaatgccttattttaccttgaaatttaaggagaaactcattcttagatgctaaccacacccacccaccccatcctaagtctttgcatcccccaaaactatagctcctccagataatctctcctccatgattccaactctccttggactggccagcctggaggatggtaatgactcaccaatactgctaatgtttgcgtcattgtcccttatttattcccttccaggctcatgactcttgtctttgatatagaaaccctgtctgatgaagcatcatttcagaattttaagtcaacttacaagtgtgctattattcacatctgagcacaaatttaggactactattatttcttgagtactattatttcttgagtatttacaaagatcactattgttgtataagaactggtctcaacattaattggtagcaatacataatccactttatccaataaaaccgtttcagttttcaaaaacaaataaataaatgccttactttaagtgtacaggaagaggcacacgcttaacagaacacttatttctcccaggcttcattaaattaatgctgaataaatatttaaagaatagtaacttgaaggggccccaatgtggccctcattctttgaattgattccctaaacaaatgtgttggtttatgatcaaattcacagaactccagcccatggtaattgactggacagggtggatgcatgacccaagctgggccaatcagattctttttccccagcaaactgggggaactggactccagaggcagccagc

SEQ ID NO: 467766 - DNA, 6616 bp, Homo sapiens
gcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaagaccaaccccccaaggcgagttgaccgggatttctccttctccctcttaattgcaaagttgaaagggtggcgtggatttggggatggattgaactagtaagtgctactaggttattttaaagcacaagactgccatcacttactttttcccattatcaaaaagcaggctgtgtaatttctgtgcatgacacttatttatttatttttttttggtcccgtgtgtgggcctctgttcttgaggggtctgccgccttcattgtctgggttctcagtgagtaggtgaaggtaggggctggctgatgccatgccatttggtggactttaatcacaggcatttggaaaacatgtaactagcttttgtaaacccagtgcagtcctttttctcctccttaaacatccacactggcctttcaaagatcgaagtacattttctatagcttctgttcctgcttgcctggcaacttgtggggaagattgaggtctgcctttgagggtaaggggtggggtaaactaagtatcgccaaaaaaaatcacccattttggatgtgacttctcttagctagaaaagagttgttgttgttgttttaaattaaagttattaatatgtaacttggaaagattagaggttagccagccttttgtgaagaggctgtatgtcccgtagccttcttcactatttgtttacatttatctgacaacagttacagttgcccaaaccaagtgtgattttggcagaaagcttgaacctttaacagtgggatgaatccctctattggggcttatttatttcttgactctttcagtttaacgtgttctttttttccaccttgatcatccgatacattaagttgaagtatgtctccgtcaactctcaccgttccaagatgcttatacagtacatcatttatatttgttcgtttgaccatataatgaacaggtaaatagcaacttgtactattattattgaagttctgaatgtttccagtaaatagtgttatttgaaaaccaagggatgctgagtttttgaattattaagatgctagggcatgtgcaggtattgaaatgtgtatgtaacctttcgtgacctgatagtcctcaaaaccaagtttcccttcttcaaatagaattttgatcactggtagtagtctctcctctgaaaaaggtgatatgtacctggtgacagctcactggatgtgatgatctgaacatactcaaagagtgtatggttgtcctaatgccatttttctggttgaatgatgtcctctctagaacaggatcacattgtagtaagttttatgtaaaggaacagggcagaatgtgctttgaagattggtaaatttgcatttaaaagcagaaggaggttcttctggtttcttaaatagtaaaaagaaaatgtccagtatctctaggtgacatagcttcttttgggggtgtcattctttcaccactaagttgttaattagagcatctaacttctttcattttgcagtaatatctgtaatacagaaagatatattgggatgtttggaaatgcccctgaaagtctttctattgctaaatttcccaatattgatacagatgatctattgcatgagttttttattacttagaattttgcacatttactcatgaattgataacactagtttgtacttcttgctgaagtcttttcttcacttctatatctttttaccttgagaatttagtttttcacctcacagctccttaatgccgcccttactcaaaatttcaaaattcgtattattttgaaatttgtgcttgattgaccttgaacaatttttctatgatggatttattttcatgaggagctgtttttccttcagaattaccactcagtatttttttgaaatgtattctttaaatgatggaattactaatatttccctatgaattctagaaaaataataatgcacaagatttaatttttgtctttaactagaatgatgtatttggttaagaagatagtccaagttaaaggcatacattcaagctagtggcatattcggaagagcaggcaaagatagttggttgcaaatgggaaatttaagccatgatcttaaaaggacagaatggatattttcttttgtctcaacactgcctcagagcctgttgggcaatagaaaagaaatgtgtttaaacatatatatggctttaaacccagtgcttctgtggtgttgtgcataacaactggtgtccccttttttgccattaaaacagttttttggcctgtgtgatcctaagtctaaagaattgtgttgacagcatttgcatatccagcatcaagattcattttggaaagttttgtactaacaatgtgctgtactaatgtgcttcttccatgggctgctctacagctgtttttcccatagctaaattatgtaatcatgtttcactattggtttcttatctgtttctgttgcaagggtcacatagtaattggtcaaactcagttttgtgttttaatcttggtttttatttacatttttgaatctatctgtataactggttgctaatgagcatcctttacacaactctgctctctgtattccatgcaaggaacctttctctttttttgtgtgtgttagttttgtagttacttacaagtctaaataagagaataaattcagtaaataccgctagaggattatgagaattttagaaaaactagagcaatgtagtgtaggggaaggaaaagcaaaatgaaaggctgccacctttgtgtgtggaaagcatgttagaggctctccattcacctgacaaaaccgtcctcacaaaagattgggccaccaagttgtctatgctgaggtgcatttgaagaatttgtaaccagttactgtttcattgtttttcttttagctttataacagttgcattccagtattgcagagcatgctatttacagctgctagggacttagccagcctcttttctagctttttcttagtaacagaaacagtgaaaaattggaagtaaatatctaacacttcaaggcaaggagtggaggagaaagagttaagaaaattataaatgtgaactatttccaaccattcagtgataatcttgaaagccacatagcaatatgggaaaatttgcactgattatttgcacggaatatagacatgcaaaaaaatatatatatgtatacactggaaggtaacgtggaaaaaatgaaaatagttgatgtattagggtggggtgatcatagccagtctttgtgaaaatctccttgttaactttgtacatgatatacctggaaaaaattcaaatctgctaagaacattatgaatcctgatcttgtgaaaactaaccattgctcgtattaaggaactcattccatttctcttgaggaacattttactgctgaaacagttggttcttttttaaaattttaaaaattgagatataattcacatatcttaaaactcacccttttaaagtatgtgatttgatgctttttgtcactggcaactaatttactgtctgtatggattagcttattctggacatttcatataacatgtaaatgaaatgtggccttttgtggctggcttctttcatttaacatgttttcaaggttcatccatgttgtagcatgtatcagtatttcattcctttttacggccaaatattcagttttatagatataccacatgttgtttatccactcatcagttgatgggcatttcgattgtttccactttttgcctattaataatgattctatgaacattggtgtgcatgttgcattcttgacaaatcccattctagtctgaagatagttcagtggtctcatagagtaggactgtgatttagtttgggcatgttattggggtgagttctgagcaacttaaaagtgtgtgagtcacaactaccttccttccattggtctgtactgggcttctgcctcagtgcccctgcttggaaaaaaacgcacaaaaaaagtcaagagtactcattaccaactactactgtatggaatccagagccttccagagtttgtagagctcttcatactctggctctagcccttgtttttattttctgtctaaaatggctaatctcataactgcatgtcatatatgtgtataatatatgtatattcatatgtatgtctgtatgtctgtgtgttgtatatatatgtgtttatgtctgtacacattgtctgtagttaacacacctctgctcatgttctcatcctaaagagtacttagttctgttcgtctaaaactctgctcagcctttaatacctagttacaattccattgttttcttgaaatctatgctgacttctgaacttctataccccttatacctaagggatccccacactgaagcagagctccaggctctctcctctctctgcctgcttctgtgcttccctttggcttgttccattctcccttcccttgttgttttctcctaagcattacatgagcttagctagttgctcagaggaggcctttacctacctgcaggctatgttaggtaccctcttctgtgttattgtaagactctatgtatccatgtttatcttttctttttttccctttggggtcatgaaagggcgaaatgaaataatccatgtgaagagctcagcacagtgcctgacgcatgctacgtgcccaggaaaagtagtttttgaaaaacgctgattttctatttgcactttattgaaaacttggtggatgctttgaatactgagaatttcattaccactttttcagttctaatgtgcatactgttgtacactggtacctactgtgcagatcatgactgaaaggtgtttgaaaggacagtattgtgaaatcttttgtcattacgttaatgttattgcaataaaataacaaatttttaactattaaaagtaatgccatctgtttttcttcatctgtgttttcaccacaaagagataaaactactgttgacattttgacatatcttttttcctccagtgc

SEQ ID NO: 467767 - DNA, 695 bp, Homo sapiens
agggcctggaatggcccaagtggagcctaggctaatggaaacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggttaatctggaattaacgtcattcataataactctttttgctgttagcaactacacacaacaaatcacatagattattcttcaaatattttttgtttaatcatacaagtacagaaatcacgttcaatgctgagcacaagcaaatttgacaactgaatataaaatctgcaagtggaaaagacagtggaacttaaccagacataaggaaatacagctccttatacttcaactaaacccaaatttcaaccagcataaaattccaagagaaggaaaggctttctggcaaaaatcttggttaagatgaagactcagctgtgacaaagaccctattttttttttcccctgaagaactgtttagtcctgaccatttttacctg

SEQ ID NO: 467768 - DNA, 1145 bp, Homo sapiens
agtgtggactccaatcattggaaagactgggaagatggttcagatgaagccatgtctgattttgattatttctctgagatgatgaaccacatgggtggtgaagaggatgtagatttagcagatggagcagatgatcattcacaagacagtgatgatgaaaaaatgccagatctggagaaagaattccagggcaagctggtggtggtagccagcaagcagcagcgcacagagcagaagagctggaggcccagagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattac

SEQ ID NO: 467769 - DNA, 1823 bp, Homo sapiens
atcgctgccaaaaccacatgggctggagggccagggctgcatggacagtcacaccactgcacaccagcctgagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcagtgagtgccaggctggcccctggggctggggctggatcccacaggagctgctggagggagaggagggttgggcaggggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaggtccctgagtag

SEQ ID NO: 467770 - DNA, 651 bp, Homo sapiens
aacaaagaccttgctgacatgttgtggttctaaggcccagggtcagtgcatgggtatcaggtcagttgagggtgatgggtccaaccactctcctcacctccacagggagaagacttcgatggccaatctttcccaaggaggcttggctgataaagagcagaagcaaaagggtagcagtcaactcaaggaagacttcctggtgagggagttggtaagctctgaggcgggtctggaaggatgccttggatttgcagatgctgggatgcaagagaagagagagtggctatggcccactggaactggggagttcactgagatactgaccagcagggaattacccagtggaaattggcaaaactctggagggttggtgccagtggttttcctgaacactgctggcagcccttcccatgggtgcaagaaagtccttcaagatctaagatccaagctccttccagtctgccactccactctccctcagttgaggtccttgtcctcatggtcaagacggtatgcagagctcaaatcatcacgggcatggtttggatatggaaggggtggaaaagtaaaagagacaaagaatgtgtgagaaccagcttcttgggagctgccatttgtcacttgtgcttcatctcattggacagaacttag

SEQ ID NO: 467771 - DNA, 4044 bp, Homo sapiens
ggtggcagtaattataggaggactcagactccttgaattctcccaactcattggcctctccctgggctacactgatgctaagagtggccagaagagggcgatgataaggacaacctgggggaaaagggtctgccaagatctcttcctggttgaaagcaaccagaagctggaggaaacccgaggggaaactggaggatgccgtccacagaagcacgcttcctggacacagagcagagtggagagggtgaagaataagtgtacaaagtataaccataaattcacccacttatgtgtttccttcccagctgtcttttggggagacattgccttagatgaagatgacttgaagctgtttcacattgacaaagccagagactggaccaagcagacagtgggggcaacaggacacagcacagcccgagaggaaatgatattgctgcaactggatgaatacccagagggccaggagctggcagcgaacacccggcagctgcagggagtgtgtgggcttgaagagcaggcatctgagagcagcccagacaccacagccatggacactggcaccaaggaagctggaaaggaagcactgaagtctgtggacgtgagcggggctggcgtgctgctggcgaaagggatggaagggcggcatttggtggtcaggaacagcatagctctcagataaactctgctctcttggctggacttttctgccttgtgcatggatccagtagggagaactcattatcagtgtttttaacaagtaagctgtggcttattgatatttaatttgtactcctctgactgctggtgccgttgaacattttttcctatgtttgtcagtgggaatcgcctcttcctgtcctgtgcccattttcctattgggttgctgatcttcctcttcaatctgacttcttttagagagaggcagatcctttagtcacccatgtaactaatctgcatttgtttcttagctatacagcttgttgtttgggctatgtgcagggcttgctttcagatccgcgtttttctgctttgcttatttaaggatattttgacttataagtttttgggctccccagacatctggtactcaatggtccttcactttgccacaaatgatcagcacttagtggtaaaaatggagcatgtgtgaatgaatccagcagagtttgtcatcacactgcagtgacaaagatgccacactcatttttcttccttatttatgtgatttattgttgcataaagaccacacccaaacttagtgacttcaaacaatagtttgttattttcatgattctgggggttgactgggttcagtagggtggttctttggctgatgccatctggggtcactcacttgactgaatttatctagcaggtggactgggctggaaggtccaaaaaaactttagctacacctccagtgccccagtgtgcctccttgtggccctgctctccatgcagactgtcaccattcagttgtctaatcagaaacttttcatagcatggtgattggcttcccagagggaaggaacagaagttgccagtccatttaaggcctggactcaaaacttcaagaatgctacttctgctacgttctgttaacaaaataagccaaacgaccagaccagattcaaggagagagaaatagattctactccttcacgagagaagtggcatgacctcacagggataaggggacttggcggccatatttggagactatctaccaccttccccccttgcctctgctccccagcaatagatattgtcagagtttttgatatttactagttcgttgggtgtaaaatgacccaactataaacttggacagtcagacacacttgggtttgaatcccagctcacccacttagtagctatgactttggataagttatttaactgcttgtatgaggtttagagggaattagaaataatatttatgtaaagcacatagccaggtgtctggaacttaaaagaggctcaaggaatgtagctcttccacctccacctccaggaattatattatccagcattgaaagtgcatcatctacctctggactgggattccacagctgtgcaacagctgcatagaaacacaattacagaggacaggaaggaagacggcggctgtggcccattaaaattctgcctctggtggggttgtgcacagcacccacactgcaacaaaaaatcttgggcttttcagggagggtgatgatagcagtgccctagtctgcagttcccccaaatggccctggtttgttcgaagcggataaggaatgtgcaggctaggccagtcccttcactctgcattacagcagcagacaagcatgtctttaagcatccagggcagtcctgaagaggaaggaaatctcgaagtgaggtgagggcaggccgttctaaccagtccctccatccttcccatcccaaccctcaggatgctgtcggcgccagcgctggatgcctcttgcttttatttgaatgaaagataagacacgttgtgtcaatctcaggttccctttaatcacaacttgccccccttccaccacccccaggaaaagagaccgcccaggcaggagaaaggatctgagggaagcgcccagtttcggcagcaggtttatttcctggcattatgtggctcccctcagccctgacggtggggatttgtgcctccagctttggggagggggaaagggctgaaatgctcactcaacatcccctccggcagaccctttggtcagaaggctctccctcctctggagatgagagctcagcatgcatttcagggctgataatgggattaatgaaatggagtgtgcaactgctccatgaatgaagctgtgactgttttgatagagcctgatttccagaaccatattcatgaaagagaatggacctttcactttcagtaacatttcctaggggctttgtgtgaaagcaaataataatggaatctggttgaaccagaggacaggcatcccacaaacttgggtgcaaaacagcactcgacgctggaattcctaacatcacttacgtcagtttacttgggtgtaacaactgagccccacgaacttcaggccttcctttttagcctgtctcaaatgcagactttcgtagccattgtggcagctcacactgagcccttactcaccgcaggcatttgacattcattacctgggtcaccaccgccctgcagcaggaagtgaggctccgaaggggaagtgatttgtccaaagccatgtaggtagcaaatggcagcatttatcttgagcttaagtccccctgaccccaaaccccttgatcttaacctttgggctgtatcagtggttcccaaacttcactgagctttgtaatcacctggggagctttagaaactgcaggtgccttgactccactctaaggccaattgattctcagtctcagagcagggaggcagacaccagaattttttaaaagctccccagttgaatctaatgtgcagccaggtttgagaaccactgtgcagaatggtctagtctcccctttacttagcggccttcagcctttcgagattgctgcaggtgaggtgcaaattcacccatcacctttggggtgagggttatgcagatggctgggctgtcagcgtgtttacttcccgtgtgggaatgaccaattgcctaatctaaaaattgcacttcctcactggagaaggctgcctcaggcctggttctgtttatgacatggctgtgccttcagctggaaatagaagattgaaaagcaacaaccgctttgctctttcagagaggacagggctcgctcccagagccagagaatttaaatgggctttatcccccctcaaccctacccccagcgtgttaaatcctgtcagacgccctgagctcctcttcaaatgcaggactcttggccataataaataattacatccttctatttggactccgattccagatagtagtaatccaagaaaatccaataatgacagttgcattaagatccttcttccaggctaagcagaacatctgtttagacatatttttaatc

SEQ ID NO: 467772 - DNA, 1640 bp, Homo sapiens
gtgactcttctccttttcattaaaaatggcccagcagggactccagcaccttgcaggtggaggggtagagtatggtatggactttatgtcagagagagaccgtatcttttgttggcttttcaagaagattcataaccacaaaaagctcaagaaccatttttggagggaatttctgcattgggtcattgggtgggaagtgcctgacttggttttcaaagggcttaacacagtgttgtgtcacaggtcaggagtataatttcttaaaaatggaagctggggaagtgagctctctgggagagacatacgactttgacagcatcatgcactacgcccggaacaccttctcaagaggagttttcttagacaccatccttccccgtcaagatgacaatggcgtcaggccaaccattggccagcgcgtgcggctcagtcagggagacatagctcaagcccggaagctgtacaaatgcccaggtcctacttgtgcttttgttagccagaaaacatcaatctgcttgctacacttctcaccaacctgttccgagggctttggctggcaaagggcgtgtggggagaccctgcaggacacaacgggaaacttttctgcacctggtttcccaaatgggtacccatcttactcccactgcgtctggaggatctcggtcaccccaggggaaaagggtggtatgttttcaaccctactgcagggcacgtactgttatatccattatctggataaggaatttgaggcttgaacattaaggaaagtgccaaaagtcaaggtctaggttaggggatacccccagtgtccccagagctctctataattatacctgttatagcatgtctcacggtatagtcactactggtttatttgacccccttctaaatcttaagctcattaagatcgtattaaacttcacatccatggatttgtttaaaagccgactgtgctggtatgattacgtggaggtccgggatggttactggagaaaagccccccttttgggtaagttgactttagacaccgttaagagaggagtgatgggatgttccccgggatgctgttaatgtctggaaggtccaccttgacagcggtcacaggaaactctcaagggcctctgtcattgtaaaactctgagcactccatttggccacacatgttaaaagcttttaaaactgcgaataccctttgacccagcaattccactttttggaattcatcctagggaactaattaaggaagtgtgcaaagctctagctacagggatgttcactgaagcaggaaaaattgcaagcaatttaaatgttcaacagtagggtttggctgaataaattatgatccatctttttaatggaaaacttcccagccattaaaaatgaagttgtagttgactactgatatggaaaggtgttcatggtacactgttacacacaaaaaagtatgtgacaaaaatagaataagcagtaggattccattttgattaaaaaatacatttatgcattttatatatatatatataatgcaggcattgcaaatgtagatggcttcaaggataacatgtaaatgaaggagatgggatttgtgtaataaaataaggagtggtggggggagtgtggtgaactgaacaccaaatatc

SEQ ID NO: 467773 - DNA, 893 bp, Homo sapiens
ggaggccgacagatctcggcggggacacagatccgaagcgcatcaccaactatggtttccggctggctggaatctcatgaattctggagatcctggcctgatgtgaacacggtgtttgatgaatgaagataataagagctccctgaatggcagcgtctttttttggctggcaaattactcagaaaacccccctaaattgcacacttgtttgagtaagagtcaggtcccgtgtggcaatgatgtaacatacctatttttggcagacttggcaattcagggagtgacccattttcctgtgcttcgtggaggtcattgcaatgggtttcatcaaccagcaggcttggaaatgagccataggaatgatggccatggagacgggtggagcagtggaacacatgttcttcacccgactcccgcgggggacattggctgcatcacaggaagtagaagtgtttttgtttgtttgcttagtttttgtcgtggtaaatgcaaccttgagtttctaggtgtccacaggacctttggaagattcatgacagcaacaaggtgttgtgaagctcctgctctggtgaggccccagctcccatcagaggatcagaaggttcccaagtaccccaggacaagaagtgagctgtgtggaaaagcccctgtaaagggttgtggtaaggattcactgagatacagtgtggattcactgagtacaggaaggattgggcttctccagcccctgagcacacctccctataatccttcatcatcttataaggtgacagtccacaactgcttggggactacagagcttgtgttttcattgcctttgttccaggatgatttgtgacttctcaggtggaactgctggtgataaaactaacatttcaaaattttgcaactgc

SEQ ID NO: 467774 - DNA, 605 bp, Homo sapiens
aggcacagccagcctgaagcagagatgcccttctacaaaatcacgaaagaaaggctcgcaaggccgtcacagggctgcgaggggggtttctgcatcgttccccaaacagttggcctaaaaccaaagtcaagaatggacttggccagtgtagaaatggctaagcagtttacctcatgggtcttgcagagcctccctcctgtggatctctccctgtgtcactggcataaaagaaaacagcccttccctatccatagaccactgtcagattctccagatacactgggcaactgtgcaggcactgctgctcccaggacaggaggactgacactgacattcacagaaacagacagcgtttctgggaatgggcagaaggggacaaaagcaggagcccaaggatctccagagagagtctgtgaccttgggatagttattttacctccttggcctccattttgtcgtcagtggaatggaattgataattgtgaaagtgctttctaacacaagccagtaagaactgtgtacatatttactgtttttattgctagcggtcaatgatcaccaaaaaaaaaaaaaaagaaaaaaaagaaaactggataggttcactg

SEQ ID NO: 467775 - DNA, 596 bp, Homo sapiens
ggggcagccgcagcaggattttaagtaagggatgacatggatgtcaatgagcaggtacagctgctcacaggcaatgggaactgaatttcactgctctctggaggtggttttcagaacatgcttcacatttgtaaggggcactgggccaggttgtggtaagaatatcataaaaacatttgatctcatccatcagagagcaaggggctgcaaggagtggggacaagtgggctatctaacccagatgaagactcgcagtgctgaaattccaggcattgaacctggcccaaatgcaaatgaggcaaagcaaaacaaaacaaaaacaatgatagagaaaggacagagatatagatcaattggacagaatatagggtgcagaaacagacccgcgcatacatggttgattgatttttttgacaaaggtgcaaaggcaattccatggtgagaggatggtctccttaatgaatggtgctagagcaattcaatatccatgtactaaaaatgaagcttaatccaggcctcacattccatacaaaactgactcaaaacaaattacagatctaaatataaaatatacaatgataaggctgttaaaagac

SEQ ID NO: 467776 - DNA, 563 bp, Homo sapiens
tcccagactccatgtggctgcccccatcacatcataccaaatgtagcagccttggtgggaacaggagcttcctggatccttggaaaaaccagctgagcaagctcccttctctctggtgttcacagaggttatttagcaaggaagtgtgggactcttgtcgatatctgggcaaagattcttctggatacagcaaaagcaaagtacaaagctctgatccgcaagcaaaccagggtgcctggagcacagtggtaaaggggagatggcagaagatgagggcgggaacgtgtgggaccagaccgagaactgaaggtccctctggataccatgaggagagaagggggcaggagtggaagcagagagagcagcgaggaggtgagtgcaatcatccaggtccttggtccagtgagagtgggaaggtggaggatgtagaaggggcactgaggatggctgactgtgagttccgggggtgaaatagagcagcgtcgggggctgaagaggggagggagggggatggtgtcagccagggcaggtacgggaccactaggcagatgcatgagggagag

SEQ ID NO: 467777 - DNA, 603 bp, Homo sapiens
agtttccaccatgggtacagctgccccttgtccagaggtgtccacagccactcagctcattgcctttgatggaggaagaagaggtaaatttcaagaactccggactcccaaactcctcctgggcacctctaacccgacacatcccaaagcaagcgcccctcctgccatctcccgactagtgccagacacgggagtgttatctctaaggagtgacccgatgcacaggcacctggtggctactaatgcatgcttgcaggatgacagtgcagccaatcgaggtgctgacccagacccctctccccacagactgagagccaataagacgtgctgggtggaggctggcgagggccagcagccttcagggacgatgcccttttccgggatgcccctgccccagctgctcttgatgcacccactctgtgatgatgtggggtcctggcctctctctccagctgggctgtgtgttcttcaagcgtgaggcttgttgaagggatgttaggtgaggtaccggttggtcttccttattccctgaaatgcaggtgggagaagctagtggcagcccagtgggccagccctctgccacctttccctcccttctcagca

SEQ ID NO: 467778 - DNA, 1294 bp, Homo sapiens
tatggttaccaagggctcagaatccgcacccccctcccaccgggatgaggattagggtcatgccatcagctcctcttgccctgcatgcttcagggacgatggaggtctcggggcacccccaggccaggagatgctgcccagaggccctgggaaagctcttccctggcctctgcttcctctgctttctggtgacctacgccctggtgggtgctgtggtcttctctgccattgaggacggccaggtcctggtggcagcagatgatggagagtttgagaagttcttggaggagctctgcagaatcttgaactgcagtgaaacagtggtggaagacagaaaacaggatctccaggggcatctgcagaaggtgaagcctcagtggtttaacaggaccacacactggtccttcctgagctcgctctttttctgctgcacggtgttcagcaccgtgggctatggctacatctaccccgtcaccaggcttggcaagtacttgtgcatgctctatgctctctttggtatccccctgatgttcctcgttctcacggacacaggcgacatcctggcaaccatcttatctacatcttataatcggttccgaaaattccctttctttacccgccccctcctctccaagtggtgccccaaatctctcttcaagaaaaaaccggaccccaagcccgcagatgaagctgtccctcagatcatcatcagtgctgaagagcttccaggccccaaacttggcacatgtccttcacgcccaagctgcagcatggagctgtttgagagatctcatgcgctagagaaacagaacacactgcaactgcccccacaagccatggagaggagtaactcgtgtcccgaactggtgttgggaagactctcatactccatcatcagcaacctggatgaagttggacagcaggtggagaggttggacatccccctccccatcattgcccttattgtttttgcctacatttcctgtgcagctgccatcctccccttctgggagacacagttggatttcgagaatgccttctatttctgctttgtcacactcaccaccattgggtttggggatactgttttagaacaccctaacttcttcctgttcttctccatttatatcatcgttggaatggagattgtgttcattgctttcaacaaccttatggatgtccctgcttttcttgaaatatgagaaacaaaacacctttattcttggaagttgtacttttagttaaattaaaatcttcctgagctgttctttgttacctgaaaaagaactagtgc

SEQ ID NO: 467779 - DNA, 570 bp, Homo sapiens
ggattcattgatagaggagatgacactaagtccatatgacatttgggttgtttctactttttggcaattgtgaacaatactgctatgaacattcatatacaagtatttgagttcctgttctcaattcttgtggatggggttcctggggcctctgggcaccaggtgtctaggaacaacagctcccagaaaatgctcttcttatggtgcataacagaagcccgaggggctaaaccaatccatgcaaacacattcaaaaccttggctgccatcacggctatttcactggctaaaacaagtcacccttttaaggaccatgaatcaataagtggcataaattattcacctcgcggaacattctcagaaatggacagcaggctggagaaatcgccagcaggagatgtgttcttgcagtgtttgggcctctgctcaccttctgaatggctggaactttctattaaaaattcagatttcagagaagaatgaatctaagctgttcagagatttcaatgagactccatgtttccttttcagacgcaactaactggtctacggggcctcttctgcagggtc

SEQ ID NO: 467780 - DNA, 810 bp, Homo sapiens
gactcagcaacatggcggcatccggcacgaaccgtagtgaaaggggcctgttcctgttgtaccctccccagagtaacccaggcctttcctttctcttgccaacatgctaccactcagctgttgtccctgcatggctgcaaggagccagcagctacatcatcgacctccccaagggttgggagttggtgggtgaagtccattcaggtgctcacagcaacctcaggtggcttggagggggacggagcagaccatcttcctctgggtcacctagggactggctctccatgttctccgacacgtaccaaagtgggcctgcaaatctgtgttcttctggaatctcagcttcactggtagctgtgaacgtgccttgggagagtcacagaactccgctgctcctgtctgtgatgggtgtcattgatcctacctgagatgttggtggaagggctgatcgaaagaacccccccgccccacctttgttttagatgtggtaaaattcatcagattaaccattgtaaccatttttaagcctgcaattcagtggcattagaacttactcatgtaaccaaacaccacctgtacaccaataacttatggaaaaaaaatattccggcagattgaactttgaccctcccacagccccttgctgaggttgagtttcttgaaatctttacaagaaagaagctgtgactggggctgaaacaggtcaaagtgaagatggtaagtaaaaggccacccttacaccaccaaactgcctgggcttaaaaagggttccaataaaaatctctaaaccaagtaatttcagtcttttgc

SEQ ID NO: 467781 - DNA, 682 bp, Homo sapiens
ctgccccttgagggggtttgttgaccaacatcatttgttgaaagaagatgcttatattacagaagtggttttccagaatgttcctgagtgggtgattggacagtccagagaaggagccaagttgcgggtcagactctagaattccatgctggaggagtttggggggcagtctgattggaaaggaaaagagggaaatttggaaaacatgacacggagaagagaacatcatgtgtacgtggaagcagagattgaagtgaagctgccgcaagccaaggaagtcagactgctagcaccaacagctaggagagtgacatggaacagcaatgttatcatcccaagggcatggccagaatttcgtggcatcagtgatgctgtagctcacgcctccgaacttgcttcacacagtcccagagtaacttctacaccccgccagctttctggtgctccatgttttgtgggccagacaccaactggacacccagatctggcctcctgcttgctgggctgtggcagcgggatcactctggggcccagggagaggtaacgaaggaacaaggagcctgccttccctgtcttgagtttgtgttttcctccttctctggcacttggcccagtttggccctaataacctttgagggaccttcatagctgacccccagcctctttctgctcacagctgccc

SEQ ID NO: 467782 - DNA, 634 bp, Homo sapiens
agggggcagcacccaacctatgctcaggcaactggcgctttctcctgggactttcaatcctgagcgtgaccggaaaaggaatctcctccagaaccttggtgaactaattaacccacagtttgctgtttatgatggaaagaattttgaggtcttacctaatcccaaaggtgtttatggcttcaaggaagttgctggtatcagcaatatctcaacccgaggctgccacgtagacatcacctcacctgccagtcctgctcggttgacagtggctttgtggggcactgtgttgaggaggattctgaaaccaaaactcattaacaaagtcagccagtgggagacagttggcagagcccctactaactttcagggggttgggaagatatatgttgatatggtttcgttctgtgtccccacccgaatctcatattgaattgtaatccccatgtgtccagtaggggcctggtgagaggtggttggatcatggcggcagatttcccccttgctgttttagtgctagcgagtgcgttctcatgagatctgatggtttaaaagtgtgtggctttttttgctctctctctctcctctctctctcctgctccaccatggagtgtgaaaatggactaatacatatatt

SEQ ID NO: 467783 - DNA, 552 bp, Homo sapiens
acctacatcatgggggagtgaccgatgcaggagggggcagagggagaagctgagctgcaatgcagtcccaacaaatgtctcagccaccctccaagtgatctagagctgggatggccatcagagttgagtgagggctgggttgtaatacacccccatcctcattttctggagaggcagcgtgacctaacgacgaaagcctccacaactggtttctgtcggtgtgagtcccaaatctgccactggctggctgggaaaccttggtcacatctccagacattgccaaacgtcccttggaggacaaagtcgcccccagttgagaaccacttctctagagtgatagctccaaaatgcatgagcagtcctatctctcccctcgctggtcctatctctgccctcgctgggacgtggcagttcaactcttgtacccggagcaggaaacagcagtatgatgctgttgggtgtggctggagggctggaggggcataagggccagcccatgcttggcagaccacacttaagtctgcagaccagggggtggttactctcgggacc

SEQ ID NO: 467784 - DNA, 974 bp, Homo sapiens
cgcttcctgccttgtgaggagcctagcaacacctagtaccgcctagcacaacccagcacagcccagcacagcacagcacagcacagcacagcacagcacagcacagcacagcccaggccagcccagcacagcccagcagagcacagcataaacattgattgcgcgaggactccagggcaggatcctgtaacacatccgggctgtattctagaatggttgagtggccttctcagaagggctggcagacctcagatgggcagatttcagataagcagatcttgatgggcaaccctcagctgggctggcagacgggcagacctccatgggtagctttcagatgggcagacctcactgagcagctctcagatgggcagacctcaatgggtagagctcagatgggaagattccagccaccaggatggcctttttcaagatctggcattttgcgggctatggatattaaaagaagatctagtgcgggcagcaccggccaagtgccagtcaatacatttgttgaggacacggagttcagatcaaaattacaaccttccttccccctccattcctcctcatgtagctccatccacacagtcatccaagtcagccacctggacatcttcttcagctcccctccgccctctgccccagagccatcgggcatcaagtcctgcctacctatccgcctctcagtgacttcccctctccctagccctcattgccctggattaggttcccagcatctctctcctggacttgggcgttgaaaatgttctaaagttagattgtagtaatggtgacacgactctgaatatattaaaaactaatgaactgtacactttaaatgggtgaattttaagtctactaccattgatgggcatttaggttgattccatgtctttgccattgtgaatagtgttgtgatgaacatacatatgcctgtgcctttgtggtagaacaatttctatccctttggg

SEQ ID NO: 467785 - DNA, 806 bp, Homo sapiens
aaaagtttccggatgatgtcggtgctgtggttcaggagctgctgttggagaaccactgatataaaacatgagggggtctttgttaccctttcttcattatatggtttctcctctgagtctctctgctgctttggtgcttcagaacataagaaaggccaaaaccttgttgctatgaaaaaggctatttcttggataccacttatttctgctttaagtggcattaagtcctgctcaaggcctgggggtgtacaagaagaaaggaagggagagaacagcaaaaattatgaaatggacatagatgaagctagaaaccatgatcctcagccaactaacacaggaacagaaaaccaaacactgcatgttctcactcataagtgggaattgaacaatgagaacacatggacggagggaggggaacatcacacactggggcctgtcgaagggtagggggctaggggaaggtgagcattagaacaaatacctaatgcatgtggggcttaaaacatagatgacaggttgataggtgcagcaaaccatagcacatgtatacctatgtaacctgcatggtcagcacatgtatcccagaacttaaagtaaaatttaaaacaataatacattttaaaaaataggtgacactggttttaataatacattttatttaacaaaatatatccaaaatattgtcatttcaacatgcaataaatgtaaaacatattgagttatctttcatttgaagtctgtgaaatcttgtgtgtaattcggacttacaacacatttcattcggactagccacatttcaaatgctc

SEQ ID NO: 467786 - DNA, 994 bp, Homo sapiens
attgattgaatgaaggaatcctctccatctggttcaaagtctcagtggtattctggtgcttatgatgccttggtttctgatgaagaattgaaaagaagagtagctgaggagctaacattggaacaagccaagaaacaaactgaagatcagaaacgactaaagcaagccacagagctggagagagagagggctgctgccaatgggcagttaaccagagccatccctcgagagagggtatcaagccaagaggaaggcactaaggcaatgcaccttgctaggcggctggaagagaaaggccgagtgctaaagaagcaggttgcattctgcaaagtggagctggctagactggaggagaggagctcagagttctacaaagtcaccactgaacaatatcagaaaattgctgaagacgtggaagcacggttcaagtgtatgagtctcatccagtctatgctgacctccaggccaaaattcttcagtgttactacgagaacacccaccagaccttcaaatgctccactctggccagccggtatatgcactacgtcaatcatgccaaacagagcatgcttgagaaaaaagtatcaacaacttttagaacaagcaaaacaccttcaacgttaatttcagagagggaatattttttttcctagtaagaaaataacccatttaaagagacgagcactaatgagaagaccactcaaaagagacagcggacaatggatccaacagaatcataccacatttccattggcagcaatttgaagggcggccaaaacctagatcaggatcagtcatcaaaggatgctcttcagtattagtaaacccctcttacgatgattaagagaagggcagccctctccaccttttggtactttctattcaaattctactgaacataaaatgtttatcttctaagcaagccccatcatttggtgaacctccaccctaacaaagtgtgatgggcagtgtgtaattaacctgtggaacccac

SEQ ID NO: 467787 - DNA, 531 bp, Homo sapiens
ctcccgccgaatgactggcaatacccagcataccccataaaaaacctacaggatgagcaggaaagtcaaatcagctgggtccctgctcaagttcctgctggcgtatgtgagcgtagatgtatccttcctgatgaatatcagttttatattcctgaggagtggaggaaatgaggaagtgaagaaggaaggaatgggaagaggggggagggaagaagggagagaagagggagaaatggaaagagagcgacgaataaagagaggaaggaaggaagaaagaagagagagaaagagaaaaaaggagaaaaagagaaaggaaagaaagagaaagaaaagaaagaaagaaagaaagaaagaaagaaagaaagaaagagaaagaaagaaagaaagaaagaaagaaagaaagaaagaaagaaagaaagaaagaaagaaaaagagggagagggagagggaaggaaggaaggaaagaaggaggcagggaggaagggaggaaggaagaaagaaaggagaaagaatgaaagagaaagaatgaac

SEQ ID NO: 467788 - DNA, 1125 bp, Homo sapiens
aacaagtttgcctccttcatcaacaaggtacggttcctggagcagcagaacaagatgcgggagaccaagtggagtctcctgcaggagcagaagatggctcagagcaacatgtacatgttggagagctacatcaacaaccttaggcggcagctggagactctaggccaggagaagctgaagctggaggcggagcttggcaacatgcaggggctggtggaggacttcaagaacaagtatgaggatgagatcaataagggtacagagctggagaatgaatttgtcctcatcaagaaggatgtggatgaagcttacataaacaaggtagagctggagtctcgcctggaagggctgactgagatcaacttcctcaggcagctgtatgaagaggagatccgggatctgcagtcccagatttcggacacgtctgtagctctgtccatggacaacagccactccctagacatggaaagcatcatcgccgaggtcaagatgcagtacgaggagatcgccaaccacagccgggctgaggctgagaacatggaccaaatcaagtataaggagctgcagaccctgcctgggaagcacgaggatcacctgcggagtacaaagactgagatctccgagatgaaccggaacatcagccggtcccaggcggagattgagggcctcaaaggccagaaggcttccctggaggccgccatcgcaaatgcggagcagcgtggggagctggccgttaaggaggccaacaccaaggtgtctgagctggaggccgccctgcagcgggtcaagcaggacatggcgcggcagcggcgtgagtaccaggagctgatgaacgaacgtcaggctggccctggacatcgagatcgccacctacaggaagctgctggagggcgaggagagccggttggagtctgggatgcagaaggtgatctgagctcagcctgcgggggcctcacaagccccggcctcagctacgccatgggctgcagctttggctctggcgcgggctccaactccttcagccgcaccagctccccgagggccgtggttgtgaggaagatcgagacccgcgatgggaagctggtgtccgagtcctctgacgtcctgcccaagtgaaaggctgtg

SEQ ID NO: 467789 - DNA, 1182 bp, Homo sapiens
gtcctatgagagatgaacaatgagtacacacattcgaaaataccggggcacagaggcccttctcatggagaggcagctcctacctctacttcccccgctggccagccccagctgctgctgggagccagaagccactgccatcagaatccctggggaggggcttagcaaccagcccacagcggacgggccagggggccagtgccggcctggggacaccatgggagatggcatggccaggagctgctctcaggggccctggaacaggccagggggcaagacgggagggagccggcccaagactgcactgggcctggtgtgcagcaggagccagcggaacgaccacccctgcttctgggccactcgcaagaagagaggctccgaggacacaggaagctcagctctccatcagagacgccaaacagggcggcggtggctgggatttggggaggggtcctcggagcactccagggcccaggcaggaagcagcggccaggacacagccgtgggcaagaggcttggagggtccggtgggagtgaaactgtcctcgctgggacacagcaagaaggttgaaggtatggtggggtggggctgtcctcgccggccctttcccggccccggggtgagttgaataaaagctcagatttgaaggcttttctgcattgcctcccttaatgggcttaatgtctcggctgagctctaatgccagtcattttacctcccacgcatagatttcagaaaagaaagcttacaatgaccctagtccgctttagcagagaaaataaaatagtagaaaaataatagtaaaaatgactgtgtaacgttcgtcacctttatttttgtatctgtaaatgcaaggatgcttacagttttttttgcttacagtttttttctcccctatctgcctgaatttttaacaatgcaagagattaggattaatttccaaatagcgcaacctttttggaaatgcacattctccacaaatgaacaaactgcttgtggtaattaaagtaatgtcctgtgctcaaattgcttgtgctaatgaggctaattgacagcagcgagtattaaccgcaattagtcatacatatctaatagcatcgctggtgcctatgattttctacgtggaggggattttacatctgctttcaggatttccatccttggctatatgcatttctctc

SEQ ID NO: 467790 - DNA, 2279 bp, Homo sapiens
tttgtagctataaaggtgaccctggaggcagatctgggctgagtgagtcacaggagtgggggaagggatgaaccagactttgaatagcagtgggaccgtggagtcagccctaaactattccagagggagcacagtgcacacggcctacctggtgctgagctccctggccatgttcacctgcctgtgcgggatggcaggcaacagcatggtgatctggctgctgggctttcgaatgcacaggaaccccttctgcatctatatcctcaacctggcggcagccgacctcctcttcctcttcagcatggcttccacgctcagcctggaaacccagcccctggtcaataccactgacaaggtccacgagctgatgaagagactgatgtactttgcctacacagtgggcctgagcctgctgacggccatcagcacccagcgctgtctctctgtcctcttccctatctggttcaagtgtcaccggcccaggcacctgtcagcctgggtgtgtggcctgctgtggacactctgtctcctgatgaacgggttgacctcttccttctgcagcaagttcttgaaattcaatgaagatcggtgcttcagggtggacatggtccaggccgccctcatcatgggggtcttaaccccagtgatgactctgtccagcctgaccctctttgtctgggtgcggaggagctcccagcagtggcggcggcagcccacacggctgttcgtggtggtcctggcctctgtcctggtgttcctcatctgttccctgcctctgagcatctactggtttgtgctctactggttgagcctgccgcccgagatgcaggtcctgtgcttcagcttgtcacgcctctcctcgtccgtaagcagcagcgccaaccccgtcatctacttcctggtgggcagccggaggagccacaggctgcccaccaggtccctggggactgtgctccaacaggcgcttcgcgaggagcccgagctggaaggtggggagacgcccaccgtgggcaccaatgagatgggggcttgagagccgcccacaggtgcttcccacctgtgcgagcccatgccctggagattcccgagccgtgagctgcctcccacctcgtccctgccaagtgtctggcccgccttcttgggggagccccaaggactttgcagctgcatgtgggggtcacttccctgcatgtcaaaactccccacaacacctgtgtcctggatctcacaatgcaaccccgctggaagatgcaatttatttgtttatagcagattatctggttgggggaaaatattagcttttagccctaccctgctttaagctggttatctatgggtggataacaggaatctcatttgaatatgaaagctttctcccaaccaccttctctgcctaagacggcatctttgtggaggaggcaggtgacctcgggtgatctttggccctatgctggtccttgggtggcatcaactggccaccaaggtggtgcccccgtgcacctttccccaggtgtgcctgaagtctggcaagtaaacggtgtcgccatcgccgacccggatctcgctggctgtgggccatgagactctgccccaccatccctctgacccctggccagcccttgacccctggcatttgctatgaggtcgccttaccctgtcacccctcgcacccagggcaggcctgttcgctttcctccaggccgcactgggaagggaagagcctctgcctggcttcactggcagtcactccagcagatgctgataggacagtgccccaggcagtggagggcagccttccaggcagtgtcccccagagccagagtctcatacctcactgactgtccctcccagggccccctcactttgcccaaaagcccaaagacggaacatctgggacacacatcagctggctccactctcctccctccccctttccttcccacagtcccctgggtccagaacaaggcagatgtttcctgcactttccacaaatcacagccctttcctaccacccagcatccagcctcgaggctcggggcttgcatggagggggtgcaagacaggaggtccctgcagagtcagtcctggacttaaagaggtgagggaggaggaaagacggaagtggaaagatcctgtctccagaccacagcctggcctgcaagcctggcacctggctgcgtcatcctgtttttcatgtcagaaggtgaaaatgatcttgttctttctcttggcatctttctgaagcagttttcagtctcctcccaaaagatggagccttc

SEQ ID NO: 467791 - DNA, 887 bp, Homo sapiens
ccactgctgtcccagatccacgcaggaggcaaaaggcgcaaaggcgagggtgacctgacggaccactgggtgtgcaagtgcgcggagagccgtcggaccccacacgagggagcgccgttcttactccatcaagcatgtgttaaaggcctgctctgccctgttcctggtctgcaggcctctgggtgaacagggctggcagagacctgtggtcccgatggatcccatggcccctgagtgcccctccgctatcaacctgccccacctcctgaccggggccatctgtgctgctcagatggctgagcacaggctgccagctctggacgcttcacccacactgctattcagtggctacacgtacaggaaggccctgcagaccattagaatagggaccatgtctgtaccggtgataactagcccttccctgagctccctgaatcccccttcccgtggccctcgttgccccagcctcttccccaggacccctgtgacctctctttcagtgactcaggaactaaagggtgggcacctggcacagcagggccccagcagctgtccgaggccatgggtgtctgtgccagctgctcagtccctgtgccttgctggtgatgagatgtacctgttccccattcgccttccaccgtaactgtttctggaggcctccccggaagctgagcagacgccgccacgcttcctgtgcagcctgcagaacgactctgctaccttctccctgagtcacaaggttatccttctgtgtgtgtctgtgtcttcatctccacttcttataaggacaccagttgatatcgtttggctgtgtacaattcatcttgaattgtagttcccatcaggaggaactcggtaggaggtaattgaatcatgggggtggttac

SEQ ID NO: 467792 - DNA, 441 bp, Homo sapiens
acagagatgatgcttacactgagacctgaaggagaaggaggaggtggctgctcacgcaacccacaggaaagtgttccaggatcaagaacagcagccggtgccgtgaccccctctgtgctggtgggctcaggggttgatggttcagagcctacacttcatcctgtggtcccacaacatgtcatcgtctgccatgaaaaggtcattcctgtgtccaaaaactgctccttgcttaggatgatggggaacttggcaagacagagaattcagtgggtacaagccaacgggtccattgcatttgtgaaaactaagcttcttgatcagaagcaatgcgtggggaatacactaatgatctgtaaggtcccatacgcccatggatggtggttctggcagaagcactgtaggcaaggaagacaaatccatattcaaaacaagtgattggac

SEQ ID NO: 467793 - DNA, 1160 bp, Homo sapiens
caggaacaaatgtggtatctggggctggcggtgtacagtgccaccaacgtggagctggtgacacgcacacgcacggagcacctctctgatcaggacaagtcgaggagcaaaggtaaacccagctcccaccccttctccgtagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagagaccagatgagctggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgttgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggccacggtttatgaggaacagcttcagctggagcggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactggctgaaaggagctggcgagagtcacgtgtccttaccaagcaggcgtcctgtgaaagtcagatcccctgtgccctgtcccacctgctggggacccg

SEQ ID NO: 467794 - DNA, 721 bp, Homo sapiens
gttactcagggttccttttccaaactgtaatgactgtaattcagttaggcttattgcctgttattcaagatgatactactgaggaggaggaagaggagaggaggaggaggaggagaaggaggaggaggcagaagaagaagagaaagaagaagaggaagaagaagaagacgaagaagaagaaggaggaggaggaagaagaagagaaagaagaagaggaagaagaagaagaggaagaagaaggagaaggaggagaaggagaaggggaaggggaagaggaagaggaagaagaagaagaagaagaagaagaagaagaagaagaagaagaaggagaagaagaaggagaagaagaagaagaagaaaagaagaagaagaagaaaagaagaagaagaagaagaagaagaagaagaagaagaagaagaagaagaagaaaaagaaagaaagaaagaaagaaagaaagaaagaaagaaagaaagaaagaaagaaagaaagaaagagaaagaaagaagaagaaatgccaagagcaacagtcttccaaaattgctgacatcaccaggcacaggcatcaggtttggaaaaacttgggctcagattattcatctaccactcactagctctgttttctgaaatacatttaaatctatgtcctgttttccatagaggttgtactaattgacatgctcaccaacagtgtgtgagcatttccagcatacacttttttaaa

SEQ ID NO: 467795 - DNA, 795 bp, Homo sapiens
gatccttccccagccaagcctttgataaggatcaagccctgagtccttcgatatgactaacaatggctccgtgacttcatgtgaaactgtgcattccttaaaggaagggactgtgtcctatgtgatttcatacctgaagaaacaagcaccatgtcttgttcttgatagagacagaaatcaggacgttcttcatgaattctcagatcctgactaccgctcaatgggtgttctatctggaggaatatgcgatggacaagatctttggccaaaccataattccagaaatggagtggatgagccaggccctgctgatggtggacccagtggactccaggaacctagtcgaaatcactgtttttggatgaccctgtgtacagaattgggtaaagagcttgctcccatgcctggcatggtttcaccaaaaacatcatgcctgaactgtgaagaaaaaacaccttgagaagaatgtgaaggcctggtttagaaaaccagtgggagaaatctatggcttacaacaccaattaattttgttaaaataatctttcagatgtaaactggctttgctagtgaataaccttggtataatatctctgggctttggattctcgtctgtaaactggaaataatatttaccttacagatatattgtaaggaattaatgagataagtaaagcacctatcttaatttctggcatatggcaaatggcaaacagataataaatggtagcaattgttattattaagattgagtatatggtaagtggattgatttattccgttagttaactgtttccc

SEQ ID NO: 467796 - DNA, 748 bp, Homo sapiens
cttccctagtgtgaatgtgggagcatgtggcgggcactggggaccgtggggtcctgggttgggcctggagggaagttcacggtgatgctgagtgaggatgagcagctctgggatggaatgcgacacgctgagccatgccatgtgcaacgtgtttgcgttgagaagccagaagaagtttagggattttctctttgctgtgacctgcagtccctttacttcttcagcgggactttctttctgaggggctgggggagggtgactgcctttgagaactggtgtcagagggaggcgcagagcaggcggccgggcaacactagaatcactgggccatgaagatcaggtcacagggaacagctcagtctgagttctctactggaattttccagcacaacttggaagtcagagctgtgctgggatcccagcgactgggggaggcaaattcgggtcaggggagggagggcgggggccatgagggagacacagcatcccagaaacattcgaataaacaaagaaccggaaaatcagagcagcagcaggtgagaaggaacccaagggtgggcgggctgttgctggacgccagcctgatctgtggcacggtttgcagcgaggtacacagggatgagctgccctggctggagtgcagtggtgtgatctcagctcactgcaaccactgcctcctgggctccagccattctcttgtctcagcctccggagtagctgagactacaggcatgtgacaccatgccca

SEQ ID NO: 467797 - DNA, 854 bp, Homo sapiens
aggagatatacctaatgtaaatgacgagttaatgggtgcagcacaccaacatggcacatgtatacataggagaagtgatcccctctctctgtgggaaacaccctaaatacacgaggggcacggcgaggaaggccagcgccagcttcctgtgtatccgtgtccacggcagccactcaggctccagccagctcgtcggaattggggccgtagcttcagaaaggcgagaggtgattgtccccacctctgcagctgacctcggggtcctcgggcccaagcctgccagctgttgctctgccccagcagaaccacgcaaaggggtgtctgacttgctgcccgtgggtgcagtgccctgtgacctggagagcgtgctcatcctctcctcccgtgcctttgtgccctgtgacctggagagcgtgctcatcctctcctcccgtgcctttgtgccctgtgacctggagagcgtgctcatcctctccgcccgtgcctttgatcggtggcagtgccctgtgcctatggacctgctcttcagtgcctctccaacaagcaacaaggtttccagggcagggaagtgcttctaacaaacaccgctaacaccttcccaggactccaacaacctgcagtgggtccttagagcactggtttttgataaaaaaaaaaaaataatgtgattaaacctatttgaccctcttctcagaaaaaaataattgtacatttatatatatatttatatatatacatatagatctatataaatctatatctatatgtatatatagatgtatatgtatatgtatatgtgtatatatatgtatatgtatatgtatatgtatatgtatatgtatatgtatatatac

SEQ ID NO: 467798 - DNA, 650 bp, Homo sapiens
tgccaaaatcccagaagaaatccaatgaggtttgactcacctagtagttacacttctaggaaatgttccaaagaaaaacattcaaaagtgtgcaaagcagcttacacaaagaaaagttcgtcaaaaagctgtttattcatgcagtcagatagaaggatgtcagtaattaaccatgtagaagttctttatgaatatctgctgcagagaagaaacattaggcgattgcgagtctgccttttacaaactgctagtactgtgtatgacaataatgttgatcacctgatcaaaggacatccagagggtcactactcatgttccgtggcaaggataagcttcaagctctctgactgcttgctaactgccatctgcaataaactgcttacctttgcattaccacctgaacaattgcctgccagagtggagtgtatggaaaatagataaagaagcttccagactttacaactgcaggaagaatcatttgcacgactgggtttgagaattttcagtctggaaaataactgtcctgtacgtcagaaagtataaagtgactccatttcaaagttccagagtcgaacaataaaatatctggctactcttatatgacatttaatttttcaaagtactttcatattttcattacttgcttattt

SEQ ID NO: 467799 - DNA, 921 bp, Homo sapiens
gatgatgtgtatagttatgtgtgtagtctgaaactgctaccttctgcaaaaagcacacccgcctctctgccccatccatctcccagcacaacgaagccgtcacaaggacatttttcctccaccgtggtacttagggccgtctgtgtggctgacccagagctgcccgcagtcaggaaataaagagaggagccagggcgcaagataacgccagcccccgcgtccctgtgatattaattactcgagacacgtgcatgacatgctgctcatttgttcctcaccgccagctatcttatctccactgacgaccgctgatgaaagttatattgtcaattctcaatttccaaccatggctccatcaagagctggactgtgggctgcctgctggattaaacttttcctcaatgctgttgcctctccaaagctggagctgcagagccctctgaagaccctggaaatcacagctcctggaatggaattccagaggcagcaacggagtgaaacaaacagctacgtggtgacttcttttccttcagttactgaaaccatcaacagtaagtttgcagttttggttgtccagggcctgccagacaattctcttgccctgggctttcttgtgtggacactggctacaggagaacctacggacaacgctgaggagctcacagggaaattgctcctgctctattctcaggcctgaatcccatttcgtttcaaactttaaatattaacgtggattagtaacttacaaaatcatgatacaacacatttttcccaatttatgcctgatcacagaccacttttcacaaggcatatttacggaggaagtgaggaaaagggcaatccagtttaggaagttttggggatttgagaagtaagatgtttgcatttttgaaatgtatttatttatgtatttacgtattt

SEQ ID NO: 467800 - DNA, 621 bp, Homo sapiens
ttgtgaacaaagacgcgtttccattgtcccatccttgcagagcaccctcatctgcattttgaagcaatgagctccttgaagtctaatgccattacgaacgagtgtgtcgccaagcagacagtgtgtgaacttccccagcgtgcaagatgtgggcaggtggcaatgggagtgtctgagatgggcaggtgctttggtggacagaagtcatccatgatcatgccccttcatcacatcagcatccctgacacctccttctcaaaccagggagcttgtacaatactaataaactttttatcatggactaaaaaattagttttaaaaggtggctctgaaaacattgcaagatgctccctggaagaccgggctaaagctgaaggcgtctgcttcacctctctctctgacagtgattgccaggggccgacagtcgctccttgttgcggcggcggctccatttgttacagggctcacttcaccaggaaaggcccgtctcctccacccaggtcacagcccaccattcatctcatctgaaaacgtcccacggggagagagccgcagtgcatagcaacggggggagccgaaacgctgtcggaaaagggctggcgccgcaggaggtggccgagc

SEQ ID NO: 467801 - DNA, 916 bp, Homo sapiens
aaccaataacattttttggaaatgcttaggccacatgagggaacagaaggcattgggaatgtgcttttccgtgatcagaggggactggtacaaagaagtcactgctcaggggtcactctgaaacctttcccctgtgaaactgagacgtttcaccccaaagctacaacactcttggtttctccagttctcttctccagttgtgtctctttatttacagtcaagctgatggccacgttcaagatgactggtgctgctgagagtctgattttcagattggcttggtgctacgcggctgtagctgatctgcaaggagagatctacagaactttttcatcttgcaaaactgaaaatctgtatccattaaacaatcattctccttcccccagctcccctgagctcctggaagcaaccattccattctgtgtctatgattttaactactctagaaacctcagttggaagcacatagtatttgttttgttgtgaatggcttatttcacttagcataatggtctcaggttcatctatgttgtagttcttggcacactgtcaaaaataatttaaccacacgtgtgaagatttatttctgagctctttattctattagttcatatgtctgtgtttatgccaataccgcaatgttttcattattgttgctttgcggtaagttttgaaatcaggaatgaaatgtttaaatttgttgtgtttatattcatgttttttatcaaatatggaaagcattagccattattttattgaatattctctctccccttttattcttctttttctgagacttcagcaatccatatgctcgtgttggtggtgtcccaaatgtcccttaggctctgtttacttttctccaatcttttaatttctgttcctcagattcaataatttaaactgtcatatcttc

SEQ ID NO: 467802 - DNA, 602 bp, Homo sapiens
gagtaactcattaccagcagtgacagcatgacacgacgataatgcaaaacagaccaaggtttgatcaattttgttattggtttttaaaatcctccaagacaatgcacctgctttttgcccatatctgcagagtgttcccatgcctgcctttgtgtgccatgctgagtcttcccaaaagattgtacagtctctatgcccatagtcatttaattccttctgaagtgctacctgttccatgcatggggcaaggaggaagtcaggagcaggaggcttcaatgcaacttcgaagtctggagcagcttctgtgctcccaccctctctcgcgaggacatcacatcctcattgtgggtcctagaataagaaggtccatgatgcaggcaacatgcagtggcttcacagcccagaacagaggcccagtcaaccctcagcccttaattaacgtaagaaacaaatgtttgttgttgtaagccactgagatttgggggggctgtttgttacgtggtgagttatatatgactgaaacactaaagggaagatgagggaatagcatactaagcaagaaatggaagagagtagaatcgaacagccaaaccaggtgtctt

SEQ ID NO: 467803 - DNA, 745 bp, Homo sapiens
cactgcagtttttcaggaaagtatgtcatcttctccgttatccccattagtctcttcaataaaacgccccttgtccttcccccagtgtgctgatgcttcgctgcctgcactgaccatcaggcacctgggtgtttggaaggagtccactgaatttccatggaaacctggtctcactgatggacccagtctggggagggttcctgggattgaggacgaggcttcggcactcaggagctctgaatgtgctgttagcacagaggtatctccagacatccaggtgaaggcagatttggggcctatcaatttaaggcagttcacagagaaaatgttttcccttgatttaatgtttccggatgtgaactgtagggcagctgattcaaatcagagaaaatttctagtccgccttctcggaggactttgcaggtccaggggggttagatgcacctgttggtcgtcagcgtggatcagacctgagttttgacgatacactggctccccctgctggttgcctcttggattctccatagctgaaactgttaactgcctgctgttccttctcaccccaggacgtgagagagctttcggttccctccccacaaggcgagtgtgcatcttccactgcaccccaaagctgctgcctgcttctcctctgttttcataacctgggatgccttcctctgaggtctgcttcacaagaatggattcatcacttcaatttgcaaagtcacagttgggtggacattcc

SEQ ID NO: 467804 - DNA, 1113 bp, Homo sapiens
ttaacacagctggtcaaggcagacatggacagcagctgcccaccagccccaggcaccatgtaccctggaggctggtctgaggcactgcctttattatttattgctgtgtgatttcacagcttcccctgatgtcagaacgcaagcccagatgatgcctgtgtgatggggcttccctagaaacgaagggatttattttaattgattgccttttaatcagaaagttgtgtgaggcatgaagccctgtccttgggcatctcctgtttcttgaaatgaatgttcagggtgaccctggctcaagaaattgcaaaccgtggccactaaaaggccagagagcgcccttcagtggggattccccaattccacgtgtaactcgacccaaactctgcagcatctgcaggtcagacatggccccacgcaatccaggaccctcacagctcagctcccccgtgtccactggaatgacccccctcacctggtgtccccacggcttcacggccctgacgctgcttttcttcctgttttaccgctcgcctgggacttcatttgctttagttgtgcagtattctgtgtcccctcctgtgaagctcatctgtactctcaagggaccaactgtccctgatgcgggcacacaggcctgtgctaggaccctccctgctcctggctcacagatgccacaggccagtgtttgtggggcacaagtggaggtgtggagactgaggcagggcacagtcaaggatgatgaccaacacactacccagaatacacagacagagctggattcactgcttcctacactaaaggagatggctctcctagcagccatagcatccctgaagagagtaagaggcaggagagttacatcatctgctgacaccgtctgccggcacagcactgtgattggctctcaggagcacagttgcagaagtgcttagccctgattggctgatttccagagcgagggctgacactaattggctggcttgcaggtatgtgctcacagccaccattctcattggccagtgggctgggtttaaaacttgtgctgcagctgtttcttatcaagttattgaacaaccagtcttttcctagttgatgggagctttttagatttta

SEQ ID NO: 467805 - DNA, 1439 bp, Homo sapiens
tcccatgtggctggtggccagagtgcagaaccagcagtggcagaagacaaggtggagagacagaagatggctcttcagaggacagacagcctctggctacagcgtgtatttgccaggcgctgtgcaagtctcagggacacacaaatcaacaccctgatatggtcgttgaggaactcagagcccagcgggggcagcagggaagagaactacgtatccccgtgcgtaattcccatgcaacaggaagtatctgtttgccaggcagaaagcgcctgtagctactggtctctttctgcagccctgccaaacacaagcagcaataaaccaatggccattggcttaaaaagctttgtattcaaattacaactctttggtgtttgtcacgtgcttccttgggagatgaaagtttgtgttcaaggctcactaacagggaacacaatctgttcagtttgtccaacaatattcaccgttccattttgtgtcagcctcaagatacactgtaaacctctcagaaacctgcccagtttctccatcagtcctttgaattttctttcttagcccttcatgctgagcacagcttgaggtcagtggctgagactggccagcaagcaccgcgttaaggacacaggctgatcacaagagctaacctgtcatggttccacagcatcgtgccttcccctggtggcctccgaagctcatgcaagtttgcaggaagagacattcagagtgaaatacggcctgaaaagccactccaagttgtattatttatgaaacacaacactcaacacaagaagaaacccaatacagcacatcattctgcctgctccgtggcttctgcttctcaagcgacttaaaatgattgtctcactttgtctcccaggctggagtgcagtggcgtgatctcggctcactgcaacccccacctccctggttcaagtaattctcctgcctcagccccccgagtagctgagattacaggatcctctctctgggagccctcatctacctccagctgcaatcatcaccacaggagtgagagagagacttggacctgagctggaccctccagccctccttcgctgaactaccttccaaccttatgttcctactgatgtttaccaggttattcaataaatattgtatgttctgtggcagtggccaccagtcattttcaaatacctgttttcccttcttccttaccaaaaacacccatggtttttagctggacacctggttgcccaaaataaacactgcatttgcagcctcccttggagattggtgtggaattaaattaagttcaggccagagggacataagctaaagtggcaacttcccagagccttccttaaaaggaaccttgtacacaactcttgccccattttcaaacttttcctcttcttgttggccttttctccttcttgttagcaggaatgcagatgtga

SEQ ID NO: 467806 - DNA, 1265 bp, Homo sapiens
agggagcccttcttttccgcttctcagcgctttataatcatttagtatgtcgcattcacaggacattgattagtcccggaaaagcaaagtaccataaaggatgctgtgtacatggcaaccacacagaacacaggaattctcaggggcggtgggcaggatggtcggcctgcccatacggctgtcacgcatctccttccaaaatctggatgaagctggtctttgttcagccaggttgtctcccactggaattggtttcttaggaccccagatactgtgctcaaccaatgggcacacgtacttgcagcaaacaaggttccaagtgcagctgtcacctctgttctccactgtcccaatttttcgctcttcttcctttgaaaaggccaaaggatattcatcaacctacccagttgctccatctgagaccctaacaacagtgtttcaggcccagtttaacagaacaggcatctgggcagccgatcctggcattgctaatgtcatcctggaaccagcgacctcagtgtttttaggttggtgcaggaggaagtgcggtttttgccattgaaagtaacggaaaaaaaccacagttccttttgcacccacctaacagatgctcctagggtgcccctgagtcccagcttgcttaggacagtgtgcacagatgttcttgccagcatgctttttaacaccagcctctcttattctgaaagtatcccatttggaccagaaattacagcagattcaccccagctatgttgctcatgcagcattcagctgcattttcactttattgcacaatcctgaagacctgctccagaaagagtaaaggcagcaaacagttactttatttaccgatgcctgaggctgcacctgagcttctcagttgtaagaagagccttgagcagaactaagctcttctctctcactgctgtctgcttcttatctcaggtctttctgcctaggaaaaagctggatgcaactggcccaggctatggtcagcccttgacaaggcctcagctgctgagaagttactcaggacctctgcttgtccctgcaattggctgctgcagtctgctgcctagtttctgcaaggtttctgaggcctctcgcatgacgctggtgtttgagggccaataaatgacacagctttcttccactcaagtgcacaatgaatttggaagtaaggcagaggcctgacaggagagaatcaatagtgttatagctttaagagtctggatgaggcccttggcttagatctgtagcacagc

SEQ ID NO: 467807 - DNA, 1061 bp, Homo sapiens
gcatcgtggctgctgcttttctgccgggactcaggaccactggccactgccaggaaagccggctgcccccgaggccggcaacatcgtccccaggggctaccctcggggtgctgggccctctcttgctggacacccacacagtccactcatccagtgacagatgagcttggggtttaaagtttcctgggctctgggccaccatagctgtgagccacatttcatatcatttctgagagcttccctgcaggatgagcttcagtggctttcgctggtgttgggtttaacgacgcactcgttatcaggagccttcacttctccacatcctgtgttcgctctcgtgcagatgctcctgcacacgcaaaacaacacacgtgcaacacgcatgcaacacgcgtgcactccacccaggggaagctcaacatgcgtgcactccacccaggggcagctcaacacgcgtgccctccacccaggggcagctcaacacgcgtgcactccacccaggggaagctcaacacgcgtgcactccacccaggggaagctcaacacgcgtgcactccacccaggggcagctcaacacgcgtgcactccacccaggggaagctcaacacgcgtgcactccacccaggggcagctcaacacgcgtgctctccacccaggggcagctcaacacgtgtgcactccacccaggggaagctcaacatgcgtgcactccacccaggggaagctcaacatgcgtgcactccacccaggggcagctcaacacgcgtgctctccacccagggacagctcctgcgagactcgagtctgaggggagcacaggggccgggatgactgccgtgcaccacagcccgcaggcattcagatctgcaggttctgtgttttcaaaagcttggaatagataggtcattcctggtctcttattttgaatcatgaaaaaaactagtttttattgtagtgagcaaaaaaaaagtttactttttaattgtccacccaatgaggaagatactgatagctataaggcacccatggtgtgctttcaggcaccgatctaaaaaatgtac

SEQ ID NO: 467808 - DNA, 517 bp, Homo sapiens
acattctgaggatgctactccgacatgaggggccctgaaaaagggctgatccctccgcaaactcagaagaacgctttgggtaagagtgcggagacaattgccttgttcccattacagtttgcagttattaatttcatggaagagagcacgtcacaccgggggcaagacacagtaggaactgccagattaagtagcacagatatcccggaaaaagaaatcagtgcattaaatataagaaggaagaagaagaagaagaagaagaagaagaagaagaagaagaagaagaagaagaagaagaagaagaagaagcccgaaaaaaaaaaagaaaaagaaaaaaaaaaagaaaatagaatggtgaaggaaacacaggaattaactagaaaattgcaaaatctgattggtcatttgaaaaagaagtatactgccttgggcaaagttctacgagcctgagagtgtgaagaatacggatttccaaaataggtcatgagggagacctctctcctcacttctcaatttc

SEQ ID NO: 467809 - DNA, 1146 bp, Homo sapiens
ttaagtagcacagatatcccggaaatccatctcatccatgaataggccatcagctcccccagaccagcagcgatgggctttcctttgaaatctggagggtctggagggctgcgcaaacttcccttgacttagttatctcagagcattgtgatggaaaagaaacatcccatgcaaaagcagaagaaggaaaaggataagaagaagaggaagaagaagaagaagaagaagaagaagaagaagaagaagaagaagaagaagaagaagaagaggaagaagaagaagaagaagaagaagaagaagacggagcatgccggtgctttgtgtcgccaaacccctggcaggaccagattgagggccgagcttctcagatactgccttcagcaaagttctatgagcctgccagtgcgaagaatagggatttccaaagaaggtcatgagggagacctctctcctcacttcccaatttcgccttcttcatctctcggaatcagagagcacattctggatggagaagcaccacccggaactgcctggcttgggggcacagctattccagcacgctctagagttgtgatcgtcacctgctccttgccgccaccgccgcccggaagtggtcgatgaatggtttctgtgtttctctcccaccctctggagcatgcagggcttaacaaaatctgcaacttacttgacacttcttgctcatcgaagatttaaatgatactatcaatacagtgtaccaatgttttgctgttggtgcagacagttcaattctctttggactagattaggaaaaattgggggacttgatatacctctggagtaagaacataaatgcatacttttgtctagtccatgtgaatatgaactgtttctgttctttcttcctgataacaatagaaaaaatgcattccccaaatcaaagactgcatgccaaagaccatgtaatttttgcttttatgttcatattgtttataacatgattactttattaactttacattccaattctattttcttatgtattcaagtgaaaagtgttaattatgagaaattctgcactatggcactgctaatattgcaatctatatcccagacttcgttttaccgacagaagaaagcataccctcatcaatttgtcatgtcttc

SEQ ID NO: 467810 - DNA, 684 bp, Homo sapiens
gtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaaaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaagggttccagactgggctgaagcttcatgagacttctcctcgtctgtgcgcagacagctggccaactctggagcccaggctgttgcttcccggtctgttggtgaatcctccatagtctggcatgcatgtacatgcgtatgcatgtgtgtatgcatgcatgcacatgcgtatgcatgtgtgtatgcatgcatgcacacatgtatgcataaatgtatgcattgtgcacatgtatgcacatg

SEQ ID NO: 467811 - DNA, 725 bp, Homo sapiens
gaaaccatcttctggaaaatgtcttccctgacacctctcctacttttctgagtttgggttgctttcctcctagcactcacggagatccaggaagagaatcccggtgggttctaacctcaacctgtaaatccactaagcaagctcctactgaacacctatgatgcaagctcaatccaagaggccagcacgctgcaaggggaaggcaaccaaagcaatagcttcaatccccttcacacttcatggtgaagaaaacatcctccatgaacatcatagcatggataaagaaggagaatatctgtattttattcactgcgaattgctatacccaaaacagtctcttaacaagatatgtgttgagaactatcggagcattgttgtcataactgctccactgtatgcgtcagatgattttgacatctgtgtcctctcagtattgttattcgaggagtctctttgccatgtgaatgaagatctccctgtttttttcataatgccgaagattttggggcttgcacaaaattgccttgtattcaagttccaagtaccaaccagccttccacgtgttgttgtttcaaagataactctatttgcaaagcctttacgccactgttcagagatttccggagtgtgtgcaacttcagtgaggactggaaagtgggccattgcgcagttcagctctcaggctctttgtaggtaagttgtttgggattagagccacttattca

SEQ ID NO: 467812 - DNA, 858 bp, Homo sapiens
gaatacacattcagatgtgtgagtgtgtgcatcatggacgctccccccgaatacacattcaggtgtgagtgtgtgcatcatggacgctccccccgaatacacattcaggtcagcaaagtggaacgcgagaagaaccaggagctgcggcaggtgcgcgagcatgagcagcataagaccgcggtcttgctcacggagctcaagacaaagctgcacgaggagaagatgaaggagctacaggctgtgcgtgagacgctgctgcggcagcatgaggctgagctgctcagggtcatcaagatcaaggacaacgagaaccagcggctgcaggcactgctcagtgccctgcgtgatggcggccccgaaaaggtcaagaccgtgctgctgtccgaggccaaggaggaggccaagaaggggttcgaggtggagaaggtcaagatgcagcaggagatctccgagctcaagggcgccaaaaggcaggtggaggaggcgctgacgctggtgatccaagcggacaagatcaaggccgcagagatccgcagcgtgtaccacctgcaccaggaggagatcacccgcatcaagaaggagtgcgagcgggagatccgcaggctgccacatatcgatgtcaccttagcaacccaaggacccggcccaaaccagcactcataagaaccgggtgctttcttcgcgtgacacgatgcttgcttttctgtgcggggaaggaaggaagcgttgccactgtcccgggaaggtgggagggacaggtggctgcctctgcccagtgccacacgaccctttcatttgtcttggttggattcgatgctctcagtagaggaaggcagcttttttcttaagtaaaggctc

SEQ ID NO: 467813 - DNA, 1130 bp, Homo sapiens
ggaaaatggcataacaataagctaatttttaaaaaaagacgacacaaaagaaatagcgatgatcaaaatagtcaaccatggccaggtgtggtggctcatgcctggaatcccagcactttgggaggcccaggatcccggcagcatgggctgtgttctgggagctgctgccccggacgggcacagcgggccgcccttccaggtggctcgccacagctcctgctccagtgcccttagcaaacatttcctagacacgtctcctggtccaggcatcgtggacctccctggggtggctcgctgcagctgggtctgcgtttccccggttcccgtggacatcctcctcctgacccagggtccccacccccccctgcgagttggcggtgtacggagctgtgtgtccccaccctcccgtcccgccccccgcaggctggcggtgtacggagctgtgcgcccccaccgcgccacgagctttcagtgcacagaactgagtgttccccaccccacgccccgccctctgcgagctgagtgtcccctcatggagctgtgtgtccccccaccccgccacgagctttcagtgcacagaactgtgtgttccccaccccccgccccgccccccgcgagctgacggtgcatggagctgggatctagattttgacttattttgaatcttcagattgttgtctttcatcaattctagagaattctgtcagtatatcttcaacttttgcatctggcaagttttccccttcatttctccttctgagagacctactcattctatcttttatctctcgtagcttcttctctgggttctgcctctttgtttgtttctttgtacttaattccaggtaatttgttctcaattatcttcagagcatccgtcctctcatctgttgtccaatctgccaccaaaagcgtccattgtgccttttgttttaatttattacatttgttatttctaagagtgttctttttattcaaatttggtatatcaccttttatagttttctactccatgaagttattttcaagcttgtaacttatttcttcaaagaaatagaaaaagtttatgtggtggggagtaagggtatgtgggaattctgtgcactttctgctaactttgctgtgaacct

SEQ ID NO: 467814 - DNA, 1110 bp, Homo sapiens
tccagaacaaagggcagtgtgtctggcactatgacagtgagtgccgggcgctggccttggtgggaacaggctggccaacccacgtggcactccttgcctgctccccgtcccctgtgggtccctttggtcgctcaggaccccacacctgccctctccaacccacactcatcaggcgctcagacctgcagcttcctaacctgctgcatgtggcctgcgtcgaaagtggcttccagcagaggacacttgggagggacacagccacacccaggacccaaggcccgggtgagatccggaggctgtaggaacgctaaggggcggtgctggtggtccaaggacgtcccccgcagagtggaccaggaagaacgtgtcagaggatctctgcgccgcagcatctgggttgcatcctgtgagagacgccgcgggagcccagcagcacggcgttttctgagtgtggccccatgggcagcagcattccttaatatctggaatatgctgacgcctttcttcctggatctattcctgagaaggtggtcactgagcttcctcttccgagacagcctggcgctctggacgcttggcttccgctcgctggctcgccgacgccctctgctgtccacggttgggagacctgaaagtcgcaagagcgtgcccgtgacaggaggctatctgctccctgattctggaaagatggccgtaaggtggaaagttcctgggatcctgtgggacccctgcccgacaccacaacagtaacctcaaagcactgttgcctacctggggagaatcacgtagattagtgccacatcaaaatctcgaaacatttgggggtggtgatttctttaattcactttctggcctgcgtggaaacagatggatgatggggcaggactctgtacgtgtcactattaaaacctctttgaatattggaggctgatgtggttaggctttgtgtccccacccaaatctcaccttgcattgtaatccccaggtgttgagggaaggacctggtgggaggtgattggatcacgggggcactttcccccatgctgttcttgtgatactgagtgagttctcacgagatttgctggttttataaggggctcttcccgcttc

SEQ ID NO: 467815 - DNA, 2633 bp, Homo sapiens
ctgcgctattctgaatattgtagtttgattgcactgtggcagcgagggaaggagggaccggcaggcagtggcatgaaagtcagccctgctgcctctcctgcctgtgctgttcctcagcaccagacctgggccttgggaaaacaaggatggtttttatttgtcccagctccttgtgggaaatttcagaactcccccagtgagagaccaaaacctttttatttcaaaggtgctttgccctccagccttagtcatagcgaggagatcacagaggtacaaaataaagaggaaatagacaaggagggaattgtcaccaagcattgtcctcataaaaaggtgtgtcaatcacagcaatgtttcaccctcaatgtcctctgtctcaagtgtaggattttaggatacttggagccagagaaaaccagttggcctggggatgctgacagcataaaaacgtccttgggctccagtaatcactactttaaggtttccagttggtgagggaaagtaagcatttccttctcagtgtcttctgagctggggtcattaaacagcacacaaagtgattagaagtttgaagacaatttcacaatgctgatgtcaatgcctgcagttagaaacaattaaaatattgattttttttcttattggatgagaatttactgagaatttatgtacaataaaatgtgtaaattttatgtgtactgttagttgagatttgacaagtgaatacaccatgtaaacatcaactcagtcaaaattgacagcattttcatcttctccagaaagttccctagtagttctttttagttaactctcctcttccaaaagaaaaacaaaataagtgaaaagtttactctgcatcatagatttgctttgtctgctctagaacttcctgtaaattgatttatggaatatgtagtttttttacatctgacatctttccacaacatgtttttaaatttactcaaaatgttgaataaatcagtagtttgttccaatttataacagaaaaaatactccaatgtattaatataccacaatttatttatttattcacccactgatgaatatttggttgtttataattattgcctattatgaataaagttactatgaactaatttttaaattttttttgaggattcaggtatttaattcctttatgtaaatgtgtcagagtgtaattcctgggttataggatagctgaagaaatacaaagttttcaatattttatttttttgtacataaccttacaatgtcccattatttgaaagtcaggatattaaaaatagtctttctttttaaagtaacatattttgtttgcagaatattatatttatatatagtaaatttagaaaatataaaaaagattttagaaaagagagccttttgcaatctcaccactctaaaagcctattagaaattattttaagctattctccaaaatgggatcacttttagtaactcttaaaatgctttgtgaataaatgaatgtatgtcaattcacttatatatttgtaaaattatcaaaataagtcaagttctgaaggtagattaaataaaggaccatttgattgtgaaatgtataattcacatttaacaggcttccacattgcagagggtggtaatgagactcagtctatcaggttagtacatttggattgacaatttagttccaaattagaatcctgattgccagtaatctcaggcaaatgaaccttagagaaaacaacattatcttatttgaggttctacctaatctctctgggaaatttttcaatgaacttagttttcagtatatgactacttcataactttataatatactaacattgaccttattaaaatatttgtaatcatagagctttgaaacagtaggagatagagcctgagatctaagagaaaaggttagttatatgtgtttttatttaaaacatttcttaatgtattcccattatgtgaaacttcccccaaaaagtcataggttacatgagtcatacagtaaagagctgaatttatgttccttatcatttatttcatgaatcagtcagaaattaattttaccaaaaacaagaatgttcaacagatgctactgtgtgataagagtctacttctcaaattaattatcatgaacactgaaagtgcttcaggaatacaactgcctagttctataatttcctggctactgataaaaattttcaatgtattttattaggaaaagtaatacattaatatattttaaagtaaaatatggtttttactgtcttgcatattgcaattcaagtcacaactgctggtttctcatgcaagtcagtcacccaaggtaatataatgtgattgatgtaatcagaatggtttgcttataaggatgacatgtcctcttgagaatttaagctttggtgaaatatgttggcagtaagcacttcccttacagataaaactttttctttaaaaacattctaactgtataaatttctagttgaaaaatagaaaagttgaaaagtttttctatttagaaagtttttttctttctaatgccaagtttaaatgtattatctaaagtttttgcaattgtagctcaaataataaaccattctttaaatttcactgtaaactaaaaatatgatactttcatt

SEQ ID NO: 467816 - DNA, 465 bp, Homo sapiens
accaccatcaagaggacaaacaatgaaaatattcccctggcatgtcagaggtcttcatggcagcccctcccatcacagccccagaggcctagaaggaaaagacggtttcatgggccaggcccagggtccccatgctgtgtgtactgcatcccagccactccagctatggctgagaggtgccaacaggggccaatgtagagcctgggttgtggcttcagttggtgcaagccccaagccttggcagcttccatgtggtgttgagcctcctgtgaaagcagccaagagggaagctgtaccctgcaaagccacaggtgtgaagctgaccaagaccatgggaatccacctcttgcatcagcatgacctgtatgtgagacatggagtcaaagatcattttggagcattaagatttgactgtcccactggattctggacttgcatagggcctgtagcccctttgttttagcc

SEQ ID NO: 467817 - DNA, 611 bp, Homo sapiens
gcatacgtatcttctccaatagccatgagcttctcaggaggggaaattgccaaacccaaaatcctgattgatcttatcactgccatcagcaagctgcgtccatgggtgaggaccttcctctcaggggctgtgtgctctggaaaacaagaggagcaggttcacagcaaagttgagaggaaagtacagagatttccgatatacccccgcctccacacacacacagcctcccctatggccaacatcccccaccagactggtacttttgttacaattgatgaccctacattgactcatcataagacccaaagtctgtcctttacactggggttcactcttagtggtgtacgttctgtgggtctggacaaacgcatgatgacgtgtatccatcattattgcaccatacagaatagtttcactgctctaaacaccctctaggaaagccttttacatggctgtaactgtaatgtatatacaattttgtgcactggttttagatttaacattaaatagtaaatgaatagtaaatatcactttttaatggcagcatagtatgtccttaagttcctgtgtacttggcacttgggcgacttaagccacaaggactcagtaac

SEQ ID NO: 467818 - DNA, 664 bp, Homo sapiens
gagtaaaaccaggaacagccaggatcctgccactgtctgatcatatcactaatgtctgtggagcgaagagcagttactgcctctaaagctccctctacaaaagagttgagggtcagttgagaggtctgggacccagccatatgaacgatcaggagcaccatctggttttaaaggtgcagcccccgcatgtgaaaatgcacagcccaggcccccgatcccatgtgggggcactcaagtttgcacagcggaaaggggctggccgtgtggtgcacatctgcaatctccctgaaggaagctgcactgagaatgacgtcattaacctggggctgccctttggaaaggtcactaattacatcctcatgaagtcgactaatcaggcctttttagagatggcttacacagaagctgcacaggccatggtccagtattatcaagaaaaatctgctgtgatcaatggtgagaagttgctcattcggatgtccaagagatacaaggaattgcagctcaagggtccattttgtctaagacccacaggccttaatccaccttcaaggttgaagttagaagacaaaggcttagtggatgtttctggctaggactggcattctgacaagtctccatatgtagatgggcactgtgtcaaccagcttccagagtcctgaat

SEQ ID NO: 467819 - DNA, 583 bp, Homo sapiens
cacatgcatgtggagagagaagaggagtagggagagagagggcagcatggaggcgtgtggattctgcagcccatctctctcccagatcatatctgcccagagtcaggagggacttcacattttggggaaaagaaacagccctggagggctgctcctggtgggcatacccctgaacgggctgaacagccttgcactcatgctccagactgagaaacagccctgtaggccacccctggcccaggatgcaggcacactgctgctcaacttgtggggtgtgtctcctggggcagcccaagaggctgtttctcaggctcaggatatggtcacatggtttgtcagctggcctgtgggtgtgtctgctgagggggtgcccatggggctatttctgaggtttgggatttcggtccaaggctatcaggcatcccatggaagggtcatgcctatcagtggcatcctacggaagaggggctgaaaacttgggagacagatgaacatccaggtccaggaagctcaaagaaccccaaatacattcaacccgaataggtcctctctgaggcacattatagtcaaactgtcaaaagtc

SEQ ID NO: 467820 - DNA, 1227 bp, Homo sapiens
gagaactatcctcatcactgtgttgaaatgagaaccttggaaactcaagccaatgcacaccaatcccatgtacgtggtttatgctccatgcaaagcatggaagagcaggaagtggtctttcttccctgtaggagccgacatccttcttctcaatggctctccatatcctcacctcgcccccactgtctgggaaatgctggagagaaataaaagaaaatgccccctgaagattgagctcccagggatgagggaggcaagcggcctggaagagttctggaaggtaacgaagatagaggaaaggggctgtgaagaggcggcatggcagcgagtcatgggactggctgtggttctggagatgagcgaccaggtcaccagcgcatctgctatctctggtgctccagctctggctttctcaactcgggggatgcagacagcagcagctctgcctccatttctgtggctgttcctgccgtctgctgtctgtgcccagttggccagcacccatcaggcggaggatgatgtctgcatcaaggtgctgcctgctgtagcaaatgagtctgcaattgtttaccctccattgacaggatacacgtgggtctttgagggttgggctggaatatggtttcatgggcagctgcatgtgaagcttctacccgttcctgacactggcttgtcgtgtttggacaggacttggacaactccacttctctttttttctagtctacttatttcttcatgcaaggccttctcatccagatgtggctgaaaagtctaggatagacatagtttatgggatgtccttaactgctggggactaacatggtagatttgagcatgggctctggagccagctgcttcagtttgtatcggctgagtgatcctggccggccacgtggcttcacttccgagccttggtgctcatacgtaatgtggaaatgataacagtgtctacctcacatcattgctatggagattctctgagttaatttacatgaaatgattagatgagtgccaggcggagagttgacctgtaggtcaaaaaaatgttagcaatgattatggtgacttcagacttattctcctgtttatttagattttgtttggttggtaagttctaatctgcatacactcttcatggactccaaagagttgaaaggataaagaataaaagagagtattatataaatattataataattgcaggtttgaattcctatattagtcttt

SEQ ID NO: 467821 - DNA, 666 bp, Homo sapiens
attcacaggagtgtgcttgggtctatccccatccaatctaccatggcgggggatgggggccttagtatcaactcactttcccctccatattcctacctcaccaatgcctcaatcagagatgtccattcagctgtcactctcctgaaggaagatctggaagaggcaccaaccatctgggctttagcctgtgttctcttctctgctgctttatgcatccaagttctgggttcctcaacctttggtgaagccctgcttaatgcaagttggaaacctgagtgtcctgaggaaggagagagcatattgaggaagggggaccctgatgtcatgttagatatatctgggccagttttactgaggtgccttggaagtgacagaaagcagatagaagaatggttctttcttggctcagtagttctcaatcctacttggggtgatttctctgaaaagtctaatttttatgtagatggggctcaggcatcaaaaaaatttaaaatgactctggtgattctaatgtgtagccagagctaagaacccctatcttgacgaaagtagttttgaaagagaatgcaaggtcccaagtggagctccaaggatcagctcctgggaagtggcttattttctatcagatatgcttatctgctgccttggccaccaagttcacaatcc

SEQ ID NO: 467822 - DNA, 1016 bp, Homo sapiens
gtaacgtatggctgatttttcaacatttccattgacccttccagggcgtgtgttgctatgtgcggcagggggtaccttcgaagtcgaccagaccgtccccattgaggtccacgtcctggaggatctcgtccacctcccgctggctgaggcgctcccccagcagggccttgagggacgcccggagctcgcccacgctgatgcggccgtccccattgcccctcactcacggcagacacgcagcctgcccgccttcagccccagtgccgcactcttccggaaggcgtcccgtagctcccggacaccgatcatgtctgccgtctctgccagcagcttggggcccatcagctccacgaagtcttcaaagtccacctttccgccacctggggggccccggcgccagggccgcttggcacagttccccatgggccctgaaccatgccaggcctggaaccccgggggtggcccgggtgggcctcggcggatgctgctgcctgaggactcctgccagcccccagctgctcccgatgagagcctgggagaccccagctgggccctgggctcctcacctcggggtagccccaattgcttgcacttggctccccctgcctggactggtgccccgcccttggatgaggagcagaagggaaccgcctatgtgctgtgggcagtgacagggctcggctgcctgcacctgggcctcgagctcccggagaagctctcgtcgccgggtggctgctggggctccaggggcctggctggttcctggagtgcctcagaggggctggggtcccgttgggaggctgccctctgctgggccctggggctgggccatggagatgagggcttgttgaatctagaacttggtacctggtaagcaccccaaatagaaccatgttgagaatctacttcgtaaccaccaggataaggtaaaaaagacggacactgaccactgtgggtatatagtcaagggaaccaaaaacataagtttggggccaggcaaacataagtttggctct

SEQ ID NO: 467823 - DNA, 447 bp, Homo sapiens
taaaatccaggccagtgggcgcttaagcaaggaggccacatggtccctctgggggttgctcaggccttgagggccctggaattttacctggttttcgttgtgctacatcttggtgacaagctgtaccttcaaaacctctcggtattagtcaggggaccacaccccagactgctgcagacccagcctggtgaccgctctgctgcaactttgacctcagaggctgcagcctggtcctctgattctgctggctggcaacaccagaccactgttcttggtgcctctctgagacagagatcccagaggaaggagcaggcagccatctttgtggttctgcagcctccactggtgacacctccaggtgtgggaggaacccagatgcataggatctggagtggacccccagcaaactgcagccaccctatggaagaggggcctgaatggtaaaag

SEQ ID NO: 467824 - DNA, 703 bp, Homo sapiens
gcttccctggtgttgaggttcttggacctggactgagccatgctactggcttctctctttccccagcttgctgatgcctactgggagacctcaccttgcaatcctctgccatgtcatgaggacactcaagcagccctgtggagaggcccacatggcaaggcactgggcctcctgccaacagccggtgagcagctgccctgtgaggaagtcatcttagaaatggatcccgcaacccagtggagccttcagatgaccatgcaatgtggtttacttaatctgattagccagagagagggaggatttgagtgtgattctaaacctgtacagtacagcaaatcgtatcagcgagttcagtcctgggaaaggggaggggaggagcagggtcaccctgaaggctcagtaaccaaggactgggctgcagcagaagcttgcagtgtaggaagagggtccaggaaggaaccaaaaagccctaaagtgaaaatgatgtacaggtagaccacctggatgtactgtcagagcatagaaggtggctcctaccatctgtagaatgggaaccatgattgctgtttctctcaaaaggtttgtgcaaaacccacaaggttcacttaatacccactgggaggagaacccagttttctgtccaaacattttagcatttttctctttcttttcctctccccctttaaaaatgtttgctcttaaa

SEQ ID NO: 467825 - DNA, 483 bp, Homo sapiens
tcttcagtgacctgaagactagtagacatgttcagaccaacagaaagaggtcaaagggcatggatggatttgaacatctggattgtgttagcagcagctgtgggaagtggcaaaccagcaggaaggtgtgggcggagagggtggtcagactgtggaatgatgtctggaaaatggaagctctgtttaccgacgccttctgaggagcaagaaagccagtccgagtcccaaaacctcaaaagtagggaagccgacagtgcagccttcagtctgtggccaaaggcccgagagcccctggcaaaccactggtgtggagacaaatggaaccaggccttggatgacatcaggaatataatggagcagaaagctactgacctccctccatggatagatgcaccaaataagcatctacccacagatccatttcctcggaaagtcagagaccagttgagagacacctatccaccagacaaatgagaaaatgtt

SEQ ID NO: 467826 - DNA, 847 bp, Homo sapiens
tgtgacgcagggctgaggagtcggcgagtccctatctgcatggagttatcatggctttcacaggtcatccctgagagctcaccagaatattttgaatttctagttttgtctcacactataggacacacaccacatgttttcaaaataactttgagttcaaaagagttccctaagataacactgtataaccccagcacagaattaatggttttgaagactgttttctgtgaagagttgcctaagagcccgggctgcacagctggaaacctggaggtttttgctacctcgtccgccctctgctggatggaccgacgtctgcttacgaagtggcccacaaacagccgaaagactaagttgtgtcagatcattgtctcttccgcagtacaggaagagaagctaatctataaaacaatgagacttcactctggatgccaaaatctgcaattacattgtacggaggggcttcatgaataattcctggggtatgatctgacattaatctggaagttaatacagagctggggcattgccagcataaagctgactgatttctttataacagagcactttcaagagctacttttatttctgattattcatgcattcttaaatttcaccttccaatctttgctgaaatttctgaaagtggcctatgtttcaggtaacattgacgatttttttaatagaattttaaaggaggggtttgctactgttcttgtgtggttgtcattctaaatgtctccctctaaaggagatacttttaaaggactcgtttggaggatggataagaaggcaacagaacagttaggaggtttgcaataaacagtgtctgtagcaatacaagctt

SEQ ID NO: 467827 - DNA, 722 bp, Homo sapiens
cagggccattaggtgggatcccacagctactctcggctttcggctcggaggaggccaaggtgcaactttcttccgtcgttccgaatccgggttcatcccacaccagccgcctccaccatgccaccgaagttcgaccccaacaagatcaaagtcgtatacctgaggtgcaccggaggtgaagtcggtgccacttctgccctggcccccaagatcggccccctgggtctgtctccaaaaaaggttggtgatgacattgccaaggcaacgggtgactggaagggcctgaggattacagtgaaactgacaattcagaacagacaagcccagattgaggtggtgccttctgcctccgccctgaccatcaaagccctcaaggagccaccaagagacggaaagaaacagagaaacattaaacacagtgggaatatcacttttgatgagatcatcaaggttgctcgacagatgcggcaccgatccttagccagagaactctctggaaccattaaagagatcctggggactgcccagtctgtgggctgtaatgttgatggccgccactctcatgacatcatagatgacatcaacagatgaagaaacagctttaagttggttgcctaaagtcacgcaggtaattgatgcagtatggccagaacccatactaggcttaagggacagtgtaccataaactcgtagaggtcctttaaacagatagaaacgctgtg

SEQ ID NO: 467828 - DNA, 656 bp, Homo sapiens
cagaggtgaagctgctgtttcagaaacggtttcattgctggtattcagctattggtctgatgaatgcgttctctggctacgtggttacacgtggttagtgaagaccatgaggaacagtttgcttccagctggctggggcagcaattcaccatcactctctcacctcagaactttatcaaccttctgattttatgtcataatctgatctgcagaaatcttggctgcctctccattcaccaggctatgactcccatcgagtgttttgatgataccaagctgattggatctgatgagcaggaattagtgtctactgtcagcatttcagccaccacttgttaccaaggtctgtcctatacctcacattcctcttggaatgagcccctttttgccatcaggaccatatggaaagcccagaagagggagtctgtgtattcagcacatggatttccattctctgagtcacactaagtgatgggaatacagtcatggacaatggttactttgaaatcctttctgttagatctgacatctggtcatcttctgggcagtttctgctgcttgtttttttctcattgtatgggttatactttcccatttctttgcatgccttataattcttgattggcaactagagtttagataataaattgacgcaa

SEQ ID NO: 467829 - DNA, 505 bp, Homo sapiens
gacatcggtatgcccaaggcccataccctgctcaggcccgaggtggaccctgagccaggccgcatccagtggggagccctgcatgggcagcaggtgaagccccttggagatgcccagggatccaaaggcgacatcattgatggcaaggctgcccctcttggtctctggggcaccctggttggaagtttagaagccctaaaggacagctacaattgtggcagctgtgagagagcagctgttgttgatccacacacgggccagaaggtttattccgagagccttctgtgccgaatgagcgcagcagccaggtgcaaccggaatgacggatgggaaccaacagatgtccctcccacatggcaccagcagccagggcccctgaaggccactgttcaccttggccctcatcctgcaaacatcaatacacctcaccacattagtgtggatgtctggagaaagtgttgagactacattggcatctaaaaattccagttgtgtcgaacgtagc

SEQ ID NO: 467830 - DNA, 518 bp, Homo sapiens
ttcctccagcatcaaccacctgttcctgctggtttattttcttctccagggaaaaaacaaagataatcaatgaaagttgcaaaggggagctttggcttatttttgtccctctacctatcagagaataccttcttctctgagagatataattcaaagggaaagtttgattcccattgccagtgtttgcagcagagtgtttgtgtccctgggtacttgagattagggagtggtgatgactctcaacgagcatgctgccttcaagcatctgttcaacaaagcacatcttgcaccgcccttaatccatccaaccctgagtggacacagcacatgtttcagagagcacagggttgggggatgaaattggctggagggaaatgtcacgccggcatgtgcagtctgacgggggacagctggctggaaaggcgtaaatcagaaaccagcctcacctccttgctgtggaaattgccaccagaatgcttataaatagcgctctctgttcccagttctgtcagggggag

SEQ ID NO: 467831 - DNA, 2653 bp, Homo sapiens
gcagctttagaacgatttcaaagagaagaagatagtgtttcagtttctgatgcccctggaagctgtgtaatagattgtaaagacaagacagggaaaaaatcccagaaagaaacggaaagtttacattgcgaatatgtagcagagccagtaatggctcagtcaacgcaaaatgttgactataatcaatcaattacagggggtgatatatcctgaaacattaaaattagaaggaaaaggtccagaattagtggggccatcaaagtctaaaccacgaggaccaagtcctcttccagtaggtcagatgcccgtaacattacaacctcaaacgcaggttagagaaaataagacccaactaccagtagcttatcaatactggccaccggccaaacttcagtatcggccacccccagaaagtcagtatggatatccaggaacgctcccagcaccacagggcagggcgccataccctcagccacccactagcagacttaatcatacggcaccacctagtagacagggtagtgaattacatgaaattattgataagtcaagaaaggaaggagacactgaggcgtggcaattcccagtaacgttagaaccgataccacctggagaaggagcccaagagggagagcctctcacagttgaggccagatacaagtctttttcgataaaaatgctaaaagatatgaaagagggagtaaaacactatggacccaactccccttatatgaggacattattagattccattgctcatggacatcatagactcattccttatgattgggagattctggcaaaatcgtctctctcaccctctcaatttttacaatttaagacttggtggattgatggggcacaagaacagcaagttagagctatctgccttagagcctgggaaaaaatccaagacccaggaaccgcctgcccctcatttcatacagtaagacaaggtttgaaagagccctaccctgattttgtggcaaggttccaagatgttgctcaaaagtcaattgctgatgaaaaagcccgtaaggtcatagtggagttgatggcatacgaaaacgccaatcctgagtgtcaatcagccattaagccattaaaaggaaaggtttccacaggatcagatgtaatctcagagaaacgagcaaaggggccagcctcaggccccacaacaaactggggcattcccaattcagccctttgttcctcagggttttcagggacaacaacccccactgtcccaagtacctcagggaataagccagttaccacaatacaacaattgtcccccgccacaagtggcagtgcagcagtagatttatgtactatacaagcagtctctctgcttccaggggagcccccacaaaaaatccccacagggttatatggcctgctgcctgagggtactgtaggactaatcttgggaagatcaagtataaatctaaagggagttcaaattcatacttgtgtggttgattcagactataaaggcaaaattcaattggttattagctcttcaattccttggagtgccactccaggagacaggatttttccatttttactcctgccttatattaaggttggaaatagtgagataaaaagaacaggagggtttggaagcactgttccaacaggaaaggctgcatactgggcaagtcagatctcagagaacagacctgtgtgtaaggccattattcaaggaaaacagtttgaagggttggtagacactggggcagatgtctctatcattgctttaaatcagtggccaaaaaattggcctaaacaaaaggctgttacgggacttgtcggcgtaggcacagcctcagaagtgtatcaaagtactgagattttacattgtttagggccagataatcaagaaagtactgttcagccaatgattacttcaactcctcttaatctgtggggtcaagatttattacaacaatggggtgtggaaatcaccatgcccgctccattatatagccccacgagtcaaaaaatcatgaccaagatgggatatataccaggaaagggactaggaaaaaatgaagatggcattaaagttccagttgaggctaaaataaatcaagaaagagaaggaattagggtatccttgttaggggcggccactgtagagcctcctaaacccataccattaacttggaaaacagaaaaaccagtatgggtaaatcagtggccgctaccaaaacaaaaactggaggctttacattcattagcaaatgaacagttcaaaaagggacatattgagccttcattctcgccttggaattctcctgtgtttgtaattcagaagaaatccagcaaatggtgtatgttaactgacttaagggccgtaaatgccgtaaatcaacccatggggcctctccaacccggattgccctctctggccatgatcccaaagactggcctttaattataattgatctaaaggactgcttttttaccatccctctggcggagcaggattgcgaaaaatttgcctttactataccagccataaataataaagaaccagccaccaggtttcagtggaaagtgttacctcagggaatgcttaatagtccaactatttgtcagacttttgtaggtcgtgctctttaaccagttagagacaagttttcag

SEQ ID NO: 467832 - DNA, 1148 bp, Homo sapiens
gagcaccgtcgagtcacaagatgaacaaaatgatgatgtcagaagaacagatgaagttgccatccaccaataaggcagagccgctgacttgggcacaactaaacaagctgacgcagttagctacaaaatgtctagagaacacaaagatgacacaaactccagagagtatgctgcttgcagcattgatgattgtatcaacggtggtaagtctccctatgcctgcaggagcagctgcagctaattatacctactgggcatatgtgcctttcccgcccttaatttgggcagtcacatggatggataatcctatagaagtatatgttaatgagagtgtatgcgtacctggccccacagatgatcgctgccctgccaaacctgaggaagaagtgatgatgataaatatttccactgggtatcgttatcctcctatttgcctagggagagcaccaggatgcttaatgcctgcagtccaaaattggttggtagaaggacctactgtcagtcccatcagtagaatcatttcttacatggtaagtgggatgtcactcaggccacgggtaaattatttacaagacttttcttatcaaagatcattaaagtttagacctaaagggaaaccttgccccaaggaaattcccaaaggatcaaaaaatacagaagttttagtttgggaagaatgtgtggccaatagtgcggtgatattacaaaacaatgaatttggaactattatagattgggcaccttgggtcaattctaccatgattgcacagggcaaactcagtcgtgtcccagtgcacaagtgagtccagctgttgatagcgacttaacagaaagtttagacaaacataagcataaaaaattatagtctttctatccttgggaatggggagaaaaaggaatctctaccccaagaccaaaaataagaaatatccaaggggggctgttagagacaagacttatgccagacttacgatctcctatatatatgctaaaaatgtattggtattcttttgaaaaagaaaagcaaaagaattcaagtattcacccaggaaataatacaactaggttattgtgtttgggctcatataaacacagaaacacagagaaatcagcacaaactccttttgcaaaccagttaacgtgatttc

SEQ ID NO: 467833 - DNA, 679 bp, Homo sapiens
ggcacgtgtgggcaaggtttgcaaactatatcttcaaccagcttaagaaacaaagaacctccagtttccttggacaacttcttaggagaggaggagagattgtaaagcaacaataacaacaaatttctcagctaagaaagtctcaaagttcccgctttctacaagattgttcttgttttagaaaggaagactggatcatgtagcaatgactgctggtgacctattcaatgtccaccaatattcttctgtattaccgaaactctgcttcttttggagtatcaatacacttcattttccagcttttgttgcaaccagcacagccatatttaaaaatccagttgagatacatctggaagactttaaaaactgggaaagattctcatctggatgggatggtttaagtgtgatgctgcttgaatttggagccaacggccataagatctttccaggccctttttttgaattgccagagctctatacccttataccagtgatccttacttgggagtggtttgggtttcccactcctcccaggagacatttggcaatatctgaagtatcctacaatgtgcaggacagcccctacaacaaagaattatctgttcccaaatgtcaacaggccaaatttgagaaatactgccttatgttaacctctttttgaacctgagttactttgcac

SEQ ID NO: 467834 - DNA, 669 bp, Homo sapiens
ataattaatcttttctgcgttccgcaaggaccatcctctgcagtgttcagcatttggctgggactttgacgttttgttatcgccatcactctctttgttttttggaaaagaagaaaaacccatccgtggcacatggaccctacacgggggcagcatcccataaaatgacatgctgtgtatttgccaaagaagaggacggtgtgcacgggaagttgtgggaagagattctggcaaagctgatgcaatacgtggttatggattagaacaaaaaggaaacaaagctgacccttccaaatgtggggttctgagtgaaaagagccccaagcaaccagttcacccgcgtcaaagggagaacatagtcaagagtggctatgcagaaaagattagcagcaacaccatcaaggtcatcgtcatcatcatgctcattgtcatcatcatcacttctgtgaagattaatcagacacctgaaataagtcaaaagccccagaaaaaaataaggtgcatagatatgtatcacacagaacatagcattacccctgcctgcaaaaagacagcaaagagaaagggaatgcttgtttaatgttctgagtgctgggccttgtgctaagtacttctgtggcatacacgatactgggccttgtgaagaggttaataggcaaaaggcttgag

SEQ ID NO: 467835 - DNA, 558 bp, Homo sapiens
tcctgaatagatggtctggactttgaaatgggggatacttggtacttccccaccgccaaacggaggactcaggcctcggctcagattgggcaagaacaaaccacacccctgccatcagccaagctccttgcctaccctgagtccatagctgccctttccagaggagacctgagggtgcacccacgtaaagggggcaatttcaatgcacaaaagaaatactactatagctgtgaaaaggaggcccgtgacatggggctgtgttttcctgtgatattagcaaccgatgatgattattgtccaggtatggaaaatgttatctgtagaaggaacaaaagtcaaacatatgatgtgtcaacgaatgactttcactttgattttgaaaacaccaccaagagtttggaatggaaagtcaagataagcaagaaattctaacgcacattgatttgtcctagttcttcagtttgggaatccttttgtcttttattcaaatgcagaatccttataatttgttattatttaaccatttcttgatgagcacctagaaataaacttctcttc

SEQ ID NO: 467836 - DNA, 930 bp, Homo sapiens
gaccacacataccatttgcctcaatatgtcaaccaagcaagttcctgttttttatgacgacatctgtggacctaaacttggcactcagcatagcacatctgtgccagaaattgcaaagtatctggcagaaaagctaattaggccaactaatcttcatggcagtaagtgtctttcatataaccttgcctctgctttctccaaccagttgctgttggttctgcctgcagatttctgggccaaccccaaaaggggcaagaagcagaacagaatcctcattcttgctgctaacagatttaaaccagctctcacaagtgcctctaatgaatttggctgcttattgggcttatcaaatataggaaagtttcctcgtagagtggaagaatttcaagatgtcttcagtactgcatcacctataaatctggacttcattatgaatcacaaccaggaggataggcccgtgaatctacttccctgtgactaaattattcgttttattcatactattttctccctagaccaatagttcccaaactgtactaggataattcctgggacaaatcatctggcttgagaggtgggaaacagccaatacagttagccagctctacagtagccttgaaaacaaagagccctgtgatcataatgaaaacaatcatcctagaagctctgaagaagggagaatagctttggagctcccctaaaacattcccagagaactaccgtcatttgcctagaagttccctggaaacttcctctcgaaggggttgtctttatttggcctgaaccagtgatcactgactgtgaacagccattctccagatgtgtttgtcaaaaacaatcagcagtaactatttaacattaaagctgcctaaagctgtgataacatttggagacaaaaagaagctagccaaaaaaacttaaaaggaaaat

SEQ ID NO: 467837 - DNA, 791 bp, Homo sapiens
gatttcatgacttacaagatttgaaagtggacagactgacagcttcactgctaaggagcttctaagctgaaatgaaaactggaatcccagactttttcccacatctgcctcccactctctcatcaattagctgaacccaatggaaagccaatggacctgggagcccgggaagcacagaccgggagtcaaccctcctggatacagagcaaggcaggggcaggatgaggaatggatctgtgggcagcagacagagagaggcccagcatagagagtcagagatgctgtgaagaggagaggagaggagaggagaggagaggagaggagaagagaggagaggagaggagaggagaagagaggacaggagaggagaggacaggagaggagaggagacagaagagaagagaaaaggcatccaagcaaggatttgaatcccttcaaaatctattgattgaaatgcagggagaactagggtatccttcagccatttccacagaagctaaagagagtgaactgattaccttgaaaagatctgtggatgtggcttttatcaaatacagtgacatccaggagcaagctgacaaaactactcaactgcaaacaggagctacctttcatgaaaaaggaaagatgattcctaggatggaatcacaagccccggggggagatccaagagcctgggaaaattattctgcaatcttgaaatctaatcaagaaacttctatttgctcagatgcattttggaattgcctttaacaggtggcttttacctttcatttctccattttttgaac

SEQ ID NO: 467838 - DNA, 531 bp, Homo sapiens
cctgcctctacaacccattattctgttctagatctcaaacatgctttctttactattcctttgcacccttcatcccagcctctcttcactttcatttggactgaccctgacacccatcaagctcagcaaattacctaggctgtactgctgcaaaggttcacagacagcccccattacttcaatcaagcccaaatttcttcctcatctgcctaatcgccacacaccagcaaaggcaggttttgctatagtacaagccactagcccacctcttagaacctctcatttcttttccatcgtggaaatctatcctcaaggaaataacttctcagtgttccatctgctattctactactcctcagggattattcaggcctcctcccttccccacacatcaagctcgaggaattgccccacccaggactggcaaattagctttactccacatgccctgagtcagaaaactaacatatctcttggtctaggtagacactttcactggataggtacaagcctttcctacagggtctgaga

SEQ ID NO: 467839 - DNA, 660 bp, Homo sapiens
agggatgctttcggtgcaccccagtgaggccaagagcttcatctgtgagtgatgcctccttggggcactgttatcctttccgttgtgccctttagtgctatccccagagaacaggggcagaacagcaaaccttgctccaacgctttgaacaggagtacagctttgagtggcaaccttaatgtggtccccaacaatacgcgtctgactctagactacaggaaatggctgccatatgcaggcaaagaaaaacaggacaggataacgctccctgcgctgagcacctcaggtgcacctcagctcctcaagtcactccttgtgccatttgtgatgccaactggactagtgtatcctttctggcctaagaaggacatgatgaccagggacacagaccccccagggatgagggctgaccaccccaccagaagagaggtcagcagcaagctggagggcctgtttcttggtgtccatggagaagtctatccgagcagtgctgagatggatgaaagggaacacagaggtgcccaaccaggcccccaacgaaggacatagccagctgctgggagctaacagcagatagactttagccagagttgtattctggttggcctcagctgtagagaactacctcacccacttggatacccttcttcacaggatcca

SEQ ID NO: 467840 - DNA, 600 bp, Homo sapiens
agacacgggaatgaggcatcagatacaaaccagcccccagctgactttctgtgaccacaaatgcatagagctttcttctctaaaatttgagaagtaccagggtttccctcacatgcttccccagggacctggctgttggacatgctttctcaccttctcatctcctaaagatgtggataaatttaatctgcaatggctttcgtggggcctctctgccatgacttgtctgtctgcacacagcaaaggagccccaagctttggagtgccttccttgaaattgtctgtgtcccactctggtggctgtgaccagcaagggctggcagggttccccgagtttggatctgctgccaaatgggtcccagttgttggaaatgcataccttgaaattttctacgtccccatgcagtacctgggactggcggggccagagctggcagagctatcttggtggtgtaccctgaggacacctctgagatgactgttggtcccagtcctgtttccttttatggatgcaatgtcttttccttttctgccagtggttcctttctgtttgcttgtcacttagttctctgcattccatgttagaggctgtcttcacac

SEQ ID NO: 467841 - DNA, 620 bp, Homo sapiens
aggaaccgtctttgaaattccgtatgtgtgaaatgagcaagttcacctctccaagcaccagggtaggcagcggtctgtggggaagtgatggcactgggttccgctggcagtcgcatgaaagggcaggacctggaggaggcagcctgggcatgaagtctcagcaagagccctgcagggagatgatgacaccctggaccaccggcgagtgtggggattactcactcagcattgctgatgcagtctggacaggaattagtgacagattaaatgtcagcagaggcagggatgatggtgtgcaacagacacatgaggatgaacattgccaggaagagaactctccttccattgtaacaagagaaaaggagggtaaaatgggaaccaacatggagatattagtaaatgtggagaacagcgagaatgggcatttcctgagagataaaaaagacaagctcaacaggattgaaggcccccttaaggttagtgaacaattatttactgtaacccccatttgtagaaattgtatctattcagtagcctgagctaatgaatgtttattcatttgacacatattttttgagtgcctattatgtgtcattgtgatagaatctcagagaaataaa

SEQ ID NO: 467842 - DNA, 555 bp, Homo sapiens
tcacagtgactccttacccccgcaatgcaatgtgagcgtaacctatgtcattggctaatgcctccccatccccatctgtttccggatttcccttacatacatgacattttatgtactttgcaccataatgctttctctttcacatctgtgcttttgcacatggtttctccttgcctgcaaaatctccccctttcccattcttcaattcaatccttctatttctcctccaagaaagagtgtagacatcaccttctccaagaatcatccctgatattcccaattatcttaattcctggttggattagatgctggtatgttgaattttcaaaagcattaccgaaattgccaaatgttacctgggtgagagggggtgaaattgcccctggagagaaccgctgtcatgcacacctagaagttagaagtgccagattagaagtgccagagtctctggactttcaattggtcatgttttagacatgaaatgtcacgaagataagcattttaatgaaatttctgaaaacacaaattttattaatagcttgtgttcctattgct

SEQ ID NO: 467843 - DNA, 691 bp, Homo sapiens
tccaacagccaacagagtaggtggccagtgaattcgttgctgatcatgggtcttgtcaagggccctgctaccctgcacagccttacagccttggaacaccgcttcccacatccaagctgcttcagctccagccagggctcaaagaagcccagggcagtgccaaggggaaatgtggagttggaacccctgcacagagtccccaatggggtactgcctactggatctgtggaaagagagctgccactctccagaacccagaatggtagagccaccatcagtttgcaacctcagtgtggaaaagccacaggggtagagctgcccaaagccttgggaacccaccccttgcacctctgtgccctggattctctgtatcccaagcggacactacttcactgctactactcagaggctcaaagttctcaagggagatgctttcagtttggttttgcagtaaactgtcaaccctgcaggcctaagctggaaggcaaagccccagggctcattcaagcaggccagagcaagaatggcatgtggtggtgagcttagaggctttgtatttatgcaggaaagaaaatgctggcacttggagatcacaggaaagccagtatattacctatttaataacgatgtttaaactcccactgttctatgagagagagatgtaaaatatcacttaagtgtagctacagat

SEQ ID NO: 467844 - DNA, 543 bp, Homo sapiens
ctgtcttcatcacaccagttttggacattctcttccttggccaaggtgcaccagtatgaattcaaattcaaggccattctacaaactaattgaccagtacactctaaaaagtgtcaagatcatgcaagtcaaggaaagtctgaaaacagtcacagaagtgaagctgccgaccttcacattgagtgttacagctcttaacgcagtgcatctggagttgtttgttcctcctggtgggtttgttgtctcgctggcttcaggagtgaaactgcagacctttgcggcaagtgttacagctcataaaggcaatgtggacccaaaaattgtacagcagcaaaatttgttgccaagagcaaaagaacaaacttttcccagtgtggaaaaggaccccagcggcttgccactgctgactccggcagcctgcttttattctcttatctggccccacccacatcctgctgattggtccattttacagagagccgattggtctgttttacagagagctgattggtccattttgacagggtgctgattggtgcattt

SEQ ID NO: 467845 - DNA, 1649 bp, Homo sapiens
tgagcgtggcactgacacctcgtggagtttgacctttctagaaatgaataatttgatttctcaggaaagtagtgaacgtaaggtggcaatgcaacaagtggcctcattccctctcctttgcttcctggacttctggatcatttcagaaagactctggctgctaggcatgcttacctctaaggcagaccccaaacactgccaagaacaggacacgcagaagctcagaggaggagcaaaacaaaattatcagaggctggggacagactctggcgctcaacctgagctggggactccaggttccctgaatataggagaaagcagagagaaagataagaaagtgaactcagaatcaggaaccaggaaagactgggatgaatcaggaaaaagactaaaagcaaaacgagagaaacagggtcttgctccgtcacccaagctggaatgcagtggcgtgatcacagtacactgcagcctctacttgccaagcaccatggtggttgacaagaacaagcgccttacgaaaggtggcaaaaagggagccaagaagaaagtggttgatccattttctaagaaagattggtacgatgtgaacgcacctgctatgttcaatataagaaatattggaaagacgctcgtcaccaggacccaaggaaccaaaattgcatctgatggtcgtgtgtttgaagtgagtcttgctgatttgcagaatgatgaagttgcatttagaaaattcaagctgattactgaagatgttcagggtaaaaactgcctgactaacttccatggcgtggatcttaccagtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccagcaggtcctgagaaatccggaagacctcttatgctcagtaccagccaaatccggaagaagatgatggaaatcatgacccgagaggtgcagacaaatgacttgaaagaagtggtcaataaattgattccagacagcattggaaaagacgtagaaaaggcttgccaatctatttatcctctccatgatgtcttcgttagaaaagtaaaaatgctgaagaagcccaagtttgaattgggaaagctcatggagcttcatggtgaaggctgtagttctggaaaagccactggggacgagacaggtgttaaagttgaacgagctgatggatatgaactaccagtccaagaatctgtttaaaattcagacttcaaatagtgtcaaataaaaagtgctatttgtgggaaaaaaagagaaagtaatggtatgttttgcagtttaggttattgtattttatatatgtcaggcgatgtatactaaacatgttgtttaagtattctcatttttaaatttttgtttatttactctttcagttatggagagaagtatattaaaaatttcacactacagttatggactctttttttctcttaggtttgttaattactaaattatttattttaatgctataccattaggcacatacaaatttatattttttcaattgtactgattgttgactttttgataattatgaaata

SEQ ID NO: 467846 - DNA, 924 bp, Homo sapiens
ctattagaagccgtgggtcacggcagagaactgtggaacccagcgactagggttcagctcgattaggacaaacctgggcacttagccatggaggaacaatggcaagcctttagcctgatcgggagtggcaatgggtgcctcactggatcgggagcacagcggacaccctgccagatccggaggggtggaagtcagcggcgggtatgcgagggcggcaaacagcagtggtggatgtgtataatggcccctgcttttgctagtatgtctctccctaacaaaggagtggggctttcaggcataattagaaaggcatgtgaaaacagtaaagttccccagtcacaacttagtggctgggagaagtatctagtgactgcctgtcctaggacccctcggatagtgacagatctggaggacagttgtccaggacaggagagaaagactgagaaggccgcgccagtgtccaggagacagttaacctcctggcccttaatggtcaaacatacccgggggctctgtgagggtgatggcatgggctggcacttgcccccggcaccctcagtcctgctgctggatcatctgattagttacgctcaccgacgtagcagtcctgcatcctttttcccacatttcttgaccacaaagaaaggggtctgggctgctggattcgaatggtcctttaccagtgtgcccaacattgcctttgtgctcagggatgagtcctagagcagggctgggttcctgagtatttcataacaacccagttgccccatcaggatgcattcccataaacaacagttcttgtgcaaattcgtttcagagagggtgtaggtaaccttttgagtcaggattgagatagagttttttgattctccctttacaaacatgggggcctggcaagggtggtggggaacaggtcccatataa

SEQ ID NO: 467847 - DNA, 1725 bp, Homo sapiens
agcccagtgttttactaatattgggaaggatgcacttgctcagaggagagttttggcaggtgcgctctgctggccagatgttagagggttatggggaatgggttttctttggggatgatgtggagcttacagttgtatccaagagtgtcttcctgaactggccagcctaccagaaatgccggcagcctgactgtggggctgagattctctccagcctggtggtggccctgcatgacaacccctgggtatgtgactgtcgcctaagggggcttgtccagtttgtcaagtccattaccctcccagtcatcctggtgaattcctacctgatatgtcagggccctctgtccaaggcagggcagctttttcatgaaactgagcttagtgcttgcatgaagccacagatctcaacccccagtgccaatatcaccatccgggcaggacagaatgtgaccctgcgatgcttggcacaggccagcccctcaccatccattgcatggacttatcccctgagtatgtggagagaatttgatgtgttgacatcttctactggagaagacactgctctgtcagagctggccatacctgctgcccacctggtagacagtggtaattacacctgcatggcctccaactccattggcaagagcaaccttgtaatctctctccatgtccagcctgcccaggccctacatgcacctgattctctttccatcccctcggagggcaatgcctacattgacctgcgggttgtcaagcagacagtgcatgggattttgctggagtggcttgcagtggctgacacctctaaggaggagtggttcaccctctacattgcatcggatgaagccttcaggaaggaggtggttcacattggccccggaatcaatacttatgctgtggatgacctccttcctggcacaaaatatgaggcctgcctcagcctagagggccagcctccacaccagggccagtgtgtagcttttgtaacaggcagagatgctggtgggctagaggcacgtgagcacctcctgcatgtcacagtggtcctgtgtgtggtgctgcttgcagtgcctgtgggcgcctatgcctgggcagcccagggcccctgcagctgcagcaagtgggtcctgcgcggctgtcttcatcgcaggaaagcccccagctgcacccctgcagccccgcagtccaaggatggctcctttagagaacatccagctgtctgtgatgacggtgaagggcacatagacactgagggggacaaggagaaaggaggaacggaagacaacagctgaacaacccaggccatggggtggaaacggcttgggcttcaagcctctgaaaccaaccctctgcagcagctccatccatttatccagcaagtatatattgagcacccactgtgttccaagcactgaacttgacacagggggttcaagagtaaaaagggaaacagagtctttatcttcatgataaaggggacatagtcattatcttcgtaaagttaaagtcaatgaagatttgtccatcaaattaatcattttattatacatggtgattagaaatcactaaatattactctttgcatatacttagcctataacatttacatgcttatacgtaatgtctacgtataatattttacatatattatcctgtaaacgaaggtagacttctacccactttttataggtgaaaaactgcagcctggacagttcaatgatacac

SEQ ID NO: 467848 - DNA, 1251 bp, Homo sapiens
ctcatcacacgaaatcagttttactatgacgtgcctaagcatacttttaaacgccttctttggctttcttctctctggaatgttcccttacttttctgtggccatggctgccatgcctcctctttcctctggccagagagatgacaagttttctttcagaagccactccaagtcatgtcatgcccacagctttcctgtggaccaaagccacaaagaggagggactcacctggcgccaatcccttcttccaaatttcagctcccttgcaaattctgttcactcctcagaggcatcgggagaaccttgctctagactgggaaaaattatttcttcaagtttctttaagacacactctttttttcctgtaatattcaataatttaggcttttggaacattaaagccagaagccatatgagctacttttgtttccccctgctaaatgtttcccttggggctgtgagctcagagctggtgaaaggcttgtttaaaggagaaacgagaaggtcagggaaagataaaagatagcaggaagaaatcccatagcttgatgtttccgaatattattcagacacggaaaatgtcttcttcctctctagtcccccagtatgtatctcgatgccttgcatgtggtgatttctcaacaaatatttattaaatggatgaacaaatttgctgtgtaatattgggcaagtctcatgacctgtcattttgttctctgagctctaaaatggggataatgatactgatgtcacagtgttgctgtaggatcagatgtgattactcacactttgtaaagagttttctaattataatgttttgtcactgttattatgaatgttcttcgagctgagagagtgcttggcatctttgtccaaactatgggtgattccagacagaactagtcaactggaaacaggcttttaccttttccccagagaagctgcacaacttcaatgaattgttttgttctccgaaattatttatcctcctgatgacagtttttatgtcagtttgcttggtgattcctgcatgatgagaattgattttggattagattcttcccagcatggagtaaccggtacagtactgagaaaatgataataatattgtatctcatcttaaaggcatgctttggctatttgcatattttagttagaatttaaactgagttctaatcacatgaaatgttaaggtgtactttaaatgtacgttttgagtattcttaaaaagtgctttccaaactgcctgac

SEQ ID NO: 467849 - DNA, 1181 bp, Homo sapiens
aaggaggagctgcacctgactgaatgttctcagttccaaattgaaatttcctgaagaaagatgtccgacttgcttatcttgagtcactcctggaccaatgatctggaaccagggtctttaattgatctaacagtgggaaccccagtcactcaaccacaaactttaaatacaatgggaataattggatcccgaggtggcaggggtcaagtggcagcactcaaccgtcaaaggcaagggactactgacactggccctgagctgacgttgattccagaggatccaaaacattattgtggtcctccagttaaagtgggggcttatggaggtcaggcccaccagaagcaatttgccttcagctggcaaggccagcaatgtacttttactttcctacctcagggatatatcaactctctggctttgtgtcataatcttattcggcgagatcttgatcgctttttgcttccacaagatatcacactagtccattacattgatcacattatgcgattggattcacctgcactgacggcttcatggggagttctctatgatcagctgatagaggaagagaatactagggactggttcacaggtggttctgcaccatatgcaggcaccaccccaaagtggacagctgtagcactacagccccgttctaggacatccctgaaggacagcagtgaagggaaatcttcccagtgggcagaactgcgagcagtgcacctggttgcgcactttgtatggaaggagaaatggtcagatgtgcgattatatactgattcatgggctgtagccaatggtttggctggatggtcagggtcttggaagaagcatgattggaaaattggtgacaaggaaatttggggaagaggtatgtggatggacctctctgaatggtcaaaaactgggaagatatttgtatcccacgtgagtgctcatcaacgggtgacctcagcagaggaagattttaataatcaagtggataagatgacctgtgctgtggacaccactcagcttctttccccagccacccctgccatcgtccaatgggctcatgaacaaagtggccatggtggcagggatggaggttacacatgggctcagcaacagggacttccactcaccaaggctgacctggctatggccactgctgagtgcccaatttgccagcagtagagact

SEQ ID NO: 467850 - DNA, 571 bp, Homo sapiens
ggacctggctttatagctgtgaaacaatatgcttgggagaggtggacagctgcagggcatggcctctaagcagggtggagaggagactatttggaagcacagtggagggtgcggcgaggaggacacctactcctgtctcactgggagagtgagcaaaatatttatgccagagctagcaattcagagactaagaagacccaatgtgacattagatctagctctgcttcatgtagtgaaaaacaggaccaaggcactcagtcccccagcttccttcacagcagcatccttctctggggactcctttggatggagggagcttccttgttcaagtttatgtctcctctctgcggacagcctgcagccaggactggtggatgaaggtgtacagagacctgaggggccaccatccatgttctcaaggtgtgcactgcagaggattcacggaaacatgggtgggaagggcaccactggagctgggcaatgcatagcccatttccctgtgaggctgtcctgtggagctgtttctggaaactgagcaagtcctgcttgctctttctcccctgaacatgtt

SEQ ID NO: 467851 - DNA, 544 bp, Homo sapiens
ttccctgtgtgtgccagatagatgctaggtgctttccatacgcaaaataagatgctgtcatcaccccaggaacagctggtggactccccattgggatctctgatgatgacggggggagagcagcttcgttgcgggagagagcagcttcgttgggtaggagagcagccacgcagggtggaaagcacaatcacagcaaagtcagaacacagacagcatgagaaattcaaggtcgcaaatggagctgtacaaaggacatgcctgggatacctgaaaagaggaggctctgagaaatccagtgacaatgagaccatgttgcatctaacagctgagtctgactccaggcccatcactagttccaagcttatcatcatcatcatcatcatcatcatcatcatcatcatcatcaccatcatcttttttgagcctatgaggtgtcaggactaagacttatagagtatctcattgaatcgtaaaaaataacattctgaggtgaatattaatattatttattcttgctaggtgaggaaatcaaggctcagagagc

SEQ ID NO: 467852 - DNA, 914 bp, Homo sapiens
gataatgggagtaatattgactctttcacaggccatttggtgtccaagacacacagagccacggaatctcacaggtgtctgagaattcctcctcctgggactctcagaggacccagaactgcagcctatcctcgctttgctgtccctgtccctgtccatgtatctggtcacggtgctgaggaacctgctcagcatcctggctgtctgctctgactcccccctccacacccccaggtacttcttcctctccaacctgtgctgggctgacatcggtttcacctccgccacggttcccaagatgattgtggacatgcagtcgcatagcagagtcacgtctcatgcgggctgtctgacgcagatgtctttcttggtcctttttgcatgtatagaaggcatgctcctgactgtgatggcctatgactgctttgtagccatctgtcgccctctgcactacccagtcatcgtgaatcctcacctctgtgtcttcgttttggtgtcctttttccttagcctgttggattcccagctgcacagttggattgtgttacaattcaccatcgtctagaatttggaaatctctaattttgtctgtgacccctctcaacttctcaaacttgcctgttctgacagcgtcatcaatagcatattcatatatttcgatagtactatgtttggttttcttcccatttcagggatcctatggtcttactataaaatcatcccctccattctaaggatttcatcgtcagatgggaagtataaagccttctccacctgtggctctcacctagccgttgtttgctgattttatggaacaggcattggcatgtacctgacttcagctgtgtcacaaccccccaggaatggtgtggtggcatcagtgatgtatgctgtggtcacccccatgctgaacc

SEQ ID NO: 467853 - DNA, 2139 bp, Homo sapiens
ctagaaaaggtgcaacggattttcatgtagcttgtaccagatcacgaagtcaaaaagggtgactgcagcaaagggtgcagcgggaggcggctccagggacgtctttggcttccatcatgggggagcagttggagctatggcggcagcagctgtcactgggcctagcctggggtgtggacctggggactccccagaaggccccgatgtggaggctcacggagcgtcggcggaaggcgcacaggatgctaaagctttacaacggcctctcagaaggggaagcggtgggactccctgcagggcccgaccccctggaccccactgatctgaacggggcacactttgacccggaagtttacctagacaagctgcctagagagtcccctctggcccagctgatggacagtgagacggacatggtgcagcagatccgggctctagacagcgacatgcaaaccctggtctatgagaactacgataagttcatcccagccacagaaatgacaaacagcataaaactgtatgaggaattgcaggagacccggaatttctcaaataaacttgtaaaagaggaacaaaaagtgaagctgcagaccttctcgtccccaacagactcaggagcccagctggcttcacccagtggattctgcacaggagctgcaggtggagctgcctgccagttcctctctgtgcacccacactcctcagcccttgggtggtcgatgggactgggcgccgtggagcagggggcggtgctcgtcggggaggctcgggccgcacaggagcccatggaggggggaggctcaggaatggcaggctgcaggtcccaagccctgccccacatggaggcagctaaggcccagcgagaagccgagcacagcagctgctggcccactgagggagccagctccgaccttggccagcccagaaaggggctcccaccatgcagccatgggctgaagggctcctccagtgccaccaaagtgggagcccaggcagaggaggcactgagagtgagcgagggctgtgagggctgccagcacactgtcacctctcataaggagtgattaatctgagcttctccagaaagtccattcctggtaggcactgggaataagaaatctcagagtataaaatagcatcaagtggtagcacttttgtgaatggctcccaaattagatcccttacctttttttttttcatgaagcacagttgcacaaaacacgcttaacctgagatgaagcacatattagagaaaggttctctctatagaattatgtattactcgaatgagcattaaaaagaggagatgggacatgctctctctagctattattacctccactatagagttgacatacacaagctcattattgcattatgttttattcaacaaaataactttaatgttgaagcttaaattgaatttgttaaaacatctttgtctccagcataatgtgcctcaagtgtcttcttggtgcctgaattttctccagaattatagtgctgaagctatggaaatggtgaaattatatgcaatctgcaaaacaatgtggctataatgtggtaattggccttccgcataattaaaggaacatttcctcatcagagctgttccatcagagacccaaaggctatcgttgtacaaatcacccacttaggaaaacctttattcccagtagcctataaaaatctggttatgcaaacagatttgcttattcagtaacattaatggcttctcatagttaaaaagtcatcaatgtgattgacctataccctgtttcctctgtgaccaagtgtcatttttattttgacagttaggagccttttgactctttcacagctggcatgaaggcacagggagggaaatctcaaaaaccaacaacctgcgtattcccagcctattaatcaatagaaaatcactcaactggattagggtcttgtacctggcagaaaggctcttatggacattggaattggatttttacacttgatatgacacctccttgagtcagatcagattcgtgtttgatagactcttgccgaaaaattgctccaggcatccccagtctcccctgtctctcctgcttttgaggtgggccaggagctgctggtgctcagcctgtcctggactcttggtgt

SEQ ID NO: 467854 - DNA, 2068 bp, Homo sapiens
agctgcaggactcctggttcctggaacggaagcttccagttcgctgcctggaaaagagcccaggcgatgaggagccctgctggcactgttcactgctgttcgtcgccgcagtgccacttggagcagccggcgctcctgggggcccagagcccggacagctgagcctcggcgagcacccgtgctgtgtctgtttccgtctttgaaatctcagcctcagtctgtcctctcttgggtgctttgatatcagccgtggcagccctgagagccaggtggagtcgttctttcatctgtccctcttggctgccagccctggggcccgtcggacatgtttagagcagagccgcctggggagagcggccccatccgtcagagctgccaccgccgcagccccgagtgctctgccaagagctctttctttctggtggagctcagtgagtatgtgttgtgtgctatggaagcggcagctctgtcaggagcggggcaggtgacggccaggccctcgccctgcctcagcctgcaggtcgtcgtagggtgcagcatgggactgcagcatgggactgcagcatgggaccgcagagggagcctggccccagccattgctgccccctgcttcctgtgcctggccatcgcctattctgtgccgtgctgtgaagatggcaggaagtgcctggaatggtgccagccagaagggctgcagactggtggcacttgctgggaatgtgccattcggcattagcggtgggtatggttcttttcacttgtcaatttgaaatgatttcagactttcagtaaagttgcaagagtaagacaaagaattctcgtacccctgaccccagttcccccaatactagcatttgcttcattgttcccgtttttccctgaaccatgcatcccccctgggctccttcttggctcttcctcctcggccagactcaactccagtgggcctgaagacgcaggcctgacccacttctcccaggctgttctctccctggcttcagacaccaccgcccctgtgatgctgcccaggttcttgtccctgctcttccccctctgtgagcttgcctcactcccagccctgccttttctgtcttgcccttcttatagcaggaaaagtcatctccacccacccatacaggatttcttcctctaccttgctttctatggggggtctctcgacgaatcttgtctgtcatagcccagatgtttcctaagccccaccccgacccccatagcttccccctgtcagaggctccgcgtctctcagctcagcctctgaattgccccagacatgcgtcgtctgtcagcccctgctgctcgccagtccagagagatcctttccactgtgcatcgatcatgtccctcctgtcctgtccatggctgaagggaggcctcaaccactgggccctgtctgtggctgcagccccacctcaggccgtgggctcacacttccctctctcaggacagcaccaagcctgttcttcctgagaacttcacaattgctatcccttcttcctggagctttctctgcggatctgtgcgtggccgacttctccccatccaggtcccagcttctgtgtcccctcctcagagaggccttttctaatatccagcccccaaacccctgcacccgccccagatcattcgcaaaatgtcacctgtttcttatcttccaggcacttgtgatctgaaatgttctgatttgtgtcttgtttttcttttctttgctcctttcactgccattcatcttccatgagcagaacccttcactgttgtgttctcgactcctaaggcttagaactgtgcctggcataaggtctgcccctagtggggttttctgtttttctcccctggctgtgggtctttcctcctcctcctcttctctttcttctacttatttccttgtttcttctcttttctttttcttctgtctttatttccccttttctaggttgttggctgtaatatggcactaaggtttttgcaatatttgtttcatttcttgagtatgtttttatgttccttacttaaaacaaaatggctgagtcaagtgttttaaacgttttct

SEQ ID NO: 467855 - DNA, 889 bp, Homo sapiens
cttaagaaaaggagcagacagccacagccatgcggggacgatgctggaagacatgtagccatcctgacacattggagcccatggcaggatccttgggctgggggaaatggaaagatagtgtttgtgctgattttctgttcactaatcgggcaatacgattggatgggaagttgggagaatcagtaataacaggggcccctggaatgacacaagccaatcccagacctagagcatccctgcagtgcctgggccccgtttctcctcttgtagcacccagtgactgtgggggccactacacagatgaatatggcaggatcttcaactacgctgggccgaaaactgaatgcgtctggatcatcgagttgaaccccggggagatagtcacggtggccattccagacctcaaaggattcgcatgtggcaaagaatacgtggaagtgctggatggacctccagggtctgagtccttggacaggatttgtaaagccttcagtacattctattactcttcttccaacatcatcaccatcaagtactccagagaacccagtcatccacccaccttctttgaaatatattactttgttgacgcttggtcaacacattaataggaagatcgggggaagaggcacctgctgatgctcccctgctctgcctgagcctggttctgcatatgttggacagaggctatacctgggactgcagaaataagattgagtcatagttctcctggatcagcattgggtgagggagagggaatgtgaccctgtgacccttccagaaaaaggtacgggttctgtctcagcatttctgtacacccacatctttagtgttagaagatcatatgtgaaaactttatctttcctgtcttcttgatatagaagtgggt

SEQ ID NO: 467856 - DNA, 1296 bp, Homo sapiens
atcattcaatgtcttaaactcagacctcacaatagcccccagcttattgccggagtatgatcagagaatggaagaatgactgtcagaggattgaaaaacagagggctagtgacacaatggtgcaagaaaggaagaatgaaaagccagttagaatatttaataccaactcttcctttcaggatcaagccccaacgtgttgccaagaggatctgagttctgcttcaccgttgcggatatggagcaaattctacagatcagacccacggattgcccttgggaaatactcccccttggaaaaagagatcctacgtctaggtggcattcacaccatagcagcaagaaggcttttggcttacaagcaagaggaagaatgcagaatgctcaaggaactacagttgctgtctccggactacaaacaagcaatggagtataaaaagaaacattcctctccttgtgctatttgtgtacccctagaaaaaatatggacagcaaaggtgattgcgcccctggaggcatttaaaatgccacaacgagagcaggtgaacgtcagtaagcacatagagaggatgaggcttgctcgggctctgggaaatcatcagcctttaccctacattgaaaggtttacacgctcctcatttctgtctggggtgggcctgggtccaatggcaaaaaataaggccagacgaaaggaagacaactatgacacccataattgtgatgatgccaaccaagataagaaagaggaggcagagggaaaaaacacaaaaagacgagaaataaaaatgaatgtagttttcaagtcaaaagaaccaaaaaaatgtttaacataccatggaaatgatcgcaaatcattcctccccgcaaagaaaccggaacggtccatcgcaggcctaacaaaccgaaatcttttctgcatatcagaattccctggtgacttaatgctaatgaatcaggattttatatcacggagagaccacttcagtgatctggtcaagacctacagcctggaagaagagagtatctggaaagagcgcatgcgtaaagcaactccttatcattattaaagttttatttgttgcccagggtaaccaggtgtactagtccttattattcccgtcagctgtgccccaggctccttgccaccccatcttatattgggattttggcttcccctgcccaatctccaggagggcctcaagcaacagcccagccttctcctaacctactcccattggggtgtgtgtctgttatctatttctatgaaacaaatcacccccaaatttagtggcttaaaac

SEQ ID NO: 467857 - DNA, 1009 bp, Homo sapiens
tcagagcacaactggccaccacgaggatgccagtgtcatctgctcagagggctggccggagctgaggctgatgggcggctcaggccggtgcttggggcgcgtggagattctccaccagggtgcctggggcaccgtgtgcgacgacctgtgggacctgaatgaagccaaggttgtgtgccggcagttggggtgtgggcaggctgtttctggccctggcgaggcccactttggcccaggctcaggagacatcttcctggacaacctccagtgcactcgggtagagcactacctgggccagtgtacccacttgggctggtcagagcacaactgtggccaccacgaggatgccagtgtcatctgctcagatgcggaagacctacctccacccacacctccagattcttctacagcttctcaggatcacataaaagccatgaccctgcaggcagtcatgaccctgcaggcagtcattccaaagccaggtccaatttgcaccctgcaagcacactgcctgccaagtgtgagacttctgatgctgagaggcccctacagaaaccccagaaattcttttaggccaccagaaagccagatagtaagtccctggatgtggtttggggtttgcttgtatcggaaagatggaccagagttgcggctggtgggtggctctggccagtgctcaggacatggggaggtcctacacaagggctcctggggcactgtgtgtgatgacctgtgggatctgaatgaagctgaggttgtgtgccagcagctcgggtgtggtaaggccattgctgctcctggaaaggcccactttggcccaggttctggagacatccttctagacaacattcagtgttcaggaagtgagaaccaccttggccagtggcccagctccggctggtcagaccacaaccgtggccaccatgaggatgccaatgttgtctgctcaggtggcctctccttccatgatagattccttctgatctttcacccaaagacatcctagtga

SEQ ID NO: 467858 - DNA, 481 bp, Homo sapiens
gatcctgagagtcagcttcatctgctttgggcgcagggtctaccacaatggcacatgggggactgtgtgcgacaacctctggggcgtcaacgctgcccacatggtgtgccagcagctgggttgtgggaagggtgttggccaccccagggaatggccacttggttgcaggggtggggggtggcggcgtgggacacatcctcctggacgatgggcagtgtcaaggcatggagaccacactaggccagcgtggctatctgggtctgtccatccacaactgtggccaccatgaggatgctgggctcatctgcacagatactgacttccagctttctcctgaggctgccagagccatgactctcagtgggggacctggaaaccaatgtgaggaagtttgggtctcactggcatcctctaaacaaatgcccaaggtccactctcaacatgagctcctggggcaaaggatacataatgacatataata

SEQ ID NO: 467859 - DNA, 508 bp, Homo sapiens
tggtaaaactgcaacacttcaaagcagcccctgggtgcctgcgtctattctgtggcctgctgaagagctctggtgaggtttgtgccctcttaaaatgactcttgcacacgaatccaccaccaccaagaaggctgtggtgaagctcatggcacggaagagcttgattttgggaaaagagctgccgttgtcaccacaaatacagcacgttgactctaaacccagggctgctgttacttatttcctgcttcatggttatctgggaactttcaaggcatttgctggctggttagtttctattaatcaatgtaagcatcgtcgcatcctaagcctggattttgctgtcctggtagataaagaggatgaagcccagattcctgtgtgtgccctgcaaagccctgaaggtctggccctgctgccctccagcctcagctttgctgcgcccccgcactgggagctgcagacctgggaaaatgttgctttctcccagccctctccactctgctgactt

SEQ ID NO: 467860 - DNA, 469 bp, Homo sapiens
gctcctcaaatgccaccaaagtgggagcccaggcaggggaggtgccgagagcaagcgagggctctgaggactgccagcacgctgtcacctctcagtaatagcacagccccatccttgctgtacattgtggacattatcttgactcctcacaataactctccaagaagcattccaaagaggatataccagaatctggaactggcatatgaaaatatcacctctagggaacaattcataaaaccaccaattactccgtggactccttttggctctgtccttgctttagatgataggaatacatgccaagacccccggtggatgcctgaaatcacagacagcaccgaatcttatatatacaccacattcttcctctacattcatactcatgatagcttaatttataaattaggcaaagtaagaaactggcaacaataataagaataatttattttcagaccatggttgactg

SEQ ID NO: 467861 - DNA, 534 bp, Homo sapiens
cattaccagggtttttcctccagcaataatggccaagccctgcacttttcactcaggcctcctgctgcctctcccagctgccttcagccagcaatgggctgatctgtggaatgtaaagtggcctgaattgcctgctcagccccagatgcagggagaggggaataaagctgagtggagctggactgccaagcctaccacttggatactccaatgtgacatgaacttaatagttacaaatggccatgatgggagtatttataccacaggaattggtgtatcaggaccagatgggaccaatgacttgaaagaaatcactctgccagatatcagaaaatctgatcaaaatacatttttggaaaagctttcggtttatggaaaaattgagcagaaaataaagtgttcccatatgctcctccctccccaacatttgccttattactaacatcttgtattagtatggtatatttgtaacaattgacgacccaatcttaatacattattagtaactaaagtccatagtttatattaggaccc

SEQ ID NO: 467862 - DNA, 518 bp, Homo sapiens
ctgctcaaaatggctttccacaggcgattacccatggtcaagctttgctttctctctgcttctactctcctgcattaccagggtttttcctccagcaataatggccaagccctgcacttttcactcaggcctcctgctgcctctcccagctgccttcagccagtgtctgccgaagcccccttgcaatgggctgatctgtggaatgtaaagtggcctgaattgcctgctcagccccagatgcagggagaggggaataaagctgagtggagctggactgccaagcctaccacttggatactccaatgtgacatgaacttaatagttacaaatggccatgatgggagtatttataccacaggaattggtgtatcaggaccagatgggaccaatgacttgaaagaaatcactctgccagatatcagaaaatctgatcaaaatgtgagcaaatgaaagcaacttaatcattttctctgacttagtttttctgtttgtaaaataggttgttaagaagtctaagc

SEQ ID NO: 467863 - DNA, 810 bp, Homo sapiens
aattccaagcttcagactgaagccctagtaaggaaaacgggatctgagggatccagaggcagatgacaatggaagtcaaggggcacagcacaggcaccccctgttaacatgggtgaaagcctcattggcacccatgggcagcaccctgccaaggtcactgggactcagggatgtaaggacccaaaaaacaaatggagatgcctcttctttctctccctcacataccctgagtattcactgggaagagaaagtaactagggacactttcttcccctctttcgagatgggtaaccaatcttcttcagtctgtacttctctgaaatgcctcctgaatcactgtgattcttttggaaaaaaaaaatgccttctttctgctttttcctcctctgtcctctctttggggatgggtaattgtgtccctgtacctaacataggacattccccttggatgtgtcccccaaactgggaagagttaatttccccaacccttaaaatgcttggcttaaaattgagcttgggtgaagggaactcagaagcctgaaatgccagcaaaagggtaaagatttcttaccagtcagacttctggtctccctctccctgtgcaaaccagttgaatgaatgagaaaatcactgtttatatcctctgtaagattttgatgcatggaaaaaaaggatttgtgaggctaatcttaagctgcagccaatctggtgtactttgtgtgtctttctgcatggttctgtcataaggaggaatacctgaggatagagcatggcctagtaccccatgagcccactgttcaagccagcccc

SEQ ID NO: 467864 - DNA, 708 bp, Homo sapiens
gctttacactttcaatgtccctcacacggggcaggcacaagaaaatagcatcatggctaatacgacacctgccctcttcccgatgagccacacagcaaaggagataagcacaagttgtattttgccactctctgccctggtgtgtccggctgtacccactgacccctggactcaccagcaggaacacatcccttcccaggacaagcagggctgtggggctaacacagccatgacacctttaagggaacagcttcactatgcagcccaggccgctgagtccctctctgttctgccaccgaacttagacgtttctgtagggcctgacttcatagcaatctataaggcactgactccagctatagttaaactggaagaatcaatccagcagcagcacgcagctggggagggatatatttcctacaacatccccagtgggccacaaccctcctctggctgccatggcatgtggcagagagcattctgtcaacagcacagacagccagggtacactctggctgtgacttccatgcagggatttggaaattagtcattggagctgcagtaacagtggcatggaaaaatacagatacaccttggaatgattgcagatccagttccagacagctgcaatacagcaaatattgcaataaagaaagtcacacattttttttggtttcctagtgcatattaaagttacgtttacactat

SEQ ID NO: 467865 - DNA, 672 bp, Homo sapiens
gtaggtaaggtgggccgtgacaatgagtgatgaatcttctaaagcgtcagcagccccttgcctcagactccctgaggccacactgaaatgtgcacccagcatcaccagagcttctgagttttcaagagatgccagtaatctggcttttaagtactctcaattcttagacaaaaagcaaattcaagcaattttcttatttgagttcaaaatgggttgtaaagcagcagagacaacttggaacaacaacaatgcatttggctcaggaactgctaatgaacgtacagtgcagtggtggttcaagaagttttgccaaggagacaagagccttgaagatgaggagcacagtagcttgccattggaagttgacaatgaccaattgagagcaatcatcgaagctgatcatccttacaactacacaagaagttgctgaagaagtcaacgttgacccttctatggtcatttggcatttgaaacaaattgcaaagatgaaaaggttccataagtgagtgcctcatgagctgagcaaaaatttaaaaaaaaaaatcattgttttgaagcgtcgtcttctcttattctacacaataacgaaccgtttctcaattgaattgttacgtgtgacaaaaagtggattttaaatgacaactggcaatgaccagctcaacgatcggactg

SEQ ID NO: 467866 - DNA, 514 bp, Homo sapiens
ctggggacaggatgaacccaccagcatgttcaaattttcagtgttcatcttcctcatttagtggagaaaaacaaaacacagaacctgttgatgatgatgccatggcaggtcaccccccaggtgcagaagaacagagtgtggagaccaacctgggaaatgagaggccggctggacttaaagctgagagcccagggctggagctccttaaaccccctggcttctgcaggccaggccaggaccaaatgccagaaaatcctcatcctaattctgctacccctggtcaattcacctcaaggaaccaaaaagtatttgtcatgcgggttctttctgggggtgaagaagcaggagaaatgggctggatgtttatggaacacttatggagtgtgaatttgaaaagtcaaaaattgtctctttccagttgaacacatcaagtcacatgaatacagatttcaaaatctctaggttctgctggaattttgtcatagcaaatattgactgaagttggtgggccatc

SEQ ID NO: 467867 - DNA, 2152 bp, Homo sapiens
ggccatcttaggtccgtcgcagcccaagatgtgaatgggcatttcgcatttgctgcctgagttaccagcactatggacacagcaatgtaattttaccgcgggtttggtaatgggctggagtacagcagaggaatcgatcaatttcataggcatctatcagaacatctatcagaacccagaagcatttactccttctcactatgcttctgaacatgcctttggatggactgagactgatatgcatcccatcctgggtaacctgaccctgcactcccagcatcttcctgagaattcgctctacagccacgagaaggaaggctatccattgtcacggctgcttcgacgatattctcttacaagaaaaactttttcactttatctgccaccccccgaccttttctttaaacaacagcagcagatgttggagatggggtcagagactgctggagaccagctttcctacaagagggtcccatctgcactggcagctgattagcttgagcccacccagattaagggtgggtctgcctttcccagccaactgactcaaatgttaatctcctttggcaataccctcacagacacacccaggatcaatactttgtatccttcaatccaatcaagctgacactcaaattcatatgtggaagccctaaacgccaatgtggtattaggtaattaggtttagatgaagtcatgaaagtgagccccaaggtgggattagtgcccttataagaagaggaagacaaaccagagcttcctctttctgccatgtgaggatatgttgagaaggaagctgtctgctggccaggaagagagccctcaccagaaacacaatctgcccataccttgattttggacttcccagcctccagaactgtaagaaataaatatctgttgtttaagctgggcagtctatggtattttgttttagcagcccaagctggcttaagacctccagggattgcatcagcccagacttgaaggtaaagcagcaaacctccagggagtcttccctctgagctacctggcaagtcatgtgcatgggccacaacagcactaatgcatttccatcagctctctgctgagtgcctgaacttgtgtagccttggccagccttgaggattccagagccttggcttagcaatttctttctcccttatgagaactggaaacaccagtctttacgtccctgatgctcaccccagagtttcttacactcatagcatttggtggagcttcacagagtaaaatttttctcctgtgcattctcttgggagctggccttttctcttactgctaatgtgatagtttccataaaatttcactatgtgccatctctctaaatttatggctaatttacttttcttctatctcattcaatgaaaagcagtcacaataaattacacattgcgttttttagctgggcagacattccaagttgacaacaatatgttaattacagaagcttgtcctgttcatctaaatgaagaccaataagacttaattgcctgaactggggagatggggggtgagtctaaaacctgtgtcattgccaagatatttgctgcctactaagcaagctgatcatgtttccctgaagcaatttacacagagcacagtggagcagagttaggacaattattctgaaattaatctacatgaaaacctacataaactagcttgacatttggattgtgatcaaaacacaatttgacttttcctctcttggtgtcttcaagttttatccagtgagggtgatcttcgctggcacctgcatcactcaggccttcctgcagtctcttgaaggcccaaacatagtctcaattcagtaaaaggaatgtcttccctccctccccagggtggaactatttttgggtgggaagcatgatgggttcttctgatctttactctcttcctgactgcttgccaggtggagggtcaaagggcatcagagaaagagaagcagaggcagaagacagttcctattgcaatggggcatcccaagttgggccctgctcccgtttctggcagactgttaaggctgatgctcttgcagggccttttcagaaatcccccgctggcccctctcccctgtgagggggagttcccttgatggggcaaatacatctccatccccaatggccccctc

SEQ ID NO: 467868 - DNA, 738 bp, Homo sapiens
actgttcttttggtagtgaataagttgcatgacatctgatgcaaacatatacgatgatgatgatgatggtgttgatgacgataatgatgatgatggtagtgatgatggtaattatgactttcaaagagctaaaaatgaagtgcttaaaggagaagctaccacctggatggtgaatgtgtgtccccagcactggccaccagcccctggccaggggcagaggcagaaccagagtagacgctggatgatgactccaagactttacggctactgtccatgcaacttgaatttccagagaggagaccgaggtcctgggagggaaaagcacacagaggtcaccgcagcgtcatgttctgttgcaactccgccccatctcccccaggccatcagtaaagtcggccaagtgccacagtcttgtagcggggtgtcttgtggaaagcaagctgcattcgacatttgggtgggtgagagagagaggcaggcagagagaggggtccaggaaggcaagctgtcgagtgaggaaacccaatcagggaagttgctgaggcaaggactgggagaagaacgcaaggctccagcaggaatctgcagaaatctgggagtggatgcaagctggctcctggatgcgggatggggctgggagccagtgagcgtcgcactgatggggaggagggagcctgaaggctggaagatttcgagacacctggttgctgttacatgggttacataaggctctgccca

SEQ ID NO: 467869 - DNA, 496 bp, Homo sapiens
agctgatcagctcccacagctcaccatctggctaacctctgctggcttcccatgacacaagcccaggcctcatcttcacatgaccccagggctccagggtcccccagtagactcaggcttctctgtcccttcattcggaatttgtcctctgaggaaatagaccttcagccaaatccagcagcagccatgggcaagaagcaacagggattctcccaaaagcagatttcaggagcaaccacagcttgggggcttttcagaaagggtcatcttggatgggcctgggaggggtcacccagtggaagtgctgactggaagaataaatgtgatgctttgaagcccagacagattcagctgccaaatcttgtctcactccctttcacattctccttatgcctctctcccttcccacctctgccttcccgagccagatgctcctcacctctcccctgctgccagctgcaggatgcagctaccaacaagtgactgtcctgctcat

SEQ ID NO: 467870 - DNA, 842 bp, Homo sapiens
cccgctgtcccccgcgcgcctgggtggtggagggcgatagtgcctgaatcaatcagatttgatcacttgatcatagaacagataagcggcttcaaatccgattgctctaacgacagactgcaaaaatggtagctccaagaagctcccacactgctggcactatcagagcatgatctttgcagtaacgttagcagcacccaagaaggcttttgttgaggcttcacactggaaaggtgggagccaggcagaggctgacatgaggaaacctccatgggccatgaccttgggacatttgcaggccccctgcttcaaacactcaagaaacctatttgggaagagagtcactgaagattttaagtacaagaataactgggtcagattggagtttttttcacaagcaatccccggtcacaggggagatggatgggtggaaaaagaactaaagaagacggcaagagaaggccatcaacttcaaaatgggagacaggtggaggagcagtttggggaagttcacatagcccctggtaaattggattctgcatcattaataatcacctggaggacagaggaagagagtccctctaattgacaatcactcagaaatgaatataaaacatctctgaaatgctaattgttaagtgtttattgaggcccatcatatgcctttgctgaatactaaagtaccaaaacatttccaaagaacttacagtctgattgtactccaaagaatagagagcattttcattttttactatattgaatttctttggtatattaccttttataatagcttctcttattgcaatgtatctgactagtgttttctctgcattttcatcttt

SEQ ID NO: 467871 - DNA, 1060 bp, Homo sapiens
tggatcctttccagaccacgggcactctctcagccatccgatgcgtacgtaagcctatctgtaacatggagcactcgcatcacctcaattgcaatttgacaaatttgacaaggactcttgctgaacttgattcctttcccctttcatctctcactcacctgactaacctggtaaacaaaagcccactccaacaggataatggaggaaacgcagatacagccaaaccagctccggatggtgagaagtgttctggttgtcgtttagggtggggtgtttgttctgtgggtcgagtgggcacagacaaatggaaaacattctttcctgctctataccaagttgttgctgaaatgggaactgtattacacctgtggggagcaatggcaacacaagttggcagccaccacaggcttgggagtaaaaaggtccctcgcagtttcccattgctggaagaacatgaagggggccagaaaagaggagatggcacagttaactggggtctggaagatgacaaagacatgtcacttacaggatggacaggaatgatgactgggcctccgagaataatttatgaaaaccaaatatccagccttaaagtagaatgtggacctaaatacccagaagcacccgctctgtaagatttgtaatgaaaattaatatggagttaatagttccaatggagtggtgggcccaagatccatatcagtgctagcaaaatggcagaattcttaaagcatcaaagttgtcctgcaagagctttggcgcccaacgatatctaaagaaaatatgaaaactcccttagcctcctgaaggacaatgttacagcaattaatcaaaaagaaaaaccacaggcccttcccttccccacaattcaatttaaggagtcttcattttccacagtaaattttctagatatgtcttgaagacctcaaagtactggaaaagaagctcccattcaaaggaaatttatcttaagatactaaatgatactaattttttgtccatttgaaatatgtaaattgtgctataataagttatcctgtcaagtgtaaccactgtccac

SEQ ID NO: 467872 - DNA, 1866 bp, Homo sapiens
ctggcagcaaacagccaccaccgccacaccctggctggccctgctccccctgcaggccggcggtacctcaagcttggccagctcctcgcccttgtggaggatgcggaaggagtagaggtggtcggggctggggtctgggaccacctcgcagcccaccaggctgaggggttgctgggccaccttgctccggttccggtcctggtaacctgcaggaggaagtgcagatgcaggaggggacagggctgcaggaggggacgcagatgcaggagggggcggggcttcgggagggcacacagatgcaggagggggcggggctgcgggaggggaagcggatgcggatgcaagaggggactgggctccaggaggggacgcagatgcaggaggggaccgggctgcaggaggggacgcagatgcaggaggggactgggctgcaggaggggactgggctgcaggaggggacgcagatgaaggagggggcggggctgcgggagggcatgcagataaaggagggggcggggctgcgggaggagacgtggatgtgggagggcacgcggatgcaggaggggatgcggacgcaggaggggacggagctgcaggaggggtcgcggatgcaggaggggactgggctgcaggagggagcggggctgcaggagagagcggggctgcaggaggggacggcgctgcagaaggagatgcagatgcaggaggggacgcagatgcaggaggggacgcaggtgcaggaggggacgcagatgcaggaggggacggggctgcaggaggagatgcaggagggggtgcaggtacaggaggggttggggctgcaggaggggacacagatgcaggagggggcgcagatgcaggaggcgacggggctgcagaaggagatgcagatgcaggaggggatgcagatgcaggaggagatgcagatgcaggaggggatgcaggtgcaggaggggacggggctgcaggagggagcggggctggaggggacggggctacaggaggagatgcagatgcaggagggggtgcacgtacaggactggtcggggctgcaggaggggacgcagatgcaggaggcgtcggggctgcaggaggggaggcagatccaggaggggacgcgggtgcaggaggggacgcgggtgcaggagggggcgcaggggcaggaggggacgcgggtgcaggaggggacacaggaggggtcggggctgcaggaggggacgcagatgcaggaggggacgcagatgcaggaggggacacagatgcagaagggggcgcagatgcaagaagcgacggggctgcagaaggagatgcagatgcaggaagggatgcagatgcctggagggatgcaggtgcaggaggggacggggctgcaggacgggatggggctgcaggagggagcggggctgcaggaggggatggggctacaggaggagatgcagatgcaggagggggtgcacgtacaggactggtcggggctgcaggaggggacgcagatgcaggaggcgtcggggctgcaggaggggacgcagatccaggaggggacgcgggggcaggaggggacgcgggggcaggaggggatgcgggggcaggagggcatgggtgtctaggtgtgtcctatgctggcactgcctctaggcttccttagagtcccccagattctcagcttcagaacccatcagacaccttccctgtcctaagggattggaagctgccctgagctttggctggctgaaccaggcaatagcgtgaaaatgcacagctaccttcctgcctggcccagtggggatcatgcatatcgccaagccacattaacacaaagtggaagaattagagaccaggactgagatgacacacacacccgtcaca

SEQ ID NO: 467873 - DNA, 1350 bp, Homo sapiens
tcttaggcttgcagtctattcacttggggcatggctcagtcacttttaatcttgattgctctcacctctgaagcatacaactccatttctagctcttctctgggggctcaaaatgaagaaccaaaaagccaagaaaactgtctatttttctgcttaggttctatgaagaatggacagtcatgcagaaatgtcattggacaaaaagcccctgctgatgacaaatcaacaaaggaattcattgacaagtttgtcaaggtcatcactgatgaacatctgatggaagaacaaggctataatgctgatgaaacatcaccattttggcattactgccccagaaagaaagctgaagaagataggaagatgtggaaaaatttggaacttcctagaaacatgttgaatggttttgaccaaaatgctaatagtgatatcaccaaagaagtccaggctgaagtggtctcagatgtagatgatgaactacataatcagaactggagtaatggccactcttgctatgctttagcaaaggtactagtgggattttgcccctgccctagagatctgtggaactttgaacttgaaagagatgatttagggtatctggcagaagaaatttctaagcagcaaagcattcaagaggaagcagaacataaacgtttggaaaatttgcagcctgatgatgcaatagaaaagaaaaaacccattttctggggagaaattcaagcctgctgcagaaattcgattaaagactatgcaagtgagaacaaaatggagtgaaatattaaaataaaaggaaaaaatactaagaaattataattctgtactctgaaattatgcttctaaaatgaagaataaataaaacttttgtcagacaaataaaaattgaggggcgttttagccagttgatatgccttgcaagaaatgttaaatgttctttggagagaagaaaaatgatacaggtcagaaacctggatttacgtaaagaaagagcattggaaaaacaattagtgaaggttaataaagcattttatttttcttattcttgattgatctaaaataaaatagtttgttcaaaatattaatagcaacgatgtatttaagtatgcttatgtacaagtgaagtgaatgacaacaatgatacaaggaatggagggaattattttgttaatataaggtactcatactaccaatgaagtggtatagtgttatttgaaagtggatttggattagttataaatgttacaaactctaggacaatcactaaagaaagtaaaaaaaaaaaaaagtataattggtataccagaaaatgaaatgatataaaatgtttgattcaaaccacaaaagtcagaaaaa

SEQ ID NO: 467874 - DNA, 2724 bp, Homo sapiens
agtagtgttcgtctcatcagggatgtggaataccaggaaagacctgacacctcccccgctttttctctctctctcctgctggccgtgtaagatgttcttgtttccccttgccttccccctgaagcatctccagccatgcctactgcatagcctgtggaaatgtgcgtcaattaaacctcttttctttataaatagtctcaggacaagagataagaggatactgaaagagaaaagagcaattgctaaagatactcttgaaagaaagggctgcaagggaatctctatatacagacgagagtcagatttagtaagagaagaagaaaagaaaatatgcaaagagaaggtgaaggctatggaagattttactgatgatgaaaatagagtatcagaaatgtgcagtattagggttcaggaatcagttaggggatcccctgtatcaagtgctgctgatccccagggggtgaatggtcttgtaccaaagatatgtttaacaggtaactttccatgtgaaacagaaagaggacaggtcctctattgacttgacagggcgggggaattcaaattcttttacagcagttacattggaagggagtgtgtgtgtgtgtgtgtgtgtgtgtgtttctctagagaccaaattgaaattgtgtaaggatgaaagacataaattaaagataggaagggggacggaaaagtataaaattcattatgggataagtaaaacaggacagaaaattaaataacttgttggatatttgctaatatataaatagcaaatctatgctaaagaattttagtgatacatgaacatattctcttttaaagagtggtaaataaatttgaagaataagcaaagcaacttaaggcaatgctacaatgaacctgtgtgcatcatgtgcccaaatggcataataactatgaacaatacagttcttttccgatttatttatgtgtaggaatacgtttccagaaatcaatgattgaaaagttataatttgacaaaatgatttatagttcatatgaaagagaaacaggctaaaatttttgaggaaaaataaaggtagagattactacactttcagatattaaaatatatatgtagaacaactaaaccagtgtgctttaataggccagttgagtgggttttctaaaaatagatcacagactatcccaaagatataaagtaatgggatgtggtataaggatagacatagagatcaatgaaatataactgacataaaatcaatgcaatggaatgatatttacccagaaataaacctgtatatttgtagttaattggtcttttggcaaaggtgccaaggtgactaaatgcagaaagaagagtcttttcagcaaataactctgggacaagtggataatcacaagaatgaaaatgtacccctttttaaatgccatatccaagaattaactcaaaataaatcagagatataaatgtaagagctaaacctataaagctcttagaataaaagataggagtaaattttcatgaccaattttcaatggttctttagatattacatcaaaatcataagcaacaaaagaaaaattagataaactggattgcatcaaaattaaaaacttttgtgcttcaaaggataccagcaagggagtgaaaagacaacacacagaattggagaaaatatttgcaaatcgtatatctgataaaggactagtatttagaaaacaaacaactagataatataagacaaatatcctattaaaaatgaggaaaggatctaaatatccaaagaagatagacaaatggtcagtaaatgcataaaaggtgctcaacattgttagttgttaggaaatgaaaaatcaaaaacaggagctaccacttcacattcattaggaaggctgcagttaaaaaaaaaaagagataatagcaaatattgatgagaatgtgaatacgttggaactctcattaattgttggttgaaatacactggggcagccactttggaaaatagcttggcagtccttaaaataattaaacatagagttaccatatgacccagcaattccactcctaagcatacatgcaagagaaatgaaagtatgtgtacacaaaaacttgtacctaatattcacagaagcattattcgtaacagttaaaaagtagaaacaacccaaatgtctatacactgatgaatgggtaacataagaatgtaatatagaattatttataataaagaagaataaagtagtgatgaatgctatatgctaacatgaataaactttgaaaatatttgtgtaattatgtagtgagcatattatttctctaatagtagctatgtttcctgactccacctcacagattgaacggtactgcccaaaacacaggaaatgttgttccctactgcattgttgaatggccacgctgactctgaactcttgttgcctcacacttcagtgaaagaaataatcactgctgaaggtaatctcctaactataaatccagtttgttttcagtttttaaaactgctttatatgtgattcaaaataatggatttttaaaagtcaaacttaagattctattcatgtttctcaggaaaatcctattacttgttttttaagttttgttttatacttagaaatgttaacttttgtccttaatttacagaaaggatattttaaaatattatattgtatatatggattgccaagtcatcattgtaattttttctttatatgtgttatatattc

SEQ ID NO: 467875 - DNA, 746 bp, Homo sapiens
ggcatttcctcctgcctccctgtgaagaggtgctttctgccatgattcccgtcggaaaagcgcagtattcgggtgggagtgacccgattttccaggtgccgtccgtcacccctttctttgactcagaaagggaactccctgaccccgtgcgcttcccaaggcaatgtgtacccagagtctggccatatccagaggtgccatctgggagccagagactaaagtcaaaaacctaaatactctacctgcagacccgccactgacttccatccctctggatccagcagggtctctgctgtgctcccgatccagcaaggtgaccattgctgctgccgatcgggctaaaggcttgccattagctataacactcaccacatggcccaagattccattctttggaatccgtgaggccaagaaccccaggtcagagaacatgaggcttgccaccatcttggaagtggcccgctgccattttcgaagtggcccaccactatcttgggagctctgggcgcaaggacccctgggcgaagttgtattgtgtactaccaagatgttctatattgattctcttacaaaattcaggaagattatcacctaggggtgttgtaaattagctgtcattaaaagcagtcccaaaattgataaacaaatattagtattaaaggagaggatacactacatattttggaaacattaaagagtaataagacaatacaacagacaaccttaaacatatacttcatcaactt

SEQ ID NO: 467876 - DNA, 981 bp, Homo sapiens
aaacggaccaatcagctctctgtaaaatggaccaatcagcaggatgtgggtggggccagataagagaataaaagcaggctgcccgagccagcagtggcaacctgcttgggtccccttccacactgtctgcagcttcaatcctgaagccaacgagaccacaaacccaccgggaggaatgagcaactccagacgcgctgccttaagagctgtaacactcactgggaaggtctgcagcttcactcctcagccagcaagaccacgaacccaccagagggaagaaactccaaacacatccgaatatcagaacgaacaaactccagacacgccgcctttaagaactgtaacacacaccacgagggtccacagcttcattcttgaagtcagtgagaccaagaacccaccgattctgcacacactaccttataatagggccttgtgtccagaggttgtggccaatatttgggcagacaaagaaaacgggacctacactgtgaattcagtaaccctcaggccaatcttgtgtggagctagcccttcagatctgtcccaaattgaggcagaaccctacagtattcagttctcaccgaaaagctctgtcccacaaattactgcacagatttaatcccaccttcaaaagtaaatctctccagcacagttagtcaatggcaaagtggttttttttttttttttttttttggtgggatgagggcgaaatttatactctttgtttctcttaatctgttctgtattttttgaattttattgaactttttttctgtgctagatgtaaattctcatctagtttgcaattaatccttcacgtttcttgattatgtattccattttctctgcaaatactgttttaataatatgcatcctgaacttacatgtctctgtgtgcctatacactcatgaaatcaacaacaatacttgcatgactttgggagctactgatagatccaagccttagtccataaattc

SEQ ID NO: 467877 - DNA, 836 bp, Homo sapiens
tgaaatatgccccttgctcaccatgctgtgggcaaagagaaggagaggaaagctgcagccctttgggagaccagacctgggagctccccaagccaaggctgtgtctccttctctgggtccctgcagttcctggcatttccaagcttctgggcatcactgcattccccgatgccagccaaggaagctgcttacagtgtgcctgctccagctgcagcctcacagagagccggcacccatgccggcacctggagctgcctgccatgcagcagcagccggcatgtctgactgtgtagtgaccagaccccatgcctttccccacctgacttgcagtctcccttggaggcatgggatccaggctggaggggtgccgaaagcaggctgccaaaaacgggctgaattctggaaattttatgtggcaaaaaacaggaagtcttctgtgaagaccaggaagtctttgctcaaatgggagggatccctgaggaatcgccacactgacttccacaatggttgaactagtttacagtaaactatcgcaagaacaaaaaaccaaacaccgcatattctcactcataggtgggaattgaacaatgagatcacgtggacacaggaaggggaacatcacactctggggactattgtggggtttggggaggggggagggatagcattgggagatatacctaatgctagatgatgagttagtgggtgcagcacaccagcatggcacatgtatacgtatgtaactaacctgcacaatgtgcacatgtaccctaaaacttaaagtataataaaaaaaaataaattaaaaaaaaagagtaaggtgaatgttatgtgtt

SEQ ID NO: 467878 - DNA, 641 bp, Homo sapiens
ctttcaacttttccccattctatatgatgttggctgtggggctgtcatatatggcatttattattttgaggacacagagagaaaaagatggaacaagaatatatgtgagagactacaaacaatggcaagcacagaccagcaaaagaaagaaagaaagggtaacagagaaagcaatagaggaagaatatgaagccataagatttcaattttgtagagttctaggaagtttcaaactttcctacatcttcctgtcttctgagccctccaagtctccaggaagttccaaactttcccacattttcctgtctttttctgagacctccaaactgttccaacctctgcctgttatccagttccaaagtcacttccacattttaaggtatctttacagcagcaacccaccacaagtcttggaaagagaaccgggattaactcagaatgggtacaatgaatatctttggggtgattaaaatattcaaaagtggattgtgattgtaccacccttaaatttatctaaatatcattaaatttttcatgcataatgggtaactttatggtgtacaaataatagttcaataaagttgtgacaaaaaaatgagcactgagctcagtgttgctcattttggaagaattattaataa

SEQ ID NO: 467879 - DNA, 621 bp, Homo sapiens
atatccccagcctccaggccaacatctatggctccaggccccaggcagaactcaaaatttcaggctctagaccaacctctacaggcccaggctccatgcctgccccagtaccggccattcccaggctctaggtcaatttctgtggccccagatgccagaggagccagggtccaggcttgccccagtagacactacagacagattggcccttgcagaccgagtctccaggacttccctcacagatccaggttccaggacagcccgtgtagatgcagataccaggtctacacctgtggactcaggatccaagcctgtcccagtggacccaagtggatccaggcctacacccacagacccaatcaacaggcccaccccagtggatccaatttccaggcccagctacctgctaaaccaggtatcaagtcagccaactggacaattccagcagaaatctctcctaaggatcatgccagacaggctacctagaatctctaaatggaatgactagtaaaatgctctttttaaaaaagccattctacaaagactggaataagactactacttcacatgcatgaacatcaattgactgaacccagagaaatggacatgcacaaactgcct

SEQ ID NO: 467880 - DNA, 641 bp, Homo sapiens
ttatgtcagcctgtcagccagtttgatgagagaacgtggataccttggaaaatatagtcgtggctgccttctgctgattgggaaggggctatcaacacaagaggaagacccaggtttaggggagccagagttaaagggccagagctcaagctgtctgaagagcgttgtcaatgcacatcagatgagggtactgaagaaaaaggacggctcaatgacaccagcgcctacactacagcagtttgcaaagaagcatgtgagacctcaaaggctgtcagatcgtcttcctttacatctgtcagacgtggcactgtttctcacgtggaaagggccggcttctcaaaatggaaggattcccaaatgtcaccttcttgtgtcttcctggaactggggctgcaagtgcctgactcctcagaaaaattatctgacagaaacagtacatccatatagtcatttaagttttacagtgatgttcacagatgctaatctcagacataaacctgtgaagtagttattcgtatttatttgctaaatggactaatgtgtctcagagactttggttactgccctgagcatcactttggttactgccctgagcatcacttttgtcgtgagtcttgtgtctcccatccagatctctgttc

SEQ ID NO: 467881 - DNA, 823 bp, Homo sapiens
cgccagacgcgccaccttaagagctgtgacactcatcatagtaaatggagaagtgtgagagtttgaatttccctttattgctccagtcagcaaagaccaaaaacccaaatccaagcctttatcagattatctccctacaaatccctgacataagaagtctgaatcaattgcactaccttctgggcttcccaaggcagctaacacatgtactgagctatgaagccacatatgacaagggccgcataatgaggcctctcatgccagtagacaagtgggtgtgtcatcagtttactgcaggggaaacaacaaatttttcatatgtgaaattctgtgacaaagacctggagctttttgaggaggcttttccaggaactaacttctctatactttcccaaaacaactgggtttctaatttagccaagtacaatttagatgagtctaaacattgtccatcttcctccatcagggtttaaacacaatataaaaaaactcatctcaagtctcactactgtactatatttgtgaatttgtgtaaatagtgttaaaatcaccagatttaagcaaagattcaggaaagcaagatgattaacatatgtcagaataaatcagctcagtttaaaaaaaaactatctttttaaccagaaaaaaaaaatgagatatttacaaccttaaaaagatttggagtattttatctactaaaaggaacaaactgaggtcagaaatgatcattttgaaattaaaaatagtttctatataaaaaaatatcattgagtgcttataggcaaatgtatgtctacctcacccctcaaattcatattttaaa

SEQ ID NO: 467882 - DNA, 669 bp, Homo sapiens
gcgggaactgcagagaaatcgggagagagaaatgccctgtagaggcgatggcttacagactttcaagaacagatatatctaaaagtttgtttcaaagttatctgcctttattaagtgctgtgatgtattttcttccattaccttcaaaccatctgtaaagagacctacgcttacagcctggagaggatattttggaggaatgaagctgcggaccctcgcggtgagtgttacagttcttaagttggtgtatctggagttgttcattccccctggtgggttcgtggtctcgctggcttcaggattgacgctgcagaccttcgcgctagacataaaggttctccaagtccccaccagtcaggaaaccagctggcttcacccagtggatcctgcactggggccacaggtggagctgcctgccagtcctgggctgtgcgcccacactcctcagcccttgggcccggggagaaatcgagcgcagtgccagtgggccagcactgctgggggacccagtacaccttccgcagccgctggcccaggtgctaagcccctcattgccccggctggcagggccggcctgccgctcggagtgcagggccgccaagcccacgcccacccggaactccagctggcctgcaagtgccacggttcccactagtgcctctccctcca

SEQ ID NO: 467883 - DNA, 709 bp, Homo sapiens
gtcttccgcgtgagttttcatctgtcacttgtaacaggagtgctggtgggaaccatggtgcagtgcgtgcgtgcgtgcgtgtgcgtgtgcgtgcgcgtgtgtgatgcgtgtgcacgcgcgtgtgtgatgcgtgtgcacgtgtctgtgcgtgtgtgggtgtgcgtgtgcatcagtttgaacagtggccgctgtgagcagttgagagacggctgctgggattggctggggcttggctacgtgttccaggagcaggtggcgtcctgtggacacatccaggatggagtcggttcactgcagtcagcagaagtagtttccctggcacccgttcctccagagaacacctgctcagatacaggtaaccctgcacctgtgtatggatcatcggacacctgctcagatccagatccagatccaacccaagcacctgtgcagggatcatcggcgagacttacagagctcccagggatagaaaggatttccatctgtgactccacagaggaggcatctgatgggcgtgggctgtcgtcagaatgcgcctggcctcacagaacctggcgggagcagtgcggggaatggccatctctgttctgagcacactggccttcctgaggacaagccggctgccctcccaggctgacctgtgagtggacgacattgcacacgccctcctcgctggggtggaaaaggaagctgtcagaatgagcagtgc

SEQ ID NO: 467884 - DNA, 1270 bp, Homo sapiens
gttttttcatcactgggctgagactaaatgatgctgtcaacatgccagattatttcaaattagctaaattaattaatctaactcagtctttggctatattaatcatctgccgagtaaagggaggtttaatagaggtagacctggtggaagtaggtctagtagaggtagtcctggtagaggtaggtctggtaaagataggcctggtagaggtaggtctagtagagttagatctggtggagataggactagtagaggtggatcaagtagatgtggatctagtagaggtggatctagtggaggtggatctaggggaggtggatctcgtgcgggtggatctagtggaggtggatctagcggaggtgtatctagtgggagtgtgcctcatggaggtggatcttgtggaggtggcctaccctaaccccacccatttggcccccaccaaggggatgtattccctggaaacgtccacgtgtggattgcgctgcccacctccattccctgtgctcctgggaatggcactgacatttgacctgcagggagcagagacatcccatgttttgcctgtggaatttgggggccctgacccagtccagctccagggctgaactggagtcaccagtcagtcagttaacaaagccacacggcggccacagggattgatctgcagataagaacgtgtcctacttagtgcccagagagtcatgaaggcagttttggattctctggagagagagacctccctctcatctgtggagatgggcagtggggagagcacaggagatcctacagaatggggcacctggacaggccagaaggacgctggagggcagctgccaccacagatgctgatacacttgcccttggatggctcttctgaacctaggcctagctctggagtggtttatgaaagcccctaagtccctctttttaattttagcttgcattgggtggtctgtcacttgcagcagaaaatccccggctcacagctcccgtgtgagtaaaggcacttgaatgctgtttccttggaggttggccctgagatggtttcatgccactgccactagggacactgggaccatagctcgcagaatcactgagagaagcagacacataccagttagcatggcagtgggtttgggaaaacagattgaatttttattcactgtggcccgtcccagccttgccttctccttgtcataattttgtccattatttttagtattttaacatcaaatgcccaagttagtgaagatgttttacttcaaaatgt

SEQ ID NO: 467885 - DNA, 949 bp, Homo sapiens
gcacactaagatatgcacgcattcccgctggggtactcacgctatcacacactgagatatgcacgcattcattctggggtactcacgctctcacacactgagatacgcacgcattcatgctggggacaggcagaaacccaagagacccatggacaatgggctccactgtaccacatcacaacctgtaggtacaataggaaacccaagaggcccatgaacaatggtctcccaacactgtaccacatcacaacctgtaggtacaataggaaacccaagaggcccatgaacaatggtctcccaacactgtaccacatcgtaacttatagctacaataagaaacccaagagacccatgaacaatggtctcacaacaccatatcacatcacaacttgtaggtacaataagaaacccaagagaccacgaacaatggtctcccaacaccgtagcacatcgcaacttgtagttcagaggaaaacacctaacaacaacctcaacaaacacaacaacaacagcaaaaggacgaagcgtgagccagaaattccatctgcgtgagtatgctgggaaaagcctggcgaggaatcctggttggtgaaaaacagattcggtgcttattgttctgctctgtaagtcaccaaagaaatgtgggcgtgtgctgctggaaagaaaatagacttccacaaaaagtatgaatcacttttgttaattgtcaaagaaaatatatattaagtgattacttagcttctggaattaaaacaaaatgaaaacaaacaagcatcctctgtctctcaatacttttaaaactgaagatggcaaaataaggcaaaccaaagccaccagtgcatcttggcatggtcagcagaggagggcaagttttctaaaaccttaaaaagtatcttggtgtcatgagccttagagttatttgaaatgcagttatgtgaaacccccctct

SEQ ID NO: 467886 - DNA, 985 bp, Homo sapiens
cccgggtggatgatggtccaacttaaacagatggccaggaaggaaggaaaggaggactcaggggtgagatatgttcagatgtatttcagcacctgccattgacacccctttggctaaagctcaaatccctgttcccaaaccagagcgcacagtcctgtttctgaaggactgtgggtcttctgtgaagcatattatttcttccacgttaaacaccagaacttgcatcctgcaggggtcctctgtgctcctgccacctcctgcctgtccctccggtccccactctgttcattatgagtctgtctctgtaatatccatgtctacacgcaatgttccccaacagaccttttcagtcccccagcccctcccgagggcagacacacctgggctttctgctctcctgtatggcccaagaccgtcccggaacgggtcacagcagcagaacgcgtgcataaacatttccaatgtcactgaagcgaaaccgtccacacagagcagcgaggccaggacagcaaccggcagcccacggacttcactggcacgaagcagagagcacgctgtgggcgaggaaggagctggtgagacccgcagacaggaagagctccctggagtcccggccgggccagcaaggccaaggccactgtccactgtgatgcagcgtcggcgtctgcttctccactggaagaagcaagtttgcagtcagagcgtgggattttattcaaggttgtgctggtcgctcatggccgagtctctacggtgggctccacctgcattggtgcaggactctctgggtcaccccagggttgtgggcagattggagagtgcaggactcatggctgcccctcctgctgtggccagacgtggacgcaggctctcggacagggttctcatcttccacaccccacccttatctcgagaacccattttcccaccttttccctgcattcccctgtgactttttcatgctgcatattctgtgttcatatga

SEQ ID NO: 467887 - DNA, 713 bp, Homo sapiens
ccaggtctagttaggttaattagtgaaatgtctggagcctttgacagtgcccagtgcatgatggtgcttgatagtatttatggaaaaatgccccataaagttcacattatggggcacattcctgtgcccaagagacagtctagagtgtgccagcacaatgcttacagaaatctgaaccccaatctgaattcaagattcaactttatatgcctttctcaacactccctaactctcttctcagaaaaacctgtgcagcccaagccattaaatcaaccatcgttgggaggtgctcctcacctttcacatcagttacacgtaaattggggcactaccacatccagccagtccccattttacgttcaccctagtccaggtcttcaaaggatcaaacttcagtttggtgaaccaatgtatgccagagaagagaaggatgctcagtgcaggtttccagggtctactcttctcctcaaatggcatttaagaaataacagtgccatcttagaaactggttgataagaatgaatttgtttagttctacttgatgacattccatccatgatttccagtgccatactaaacacactgcacctccagtattcccctagattggccttaatcattttatacctttttagactgtaaagtctgaataggttcaaatggtatattagtccattctgttttcacactattataaagaacttactgagacc

SEQ ID NO: 467888 - DNA, 866 bp, Homo sapiens
aaactgctccaagaaggataggtcaataatgagtcagtgtcaggactttgagcaacggactccaagcacaagagggcaagcgtttcctaggggcaatgtaggtgcgaaagtggaagcagagagactgcgaagagccctctcccttgggagcctatgccagaccagcctctactatttctgggtctgtttcagaaacgtctgttctaacccatcttgcgtcctgggaggcaaagaacagggctatattgttctcacttatttgtgggatctaaaaatcaaaacaattgaattcatggagttaaagaatagaagaaggttaccagaggctgggaagggtagtggggtggtaggggaaggtggaggtgaggaaggcgccatctacaaccagaaagttggctcttgtcttgcaccttcatcttggacttctaggctccaggaccatgagaaagaactttttgttgataagccatccagtctatggtagtttgttgtagcagaccgagtgggccaagacaaacttcccagtggaatgtcattaaaatggagtgtatttcccaaagctgttcatttgagtcagactgttctgtgtcaatctagggcagtgtgctttctgtcactgtgtgattgttttggttccctttctgaaagacacattgtgttttacaatgtgttgagtggtgttctaaccagcagccttaggatgtcctgatgtttttgttctttttcaatgaggatagctttgtgttaaaaaagacttcatacaataaacagaagtcctatggtaatgaggtcactgtctttcatactgtttgatttagtcagcctgtgtaggcaacgtgtacttttaaaagtcctaaaagtaaagg

SEQ ID NO: 467889 - DNA, 533 bp, Homo sapiens
gggaggcggcggttgcactaggacttccagtatgatactgaaaaggggcggtgagagaggacatccttgccttgttcctgatgttagcacgaaagctttgagtttcttaccattaaatatgataagtgggaagagattcttctccgtttactctaagaacctggtgaaactcctggaggtaaaactcacaaagggatggagacctctatgtctgggtcccctggagcttttaatgttcaggcttgttcatactgagtcaccaggaatttatcaattacaattaggtgggacactcactggtttctgctctgattgggtaatttataaagaagagaaacttagttctcgtagttctggaggctggaagttcaagatcaaggcacaagcaagttcagtgtctgatgagggctcagtcttggcttccacagcgttgtcttattgcagcatcctccggaggaaaggaacactgcgtcttcctatgcagaagaaatagcggtgaaaagggacaaactccctctaacaagccttttcat

SEQ ID NO: 467890 - DNA, 3144 bp, Homo sapiens
cgtggctgaaaactctccagacttcaatcatgggaccaatgaggaacgtatctgaagattcctccatcagaaatagccagcataacacgggaaatgggagccttttttggacacctagtgagggctcaagggcagagtggaatcggctgctggatggcaaggctccagggaaagatcattttcccactccatccctccttcaggctccccatccatccactgacagccacctccaccacttgataaaacccccatattcatccttcaagtctgtgacccaattcttccaggatgctgaacaagagcttgagatacagcaagctgtcacactggccctctgcccttgcagaagggcagagagtccaatgagctggttaacactcaagccatctgtggacggcagggctaaaagggcacactgtgccatctggctgtctttgctttgccttgtggtccctggggcttggggagccagtgcagaagtgctggcactctagttactgttattgctgtgaagtaatcagctatccttcatctctgacccaagaatatcaagtcttcttccaggcttcataaacttgtggtaagttaattagcctgattttagtataaaaatctcagaccctttttagttcttgacaatgtacatcctgcacaatggctagaaataaaaagactggtgataccaagtgttggaaaggatgtgaagcagtaagaactctccctgttttggggactataactaggcacattcactttggaaaactgttttacagtatccacgaaagccgaacgtcatacttaataactaaataaattgctctcatgggcttatgtccacagaaatgtatccgtatgtttaccaaaaaacaagaatggtcataggcatactcttcacaattgtcccaaatgcaaaataacccaaatattcattgacatagagtgggcagataaattgtcacatcttcacactatggagtattatacagaaattagagtgaacaaactgcaactacacacaacaaaggaaaattaaatacacatgtggattgaacatccattttagcaaagcattgtgctagttcaggcaaacaaagataaatcttgatcctgttaaggtagatgaactaataaagccagtgcttatgtgttagaccttataccttcttcctgttcaaagacattgatcaggaatttttccatttctctcatattttatacacaccaccattctttctgaatcatacccatcagtacacaacaatctggatgaatcttcccaacataacattgagtgaaaggaaccatatgccaaagactacctactatggtatattccaaaatagaaaagctaagagcgttaaaagttatgacagtggttttctctgatggtggttagtgataagcagggagactgacagagttttgtaaggtgctaataaagttttatttcttaataagtactggttatacatgtgtgtgttagttatgtgaaaatgcatcgagctatacacacataatttgtatattttcccatgcatatgctgtttttcaattaaaacactaaaaacgcataactctgaggcccgttggcatactgtgttatgtcaagatagtaattctgtctaatagttacctcattcacaactcagcttaatttagagtcccaatgggtttggaggacttggtttaaaaattccataaagaaaacaaccataatactaagatcactttaaaatgaaatgcttttatgtttaaatgtttttttgtgtgtacaatccacaatttctatttgaaatgttgaaatatgttatagaatgaatgatactgatgtaggttatattcattaagataaaaaataagacatttacttaagtcaaggttgcctagagcttaaaaaaaatccagacgtaactttagtaataatgactaaaatcatactgttattttcctctgaattcaataaataaaagtattacatcccctgagaactctgactgatagagttttctgacaatggctttttattttcaacatttcatgctttaattctgatatactttaaagaagatgtaacaggtaaaatatatagccagagttacccactaaagtcggattggtaattttaacttaactatttttacttttgttaagtcatcacaaataatttttttgtgttaaattataaacataggccacataaacaaaggccacatgcttagtacaaattttgtcctggcatctagaataggttttatgtcacctgggccagaccccttactgtagagctaggatgctgaaagccttacccatgtggtctcagctggtaagggtgaggactgagaagaaaattaggccaaattagtctccagattagcacttgcaaaaattggtcaagacagcttaatcatttcaactttctattttccccaaattattttctgaaaaattacctactttactaattgtccactttaaatctgtgatagttctaagaatgatatactgaaagctgtattcagtgagccagagttctatataacagccaaatgcttttttctggcctatctggaatattctataactcaactattgtggggagacttagaaatttcaattttattaacttttctatgaccaagaataaaaaaaaaaggctagatttgtatggcctaatttggtgagacaaatgaaagcaaaacactactaacttagctaataatttgggaaagcccagttctacaattgcaaatgtgtcttgctttgagatgcatagggcagtttctctcccttcccaaattatcaggatgctaaatgaacaattatttataaattacatgtatttattttttatcacttgtaggtagttctgacagaaaactggatctgcacagtaatgaaagcatttatcctacaaaacactttatgtcatattaaacagaaaaataattgttccgaataatcaagaaggtattattaaagtaggcttctgtccttttccaaaaatatgaaggttgttatatgaacactgtcatggacctatttccatgagtttacatatttctaggttataggaataataataacatgatctaggctacccatactataaactaagatttaaattataaagataataggttt

SEQ ID NO: 467891 - DNA, 506 bp, Homo sapiens
tctttagaacaataataagataatgattaatgtgacccatttcacagaggagacaactaaggtgcagagcagggcgcttacacattcaatcaaggaaatagcccaactaaccagagtccaacagacccaaggtttccaggatgcagcttcctttcagtacccagccaacaagtcccaggctgtcctgcaactaaggacgtctgtttttgtcagaaccctcaatcccactcccactccaagagtttccaaaagtctccaagaaatgcactggcttggaaggcttcctggaggaggattagcaatgtatgagcagcatttggagaaacagtatgaggtggagaaggggacctgcctcacaaacgctgtgggcccaagatctgtgcccacctgaaagcctgctgtgattgtgaagactgacaacaactcctcttgtctctggaaagcaagaggcttgggctttgtgaatgccgggatgcctgcagctctaacagggtttgaccccttga

SEQ ID NO: 467892 - DNA, 957 bp, Homo sapiens
taagtgccacagtacattagcgtggcagttcctgcagtgagttagacactgtaaagacccttcatgttacagaccaggaaacatgaaagttgagttacctgcccaagttcacagagctaatgaccctctggcaagaggtcgacgtagtgtccaacatgcacatagggcttggagacgcattttgagccactgtgctgaaccgcctccctgtctagacagtggcagaccaccacgttcaaactcaccccactgtgaaggctgccagagaccacagccaatgaaaggcaaggcagagactggaatcaccttgcgggacagtgaggccgacgtgattaaatgccaagatgatgacaagaccgtgaagtttgcccaacaggcagtggaagaaatggaggaaaaggtaccaagaaatgagaaaatgttcctttaccaagggcgaatagggatctgttgtggagaaggtcccggtcaaggcagacgggacattctggtaggagaggagaggagattaagctttaaagtcagagtgaccacagctgagcaactcactgggcgaaagcatttcacaccctccttagggaaaggaggagatgacgcgaccaaggtcacactgccagtaagacaagaacctggattcttccgctccaaaacatcagagaagctgaaggggacctggcaggagctgaaggagctgcagacctggctgctgcctgccccatcgacaaggttctccgcagaagagactttatgataaatgtaaaaatatcacagtaatctccaataggcagtacatgggctttaaaaaggtaggggagggagagaaggttttattttcaattataaagcatcttttgcaagtgaatgcattttaatactttccttgacttagccaataatctaggcccatagctctttattgggaatatggttccttcaaaatcatgcattagtgctaga

SEQ ID NO: 467893 - DNA, 575 bp, Homo sapiens
ctctcccactgatggctgcatcccatccgagcttggagggcatctgccatgggcacaactccatctcctgggcctgtgagaatgcctgggaaaaaccactttgtccactttgtctgtaattgttcgttattaaatgatgctggtgtatatacagtgatagagagtcctttgtcccacctggtgctgtgggcagcaagaagggacaggaagagtggcatctgccgtcagaggcagcaaaggctactctgtaggaaaaacagtgcagagacgcatggcagaacagaaccactgcctaatgtgactattgctgatgtagaatactggcaatggagctcacacaagttcatatcaagcgcacctcaaagacataggccagcatcctcccggaagctgaagctgggacctgaccagagaccaccctctggagagatgaaccttgagtacaccaaggatgccatggacagagatgacaaacagggctgaagtcaagtcagaagtcttgaggacacttccagtggcagcattcacgtgagcccaggtgcttccctctcaggccactctgtgcttctgcctga

SEQ ID NO: 467894 - DNA, 486 bp, Homo sapiens
ccggagacactaggtttacaggcatgagccactgcgacgagcctgagtatcaattccagacagtgttgctccaatctgctcatcacagactgtcttggctgcagctctatgctgttggtgtgcatgggctgcacttggaagctttggccaaaactatcattgcagtcatctttgacagcaccagcagaatcaaacttctctttggggtggctcaaaacttctcacctgcttttctgcttttgacaaaaaggcaacaattaaaacaaccaagcatcactcgtcctgaggacttggcccactgtcttcttgttctgagaatcaagaaagcaagatatggaagggataaacaccatgaacaggcgtcaatagcctgtgattataaaatgaagggcactataacttttaaaagttattctgtttttcatatgggtaatacatgcatgtgatatgaaattcaaaaggcactgaaaggaatgtagtgaaaat

SEQ ID NO: 467895 - DNA, 2015 bp, Homo sapiens
caggcacttatgggttctgaaaatgcccctgcaggaaggaggagtggatggagcctctgccctgccatgaagacgtgggccttctcagggaccccactgactcttagaggctccttcacgacccacgggatcgagacgtgcagaaaagaacgcgccggcctcgcccgcgaagggccgcgcggcggtgggcggggcgtcgcgaacccccctcgcgcccactggctgcgttgcgcggccgcagctgaagttgggccgagagccggcgacggccccgcgccggggtcgcagggtaccagtgtgcggagttcctgttgccaagctgaaggtggccctgggcaggcacaggtgtggtcatatcttcagccaacaggaccatcctccggagggccacctctggggacttcctacgggaagagagtgacagatttggtgcttctgtgtgtttctgccgcttcagtggggccgctgcgggagacagcgggtggatcctccagcagcctgtctgctgagcctgccttctcaagtctactgttaaaatcaggaccgggtcgtgtccgagcctacaggccctgtctccgctccccaggcctgcaggagttgagggctgcacctgctcgctggagagggagaggcagatttagtggacgcctggcatggactcggactggcctttggaagctccctgccctgacggggttgcctgtcaccactgcgaagtgaggcttggcaggacctgcacctgagaaaggctgtgtgtggtcttggggtccacacctgcagagctaacttactgccagacggcgacttactgtgggccaccctcagtgaaccggggtgtcctcagctggccctacagagcacttctgtgctggggatgagtaggaactctgggcgaggagggtcccagcgccgcccctcgatacagcctggctctgccctctgcccgtacttacaccaggtgggatccctgccctgcattgcctggggattggctgggcttgggcccgccctgctgtggaactggatgttttcagggagcccagcctttcctcatgtcaacacagttcacaatatagttttcaaagtacagtttaaaactcaaaagtaaacttttcagcaactcaaaggtttgctgagtgatctgaagcactctggccactttttggggccatgggatttggttcacctgaaacagccagtgagaggccgggtgtggtggctcacacccgtaatcccaacacttcaggaggcagacgcgggtgatcgctcacttgagatcaggagttcaagaccagcctgggcaacatggtgaaacctcgtctctactaaaaatacaaaaattagctaggcatggtggtgggcacctgtaatcccagctacttggaaggctgaggcaagagaatcgcttgaacctgggaggtggaggttgcagcgagacgagattacgccgctgcactccagcctgggtgacgagagactctgcctcaaaaaaataaaaaaatgaaacagccagtgaggaggaaggctccccgccttccccccgccggaacatagccatagctgctgctgggacaccctcttggtggggaagaaggctggttagcttcatcagagccagcagcagcagaccagggacgggcacctaggcagtggcctcagagtgaacaggagttcctcagaaacacacacagggacggcgtggcgcatgctctgccagctccatgcctccttcccattgtggggctgggagcacaaagaccccatgatctagggcaaacttgtccaactgttggcccatggaacagctttgaatgcagcccaacacaaatctataaattttcttaaacattttttttttacgattttttttttaaagcttatcagctatcattactgtattccatgtatggcccatgtatggcctcagtgtattccaatgtggcccagggaagccaaaagattggacacccctgacctagggcatccccatcctctgccttcccatgcatggctgt

SEQ ID NO: 467896 - DNA, 585 bp, Homo sapiens
tgttgaggaaacttaagatttgacattgtttgcattcttgagtatggacttatctggatctagctatcctttgttttcttgtcttttaattccctttgcaatgaaagtgcataacaaaagtaacctttgctcaactctatctgagaccccatcaatctggacatcactgcctgcatcactattggcattttggtcagaatcatttaaccagtctctgggaagttccaaactctctcatcttcctttcttcttccaagccctctccactcttccaatgtctatctgttccttaattccaaagctgcttccacattttcagaaagagaaagactattgggagtttggaaataatcctgaaatggagtgtgcttttgccagaagacacagtaaaaatcctattaacctacaagttatgtgtaaaatacaggaacttagggatccttgtgtccagagacaagcagtctatatgaaatgtcataattttgacaagggctgctgatcaagaggacaaggtcaatgatgtctaaagtcattagacactagtactgagattgacaaatatcatacctaccgctctccccttcc

SEQ ID NO: 467897 - DNA, 948 bp, Homo sapiens
aggcattgatagcacccatcagatggccaaaacattatttactggactaggccttttcaaaactatcaagcagatagtcagggcctgtgaagtgtgccaaagaaataatcccctgccttatcgccaagctccttcaggagaacaaagaacaggccactacccaggagaagactggcaactagattttacccacatgcccaaatctcagggatttcagtatctactagtttgggtagatactttcactggttgggcagaggccttcccttgtaggacagaaaagtcccaagaggtaataaaggcactaattcgtgaaataattcccagattcgtacttccccgaggcttacagagtgacaatggccccgctttcaaggctgcagtaacccagggagtatcccagaaattaggcatacaatatcacttatactgcacctggaggccacaatcctcaggaaaagttgagaaaataaaccaaacactcaagcaacatctaaaaatgctaacccaagaaacccaccttgcacagcctgctctgttgcctatagccttactaagaatccaaaactatccccataaagcaggacttagcccatacaaaatgctgtatggatggcccttcctaaccaatgaccttgttcttgaccgagagacagccaacttagttgcagacatcacctccttagccaaatatcaacaagttcttaaaacattcacagccttggagcctgttcctgtctggattggacctccattgaccgactattacaataaaagccacagtaaaatccagtagcctctggaaaccactgaagcagaaggtttttgaagttggagcctaattgatgtttcaagagtttttctcctttctaagcatttagtgccataaatttatttatcagaactactttagctgtgtcctgtaattttaaatatgctgaatcttaa

SEQ ID NO: 467898 - DNA, 2356 bp, Homo sapiens
tgctactacgacgtgatggtgacactgcaatgcccgagagcctctggtagcctgcaggagcttcacggccgatgtgtgcggcattgttcctgcttgtcggtcatcatgcctgagaagcccattgactttggcttaagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagcccccccacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaaggtgggctgtgtgcgagcctgtgtgtggggctcggggtcacgggcggtgggagaacgacccccagaggtgagcagttgcctggtgacgtctcagcccatgctccccccgcccaccgacaccgtgggaccctcagtggccttgtgagcggcatagcgaacaggacgggggtctcacataggtggggcggcctctgccgccgtctgtctgc

SEQ ID NO: 467899 - DNA, 949 bp, Homo sapiens
ctcagaaagtacaagataaagatgtcaggacctaaaagggctgctatttggtcactcctcatcatctatgtggtgaccatcctagaggacctggctgtcgtggggaccatcagagccagccaccacctgcacatatccacacacctcttcctggcccaactctcggtgctggagactctgtacacctcggtcaccgtcccaaagctctggctctgcctgcacctggccatcagcgcccagctcagcagcttcccagcctcctttgtgtccacggctctcaactccagcctgaggctccgcagccccgatgtcctcaaccacttctgtgatatcccacccccgctagggctctcttgctccagcaccactaccatagaaatgcggactcaggcagcccaggtgatccttgcggcttccctgcaggcaaccacgacactggtgaccacccaaggcagccatagccctctcccaccagggcagtcagcaagtcctgccctcgcccatatcacccagagttgccaagagcacagagtggccacaggcaagcatctccttgagcagtggaggggcagagatgccagacctgggcctcagcactgccaggacagctccttgccacagcagctaggagcctccagcccaggagaagctgggcctggagctcacaagaagccccctctcacggcctctcccctgaccctctcggatgaacagctgctatggaggccagccactctgcccagtcctgcaggcccagagggatggtctccttgccatgaggtcccagctcctcagagcagagcctgaggccagggctacagctgcaggagccaccccaccttccatggtacaatcaggtctcagggctgcagcttcaggagccaccgtgccttcaacgtgctgtgttcttcttggtggcagctctgccaatgctgtgttaaacagaagc

SEQ ID NO: 467900 - DNA, 1049 bp, Homo sapiens
ccaaatggctggcctcaattagcatggatgtgaacaaatcggcagacctccatgaggactgctatgaacattggacctggctctaatgtgagtgacagaacatcttagctgacttacatgagaaccacagggaataactgtacaggacccatgaggacagctgtgaacacctgggctgtgcacaatgaagacagctacgaaaagccaagaacacctggtgtggggtcaacgaaagccattgtgagcgtttgggcttgccacaatgaagatggctataaacacctggctgggcccaagatgaatggctgtcaacatctaaactcaccccgacaaagacggtttagaacagccgtgaatacctggtcatgcccacgtaatgacagcaatgaacaactgagctcagccaatgggaacggcctgagattggatgtgaacatctggcctactgctgcaaacacctgttctgggacaaatgaggatgcctatgaatacccgggctgggccctaggagaacagctcggattaactgtgctgggcccaaaacatatggctacgaacacctgggctgaccccagtgtggacagctataaagacctgggctgggctcaggaggacagctgtgccattttggctgcatccaatgaggacagctgtggatatctgcacctggccccattaaaacagctgtgaacacctagcctatccccattgaggacacaggttaacacctggcctgggaccatgggaactgctgagaacacctggattaagtccaatgaggaaagctttgaacacctgggctaggcccactgaggacagctgtggacacatgggctggccccagtgaggatggctgtcagtacctgggatggcctcttgagggtggttggccccaattagcatgggtataaacagatttgctggcctcgatgaggactgctatggacatctgagctcgctgtcatgcggatgacagagaactccttgactggcttagatgaggacgactgtgaaaacctgtgcaggcctggatgaagacagctgtgaac

SEQ ID NO: 467901 - DNA, 1544 bp, Homo sapiens
aggacagctagcagtgccaggaattgaaatgacaatggcagcacctgggattcccaatgagcaagtggctcaatttgcccagggaagacaggaggagccaactccaagcatcgagctcaaacagcagcccatgctcaataagattaaatcaggcaccaatggagatatcaaaatgaatctgaaggcttattctgtcattttctctaggatcccgagcaagaattacaagggtgagagtggatgcagaaaaagcccccaagatgcaagacggaatctgctctacacacccagagctctgggatctgagatgaaactgaccaggaaagatctgaccacccagtacaaagcctggctgggccaagtttctctgggcactctccctattgctgtctcagagccctcaggccaggactggacctatccccctgcagcccagccccaggctgaaacacctgcccctctgaagtagagctgcccatgattcacagtaagcacgaatctgatttatgcatcagattattaaactattgattacttcatcatcattctccagtttgtaaacatgtatttggtttctagttattgttcatgattacagatttgggcttatttaatagatgtgaaatttacttcactaattatttaatttctatttctttccttataaatgatgtgaagtaatttctcttttgtgtgacttatttgtgtatatgcgagtatatttgtctactggagactgggggttaattttagaaattttatgagctctatatatttcatgtactaagtctccatctgttgtaaggagatttgaaaaatgtcagaaactctgaagaacatttggtagcactgcccagatgacacttggacttcctgcagtttcctaaaatattttattttgctactattttgtctttattttaattgtgcaaatgtttaaattttactcgaacatctttgtccattttttcttcaaaatatcttcaataatgtaacctggtttctccatttggttacattaactatttctttgtgtaagatttaatttttattgtaattctttgaaataatttttgccatattgaaacaaagttattccagtagcacgtacaaaataattatgtcctttatgatgttactatactcatttgccatgttttcatatgtacttaaaattattaattcatactctattttatttccgtggtctgtatttctccttctaatccagtgttacactggttcagttactgttgttttttaacacagtctattttgtgagataattattattctttcattagccctctaatattcttatctatctttcccagcacactgcagaatcaattattctgaattctataaaatgccaatgatatcattgttattttaactgaagttatattaaacctacaaattaaaccagaaataatggcaacttccatttgatctccctacccaggagtagaacatatttctctgttttcaagcctttttttccccattaaaattttgcagacttctttgatacatattatata

SEQ ID NO: 467902 - DNA, 1340 bp, Homo sapiens
gcactggcttttgtggaatggaggatgtttcagctgctagttttggtgcctgttcagacaggtggcagaagctctgagctcacaaatggcatctgttgggcacagaagggtcctagtgccctggtctgtggcctcagcccagcacatttgctgagatccagagaggcagcttctgtctgtcccctctccctacccgtggacaggaaaccacagatggcccagcaatttgatacgttgcagtgtttccaaagctcccagaagaagagacagctgctggggaaaggggagaagagggtcatcagagcaatccaaaggagaatggggcttgacaaagaggtaggagggaagaagttggagaagacaaaggaggcacagaagctcaaccaggcagagagaaaaggcccagagtgtggggcactttgtcctccagcagcctggctggggccagctgatgtgctggctgcagagtccaagagcaccaagacaggacaagttgtggtgacggtagcgattgttgacagctatcctggctgggaacgtgggcctctgcaggtgacagtgtgccccgggacagctgatcagctaggccatggggcataccactggctgaacgtcgactctggggaaaatcagctgtttactggagttaatgaaacaggaaatatttcagcatttagatatatgagtttcggcagggaaagatttgatgacttaatgatgagccctagagcactaggcgatggcagcccagacatatgtcagcctgtatggtgttctgcggaggctgtcattcccatgaggagacagctgtacctcgtgtgcaggctcaacattgccagggagcagtgtctggcccacctggggcactggaagaggcttcctgggagacagctgacggatgacaaagaagaggcgagtgtattccaggaggagagactgccgaggcagtgccatggagttgagcaggaactacgattaacaggggatgggagggaggcactgaggctcagaacgcagcagcagcagccttgggtgccactgtggggaacaccgaagactgttgatgttggcatgctcttcttcagaatcttagggtaaacagcagatttttaccactgaaagacaaatattaatgtaatttatttattaaaatatttgtgttttccatgctagaatcacagatgcatgttagaattaaagcccaaatgaataaatttaccttttacttcttcttacctgtgagtctattatttgtaagaatatagggaatagagaaacttccaaatgttagtaaaacaatcaagtaatcaaagagatgaaaagaaatgacaagtctaggc

SEQ ID NO: 467903 - DNA, 646 bp, Homo sapiens
gctcggatgccataatgggtgatggagtcagccaacattgctccttcagtgtgcatgcccttgttcatttgcttattcacgacagatggtccctggtgtgtgtaaatgtgaatgtggatgaatgtgagagacaggatgaggctataaatactcatatttatcacttttacaatggcacagcaaagtggagattgattaagactacagaagtatacaccaggtaccacccaggaagaggaggggctgggctcctccctgctgcaaaagaacttccaaaggctccaccccagggcgcagatgtctttgatctctcatgcctccctaaaatgtatgaagccaagctgcaccccaaccaccttgggcacatgttctcaagccgtccagagggctgtgtcatgggccatgttgaacagacacttcaccaaagaagatatacagatggcaaacaagcacatgaaaagacatgcaacatcattcatcactgtgatattagtagaaaaagtgagtaatggaatgccagtcagatggctttgctgactgacttctttgacctcacacagcttaagatctctgtctcagaccttcctaagtgaaaaaagaaatcaaaatgtggtttgcctcacagataattttgaagattggcaag

SEQ ID NO: 467904 - DNA, 677 bp, Homo sapiens
agggtccctctggtccaggctgccatgctctccccctgtattgcaaccttccttctgccagacacctatcccaatgcaacagggagagccgataaaatccataagaaaggacatcaggagacaattcttctgactgccaaccaaagagaatcaacactacattctgccctgaatccaaagcacggcttttggaaaataaagatttatgatctggatagaggcagcgatgaatcacttggcgatacgtgttttctggcacaacttgtcaaaacctctgcacagctgtcctccaattaccgagcttctgcccctgtcgccagtgaaaataaatgggctgataattacagcctcagacgttcttggagcctgcatttccctgcacttcgccagcctgtgcgtctaatggggtcacattatgaagtgtgggcattgttccaggacttcagcactccctctgtcttcttccaggatgacttcacgtcccaccattgactttcacaagccatgaaggacataagtccaggtcacagatggctggtcatcctagaaatgaccaagtgaaagctgagagtatagagcatggatgcagaggcttagccatgcctggggaagtgcagtgtgaggaggtttggagggttacattgctccggaccacactttgctctctgtggattggc

SEQ ID NO: 467905 - DNA, 612 bp, Homo sapiens
gcatttcaaagtagctagaagcgaggattctgaatgttctcaccacagagaaataatagtgacatacctgggaaccgcaccagttcccagaaccataattctaaattctgccagaccatcctgcagtctctaaattccaatggacgttttgtaagaggtgtctgggcgcaatactctccggcccgaagcaaggggacgtttgcgaggagggagaaatttaaacccccttcgctccgcgccacctgggagcactttggcgccgcagactcaggagccgacgccatctccaggacggcctcggtggcctcggcaggaggcaccttcggggagcggtcccgcactcctccttcctcagtccccggtcctctgcaccgctccctctctgctgccagaggacctgtccgcgagctccccgcgctgccctggggacggaaaagtttgtttctccaacgcgcaactttcccgctccaggcggcggggaccccgagccggagttttggccaaaaaatcccagagtcctatacctcctgcgcgcccagacctcgggggcgaagggcggctcccccggcgcgccccgatccccgccgcaaagaggacttggtggactagagg

SEQ ID NO: 467906 - DNA, 554 bp, Homo sapiens
gcttacactgtagcctcaataggagacaagattcttcccctaatgctagacttcgatcttgattgtttcatgaaattaaatactaaatctggctacaaagtgatttgtctgctactcgggatggtacagagtgctgaaagaaatccagctcttgagtctcttagatcccatcctgtaggaagtggtgggaaagccagcggaccatgggcaagtaaactactggctacttggcaggacgtcagactgtggtctctccattccccaggactcctcagaaccgtctggtactgccagtgctgggtgaacaggccaaggagagagaaaggagaaagagctgtattgggaagagaagctggctgtgcctctaaactgagatggaaagaagcattttacttctcagagtgcacttgggagcagacgaaagttgaaaaaagaaagaaggaaagatacattgattgctaggaagaaaaaaaaaagagggatggaaggaaggaaggaagggagggagggagggagagaaagaaggaagaagatgggagggagggaaggagggg

SEQ ID NO: 467907 - DNA, 516 bp, Homo sapiens
tcaaagccttgcactctccagcagggcagaggttgctggtggatgctgcctgaagaggctcccacctgctgtcagcactgggagtctctgtggccccctggcagtgaggactcgtgtgctaaccacttagcctctggtggtcatggcgaggcccagcatctgcaggtgtgctccacaggcactcaaggccccagtgtctgggatggatgcagctgcaggattcaccttggaaatccattgagagtagctttatgtttgaaaacaaaagggcagattgaaaagcagataagaagtactccaaagagagatagtgctaaaatgaattttattattattataaggcccaaacaactgggacatacagaacccttctctctgagttccactaaccatggcacgaaggcttctgtggctgcccttccttgatcaagtgccttcttcttatcagacgtgctattttattgaatgctcacagcagtgctgggtggtatgtattcctaaggcctgagaggtgag

SEQ ID NO: 467908 - DNA, 1391 bp, Homo sapiens
ttaagaagtctaactgggacacagggtggagccaagatggccgaataggaacagctctggtctacagctcccagcacgagcgacgcagaagacgggtgatttctgcatttccatctgaggtaccaggttcatctcactagggagtgccagacagagggtgcaggacagtgggtgcagcgcactgtgtgcgaaccgaagcagggtgatgcatcacctcactcgtgaagcacaaggggtcagggagtttcctttcctagtaaaagaaaggggtgacagacggcacctggaaaatcgggtcactcccaccttaatactgcgcttttccaaagggctaaaaaaattgcacaccaggagtttatatcccgcacctggctcagctcgtcctatgcccagggagtctcactgattcctagcacagtactatgagatcaaactgcagggcagcagcgaggctgggtgagggacgcctgccattgcccagacttgattaggtaaacaaagcagccgggaggctcgaactgggtggagccgaccacagcccaaggaggcctgcctgcctctgtaggctctacctctgggagcagggtacagacaaacaaaaagacagcagtaacctctgcagacctaaatgtcccggtctgacagctttgaaaagagtagtggttttcccagcaagcagctggagatctgagaacaggcagactgcctcctcaattgggtccctgacccccgagcagcctaacaggggggcaccccccggtaggagtggactgacacctcacatggccgggtactcctctgagacaaaacttccagaggaaccatcaagcagcagcatttgcggttcaccaaaaatatgggactatgtgaaaagaccaaatctacatctgattggtgtacctgaaagtgacggggagaatggaaccaagttggaaaacactctgcaggatattatccaggagaacttccccaatctagcaaggaaggccaacattcagattcaggaaatacagagaaggccacaaagatactccttgagaagagcaactccaagacacataattgtcagattcaccaaagttgaaatgaatgaaaaaatgttaagggcagccagaaagaaaagtcgggttatccacaaagggaagtccatcagactaatagctgatctctcagcagaaactctgcaagccagaagagaggggggccaatattcaacattcttaaagtaaataattttcaacccagaatttcatatccagccaaactaagcttcataaatgaaggagaaataaaatactttacagacaagcaaatgctgagagattttgtcaccaccaggcctgccctaaaagagctcctgaaggaagcactaaacatggaaaggaacaacc

SEQ ID NO: 467909 - DNA, 1600 bp, Homo sapiens
actgtataattatgtgttcataaacctcatgtctccccttgctgattgtttagaaaacaaagaataaaaattaaaagcagggagccaagatagctgaataggaacagctccattctgcagcacccagagtgagcgacgcagaagacgggtgatttctgcatttccaaggttcatctcactgaggaggtaccaggttcatctcactggggagtgccagagagtgggtgcaggacagtgggtgcagtgcacaatgcgtgagccgaagcagggcgaggcttcgcctcacccgggaaatgcaaggtgtcagggaattccctttcctagtcaaaaaaaggggtgacagatggcacctggaaaatcaggtcactcccaccctaatactgcgcttttccaatggccttaacaaatggcacaccagattatatcctgcacctggcttggagggtcctacgcccacagagcctcattcattgctagcacagcagtctgagataaaactgcaaggcggcagcgagactgggggaggggtgcccgccattgcccaggcttcagtaggtaaataaagccgccaggaagctcaaactgggtgaagccccccacagctcaaggaggcctgcctgcctctgtaggccccaccactggtggcagggcacagacaaacaaaagacagcagtaacctctgcagacttaaatgtccttctctcacagctttgaagagagcagtggttcttccagcacgcagcttcagatctgagaacaggcagactgcctcctcaagtgggtccctgacccctgaatagcctaactgggaggcaccccccagtaggcgcggactgacacctcacacggccaggtactcctctgagacaaaacttccagaggaacaatcaggcagcagcataggtggttcaccaatattggctgttctgcagccaccgctgctgatatccaggcaaacagggtctggactggacctccagtaaactccaacagacctgcagctgagggtcctgtctgttagaaggaaaactaacaaacagaaaggacatccacaccaaaaaccaacctgtacgttaccatcatcacagaccaaaggtagataaaaccacaaagatggggaaaaaacagagcagaaaaaccggaaactctaaaaatcagagtgcctctcctcctccaaaggaacgcagctcctcaccagcaatggaacaaagctggagggagaataactttgaccagttgagagaagaaggcttcagaagatcaaactactccaagctaaaggaggaagttcgaaccaatggcgaagaaaactacgtgacaaagaaaggtgcacaagcctcagtaactgatgcgatcaacgggaagaaaggaatttcatatccagccaaactaagcttcataagtgaaggagaaataaaatactttacagacaagcaaatgctgagagattttgtcaccaccaggcctgccctaaaagagctcctgaaggaagcactcaacatggaatggaaaaaccggtaccagccactggaaaaacatgccaaattgtaaagaccattgaggctaggaagaaactgcatcaactgacaagcaaaataat

SEQ ID NO: 467910 - DNA, 554 bp, Homo sapiens
agggcaggaacaggccattttcacttcttttgtggtagaatgtcattagttaaggcaggaaccggccatctggatgtcacaaggccaggaactattctacatccacatctatatcctctttactggatgttctcttcatcagttacctttccagagacctggctcttccatgggaagaggtttctacttatttttttcaagtgggggatgttgatccttttatattccttgggtttggcatcttttgagctcccaataccaccttctgaccattacttctctgacgctatgtgcaattcccttgtctttttgagattcatgccatttacatttaccaccctataccactctttgttgtctataatttaccaacctctcagtcattccttatccattaaggccttcagcatgaggttcattatctttcctttgattccagagtttatgtccttgcccacatagctaaaatgaaatttacacttaaatgattatttagcaaacactaaggcttgatacaatgattgagaacctgtgatttctcattaatctttatc

SEQ ID NO: 467911 - DNA, 804 bp, Homo sapiens
ctccttaagagctggtaccgtacactaggaactaagaaagacaccagagtgttgttgggccatggggaagtccagggtgtcccaaggaggtccaggatggccaggagatgaggacagggaacttaggagtcttggcagcaccacggtggttggcaagaacaagcaccttacaaaaggcagcaaaaagggagccaagaagaaagtgatggatccattttctaagaaagattggtataatgtgaaagcatctgctatgttcaatataagaaatattggaaagacgctagttgccaggacccaaggaaccaaaattgcatccgatggcctcgagggtcgtgtgtttgaaatacggaagacctcttatgctcagcaccaacagatccgccaaatccagaagatgatggaaatcatgacccaagaggtgcagacaaatgacttgaaagaagtggtcaataaattgattctagacagcattggaaaagacatagaaaaggcttgccaatctatttaccttctccacgatgtctttgttagaaaagtaaaaatgctgaagaagctcaagtttgaattgggaaaactcatggagcttcatggtgaaggcagtagttctggaaaagccactggggacaagacaggtgctaaagtcgaatgagctgatggatatgaatgaccagtccaagaatctgtttaaagttcagacttataatagtggcaaataaaaagtcctatttgtgatgaaaaaaaataatgataatctccagttccatccatgttgctgcaaatgacatgatttcattcttttta

SEQ ID NO: 467912 - DNA, 745 bp, Homo sapiens
cacctcggcagccagctggctgctctctgcccagacctgggaggtgtagggtgtctgtggggtggttccacacctccatgctgcggtgtggagaggagtcagccctggtatgcttgctgtaggagcaggagggaggggacaagggaacggccatatcgacgatggcttctgtcttcctaaggacgcagtccaggcctgcttcatccctccaaccctgctccaagcctctgggataaccagcagtgtgaggctggttgacgacagtggctcagcacagcctttgatgtcaccctttttatgcctccctgtggccctacactgctggcccacctcttcccaggtgatgagaagttggattcagggcctatctctgcagtgctgctggctggctgtgcctcagcaggtctgcactgtgctcagaagcttcatcagtgtgtttttccctaagaggctggggctggtgggcaccctgggacacgactgtgagtggaggaggccagtgctctggggcagaagcagcccaggcacactgcagggctggcgcatcctgtgctccagctgctgagcctccccccaccgcaccctccccctgccaccccaccagagggcacagggacaggcacctgccagcctctctttgctccaacccctggggcacaggattgccaaggtaattatcatcagatgtagatcttaacctaatattctcctatagaggaacttggagtagacatgaaaattctcc

SEQ ID NO: 467913 - DNA, 2127 bp, Homo sapiens
aggagccagggcaggcctcaaccccatgtccagggcatctcaggccagctgtgaccagccgtggcaggaggtcctacagaagcccaggcctcctagactctgtgaactgtcctatgacggcagatgggtgctctctgatgaacaagtggtctgtgatggacgggtgctctgtgatagatgggtggtgtgtgattaatgggtgctttgtggtgaatgggtggtctgtggtggatgggtggtgtgtgatggacgggtggtttgcggtgaatgagtggtctatgatggatggatggtctatgatggatgggtggtctgtggtggatgggtggtgtgtgatagatggctggtttttggtggaagggtgctctgtgatagatggatattctgtggtgaatgggtggactgtggtggatgggtggcctgtgatggatgggtggcctgtgatggatgggggctctgtggtgggcgagtggcctgtgatggatgggtgctctgtggtgaatgggtggcctgtgatggatggctggcctgtggtggatgggtgctctgtggtgaatgggggctctgtggtgaatgggggctctgtggtgaatgggtggcctgtgatggatgggggctctgtggcaaatgggtggcctgtgttgaatggctggcctgtgatggatggctggcctgtgatggatggatgttctgtggtgaatgggtggcctgtgatggatggctggcctgtgatggatgggtgctctgtggtgaacgattggcctgtgatggctggccagcctgtggtggatgggtgctctgtggtgaatgggtggcctgtgatggatgggtgttctgtggtgaacgagtggcctgtgatggatggctggcctgtggtggatgggtgctctgtggtgaatgggggctctgtggtgaatgggtggcctgtgatgaatgattggcctatgatggatgggggctctgtggtgaatgggtggcctatgatggatgggggctctgtggcaaatgggtggcctgtgttgaatggctggcctgtgatggatggatggcctatgatggatggatgttctgtggtgaatggctggcctgtgatggctggctggcctgtgatggatgggtgctctgtggtgaacgattggcctatgatggatgggggcactgtggtggatgggtgctctgtggtgaatggctggcctgtgatgaatggctggcctgtggtggatgggtgctctgtggtgaatgggtggcctgtgatgaatggctggcctgtggtggacgggtgctctgtggtgaatgggtggcctgtgatgaatggctggcctgtgatggatgggtgctctgtggtgaacgactggcctgtgatggctggccggcctgtggtggatgggtgctctgtggtgaatgactggcctgtgatgaatggctggcctgtggtggatgggtgctctgtggtgaatgggtggcctatgatgaacggctggcctgtggtggatgggtgctctgtggtgaatgggcggcctgtgatggatgggggcactgtaatggatgggtgctctgtggggaatggctggcctgtgatgaacggctggcctgtggtggatggttgctctgtggtgaatgggtggcctgtgatggatggttggccagtgacagatggctgctctgtggtgaatgggtggcctgtggtgaatggctgggcttgtgatggatgggtgctctgtggtgattgggtggcctgtgatggacgggtgttctgtggtggatggctgctctgtggtgaatgggggctctatggtgaaaaggtgacctatggggaatgggtggcctgtggggagtggttggcctgtggtggatgggtggcctgtgatggatgggtggcctgtgatgaatgggtggcctgtagtggacaggagaaaggtattaacacgcactacacctggtagacaatgcgaatgtcagtggcctgggtggcctcttcccagtgcccaccatttggaggcccatctgcccactcctcattctccctagctggtccctcctccatgtaccacagtgaggctagcagtcagggctggtccccagagagctacagacccctccttcggtcctgcttaaaggctctgccct

SEQ ID NO: 467914 - DNA, 705 bp, Homo sapiens
agtctcagccacatctagttagaagtggcagtttctcctgcgcactctctctctcctgcagtcttatgaagaaggtgcttggtttccttaggcctcctcagacatgtggaactgtcacacgtcataggtccgtcacacacactcagcagcccttccaccgaggcagccctgaccttctgttgagccttgccccttgggccgtcctaggcctccaagagctggccatatgggtaggcccagattctcatgggggtcctcctacgcatgaagctgtacaggaaagggtcccgggtttcagggttggagaactcagcagggcgtcccacggatgtttcgacacttcccgttccccttctgggccctgcgcctgccctgagctgcaaagtcgcccagaacagccacctctccctgcctcactgactgcagctctgcccagcaacatctccttcctgactcatgaggcagctcactccctaaaaacctcccctaaaccccctccgtagaaataagttatctcacttaatgtgaatactcgtatgtttcactgcagaaatattaatgaatttggctgtcgtgagttgctacttcaagcacactaaggatgttccataattatacacctttgtaaaatctgaaaaagtttgaatcacaaaatacattgacccccaagggtcagaacagtggacctgaatacttaaaagaagc

SEQ ID NO: 467915 - DNA, 2543 bp, Homo sapiens
gtggttgctcacacctgtaatcccagcactttgggaggtcaagtgactgggaaagagagatgtcagctgggttgtcggatttcctggtttatttcaacactatcttctggctcccacggcaacaacagcagcaaaacagcagcaacagcaacaacagtagtgtcaacagcagcagcgacagcagcaacaacagcagcagcgacagcagcaacaacagcagcaatagcagcaacaacagcagcaatagcagcgacaacagcaatagcagcagcaacaacaacagcagcagcaacagcagcaacaacagcagcaacaacaacagcaacagcagcaacagcagcagcaacaacaatagcaacaacagtagtggcaataacagcagcaaaacagcaacagcagcagcagcagcaacagcaacaatcaatgacctttccgagggctcattctgcactgggcacaagggtgtcacagttcagagctggcggcttcatttaaggagcaaatgtgctccccctgctggctgagggcagccaatacatcggtgtgctgcaaaaatcacaaacctggtttttgggctccctccaaaccacaggaggctggactcagaatgtgtaacagagacaacattccccattttcatcatttttctaaaacctttaaatttggtgacagaagttgttggtacccttcttccaactctgccttttatgggagtgaattaacttgagtgggagagatgggtagggggctttagaagcatctcagtatatcctggtttattccataattatgcatgacctcatggagcagcccctgcccgggtaccctgtcttccaaagtaaatccaagtgtgagtcattgcgtcattcccatatactgactagaagagaccaagttagatttcaaacaagctcaggacacctagtattcaaaaacttatgagccaggagccacttcttcttccatcattaaacttattgaatctgttctcaagtctctatatctggatatctggatgccatgctcctgtataaaggaaggagaaggatgtctccatggcttaaataagttgaacatttaataagcctgagccttaagtattgctgggggtgatgcaacaggaatcagcaatcaatagttgctctttttagagtgactagctgcatcccataggaaaacttgtttagtctccttccttctctgtcttatgactcccccaaatcctcactctggcaccaatcaggagatgcatgggaaaagatagacctgtttttgctctggggctttctcttcttttttctaataaagttatgagaaaactggaggataggcagtgggacagccaccctatgatgagcactgatattaagaagggttcttgtcatttggttcccaactgcaagtcattacaaggaaaggaacgttagtgatagaaaggcacaagcttcagctcaaatccttaactttgggattttgtcataaaactcttatgctgagaatggtcttttagagtcctttgctcactactcatgcacaagtgtctgagtttcccaagggaaaaataagcaaaaccttcatgctgcctttggattaatttttttgtagcttagaagttggtacaatatcaagtgattaagtgaacgatgacattcttttctcgccttagatcagttttgcttttcccatgacaacctgaaaatagatatctatattatctccattttatagatgaggaaacataagcttagagaagtaaaagaattcattcaagttcacatagacagtcagtggcagagtcaggatttagacccacatatttctgatttcaaaactcaagttctttatcccagaactggcatttggcatgtattgctatacatcctgtgtaacttgctactttgaatttagctctttgtattttctgcagatcttggcatatacaaaaagctcaataaatgcctcttaattagttgattagtggtgagggttttttcttaatttgattcctatgattttattatttatttccaactagtagcattttagccttcttgagtataagtcattaaagacctgggatggcctttgttgacaagtatcattttaagttctggattccaaataaggaattaatagatagatgtcagagaaggagctgaactagagctcctgagtcttgatctaattagggagcttgatgacgattttgtttatagactatgaatcattcatttcatttcccaggacattcagctaagcttcttcattactactaccacaaccatcatcatcagcatcaccaccagtatatagcaccatttaatgaattgtcaatcgtttcccaactaattaaaaataagacctttttcatatatcaaattcccttaaagacttggtgtgcttgtcttctgtgcatgtgtggagtggggtcagcagcatgggcttgggagattgtcagctcagatctcagtcccagctctgctgctactggcctggagtccctgggcacgtcacataaaggcaatgaaggggacaataaaatc

SEQ ID NO: 467916 - DNA, 547 bp, Homo sapiens
cagtggttgacatgctttaagactgcctccttagtgcacagaggacaatggcacaacaccatggccaaccaagcccaggccaagctcccatctccctccacacttttcctgctcacagccccggggagtcaggtccacagggctctgccctgtggagaagcctcctctgctcaagatgtggccttggagatgtgctccgaccatgcccagagccacacagacccaagtgcagccaggaccacccacactggcctgcccctgccctctgatggctccttctggcccaaggaccatcccctcctcattgaaaccctgactcggggatgctctggggaaaggggaggtttttttcgtgggcgtcctactgggaactctgcacccacggccaggcctcctgccgcgtgcgagtcttctgacaaccccctgcgcaagcggggcccctccggccgccccgggacgtgcgtgttcctcccgctcgcggcccaccccactcgcggggcgtcctcccgccagcgggacctgccgtaggaggggaagggaagggaag

SEQ ID NO: 467917 - DNA, 1262 bp, Homo sapiens
caaccacaggaactcaggaatgggaagcccggtaaatactaggatatgggactacgccgcccttcctgtgcggcagtccagctgcaagatcccccaaagtgctcttccatcttctgtagttcaggtccttctgaggatgacctgctcgtggcacaaatgcttcagccctccagagattttgcctctgtccacagttcctggggccctgtgcaaacaaagcagccaaaccttagagatggcacagggagtctgagccaggggatgaggaggggagagcaaccaggaaccagagaggatgatgatccagaaggaatcctttggaaaaatgggattgtgctcctgccaggtactgaaaagcacattgatttcaagccaaacacacctgcaggcctgatgcggccccagggcggttggtttgcttcctgtgttctatgccatctaaatgtggagctctttattgaacaagatagagtaaaatccaagtcaataccctctgacggcctcatctcaaactaatggctatggcttaaattaatggcttgatttaaagttgactcagctcagagtcctgtcagcaataagccacaggaattctgaaaatgatgcacattttaaagataacattttaattattttatcttatattttataattacaagggatgtaattcacatatgtattagtcatttaaagtaaacatattataacactctttaaaaactgtatgtaatagaatttaagtatcttgcaatttgatagtcatcatcacctatttaaaaatatatttgaggccagagggagactctgtctttaaaaaatatatatatatatgtatatgtatatatatatgtatatgtatatatatatatgtatatgtatatatatatgtatatgtgtgtatatatatgtatatgtatatatatatgtatatgtgtgtatatatatatatatatatatatatatgaacttaactctttaatagctggaaaattaacactgttccttttcctccttacattgtatttccatttcccacttccgtctttgaattttatcctaatatattttttaatggctgaaagtcttttattgatatatttatcaaacttccctgtggcaaaaatatgtatatggcaaaaataagtatataaataaaaatagatttttcaaagtagttcatgcgattacaaggctcttacaagtgttaagaatatttattgttgggtggagccaagatggctgaataggaacagctccagtct

SEQ ID NO: 467918 - DNA, 972 bp, Homo sapiens
aagccattttggactacttagagcaggggtctgcaacctatgggctgatactggtctgtggcctgttaggaactgggatgctacagcacgagagaccctgccggtcctccccgccgggctccctcgcagctcgcagctcgcagctcggggaaagggcgggctgcgccctcaggacctttctcagcagccacagcagcgcatcccagcacctcctccaggagccccgccatctcctgccacccggactttccccacagcgcagcatcccctagtcccttcagggctggaacagtggtacccgcagacggtgcaatagggaagtcccttttgcctttccatggaagctgtagggcgcttagagctgctgggggaggaaaagaaagaagaagaagaaatacagtaagtgtgatatgggtacaaagaaacgaacatgcagcttccgtgtgcctagacaggagccctgggacatgtgcactgggcctgcgtcatcgcctgccttcagcgggctccagaccttccagaggcccccctcaccacccgcggccctcctgaggctcccctcacccccacccacctccgaggccctcccgaggctcccgggctcgcgctcctctgagttgcctgcggctgactccagcgcctgtgacccggacccagcgcgcgactcacagaccccggctctgggcacccctggtgagtgccttctgccccagagctccacacagcaccagcctgcacgctcccccagcttcagttcatttgctgctgtcctgacaggtcagtcgcttgagcatccatgctgccaggtgacaaacccagtcacgcagaggtgtacatcctttagccagggtgacacgatgtggagctgaatccaagtccgggagtctggtgaccgtatctgggctctgactgcgcagctgtctcacagtgaaacaaattggggactggccttgtcctgagtggccttaggac

SEQ ID NO: 467919 - DNA, 1190 bp, Homo sapiens
agagcaggcactcacagaacacaggttggttgggggccttgatgtacccaagctagctgagatggccttgcagaccctggctgagcgggcaggtgctcggagacaggatcctgacagttgtggctcctcagatgccttcatctgtccaaatggtctgacgatggctgtgccccagggccaggagtgtgtccctgtgcagtgtggtgcttcaggctgcctgtgctgcaccctcctggagctccaggatggctccttccccttggatcccttggacacagatatctttgtgtctctggtctttgggatctggccccaggctctcccacaggaggacagactgtggctgctggcctggtttgtggaccctaacgatgaagtctctatgatgcagttagtgctgctgcccaccctgcacactctctgccccaccctggtgaatttccctgctgactatggggtgcccaattgggggaagggggcaaatcatccccctacgtggatcctttctgagctagaaattcccagtgtgagctgctgtgttgaatttaagaatgatgtccaaatgtcatcagtatccattgcttggctctgctcccagggcctgaggacaaagcaggactctgtggtcacaggcaacaggccctgctcactgccttgctccaccagcggccccacctatggctttggtggatttggtgcccactcagtgcctgtcctactctgccagctgcaggtctcactgactgtgcccgagcccatcctgagggtatgaaggatggcagcagctgtctttcccaaccagggtcaaaaaatgccacgctttctccaagtccaggccacgctagtttgagagtaaagggaagtggcagtttctgagcgtgatggcatcttctttcaactgcagtgctgagaaattgctggccttcctttctcaggaggcttggtgacttacgtgtgaaatcctagcatggctcagatattctcaaagctcagaatctgctgaggctctgctacctttagggctcatgggctcccgaatagcccttggtgtccgtcaatgctgcctgccggtggccccaggtgctcagggtggctgagttgtagcttgtcccagccctgttctgtgttggttgaatgtggcattggctctgccttgtgtttctgctttgccttctgctggacaggcctgt

SEQ ID NO: 467920 - DNA, 756 bp, Homo sapiens
tctgttcctattcggccatcttagctcagagcaaaacttttaatgaccacagttacagaatatgtttcaatatcaaatggcccttgacacagtgttgattcatgccatcatcattgtcatcctcctcctcctcctcctacttatcatcatcactctcaccgtgatccttatcaccatcaccatcatcctcatcatcactatcattatcctcaccatcattactatcatcatcaccctcatcatcctcaccatcatcactattaccaatatcaccatcaccattatcaccattatcctcatcatcatcctcaccatcatcatctttatcatgctcctcctcatcatctccatcatcatcatcatcatcatcatcatcatcatcatcatcatcggaatccaagaggaaagcagaagaaattctggggacctgcagcagacagacccagttaaaaaggcaactcaaaggctctagcaagatctcaatttggctctgggctatattaattcagagcatttcctcactgtggcattggctgatgcatttttattttctggattttaattaaaatcctgtaatattctgatctaggcagcataaaaactcacattcaaatatatgtgtgtctgtgtgtgtgtgtgacagcggtgtatacacacacatatacatatgctttgaataattacaatacagtttttctcatatatactaattctttttaagccaaaggaaataatttatatttttcaaaactttgc

SEQ ID NO: 467921 - DNA, 818 bp, Homo sapiens
acatgatattgctataaatgacaggactgtgggtctgagcctgctggaaagcagctgactttaggaagccgagggttcctggctgtgccaggaacctgtcctgagtcttttgcctctgaatcacctctgctgtgatgctccatccaggaatgaaatgatcccaaagcggcctcgccgcctcgtcagaactcgacttgctcggtggggatgagagtggaatggagagccgtgtccacttctcttgccctcaagatgcaacacctactgaacctgcagcttccccattacttggacacccagccccctaatgtggtctctctctgcctctccagccccacctgtccccggcacccaggctgtgtcctggggctctgcgctctggccaccctcacagtgactgtccagctttccctgggcatcgacgtggtaccagggcctcggctggggactggggttcacaggagtgaccagaaggtgccagccatgcaagaatctcagggggtaggggtggggagtggtggtgcagaaaagctcctgcaggcatgtgagcctgctgcttcctgcattggaaagggccagtttcactggagcaaaggggaggagaaactggaagtgcgattgccctgggcttccgttcgccccagtaactgcaccccaaaggcagaggccatcatcaattcaagtcctccacatccctgaactatcctgagtcctgagtcttgtcgttttggaagtctggtccttctatttctattttttgaatctctcatagcctttcaattaaaaatgcttttgctttcataagccatggttgtttt

SEQ ID NO: 467922 - DNA, 866 bp, Homo sapiens
atttcggccatttctcctcttggcaagcaggagctgattcatatgtctctattgaactggcgtggcctgtcctctgctgggatggcccagggtgctgactgtgaagaggagacagtgctctggagattgtatcaggcaaaatgcatcagtggaaggatcctgagccagctgctcaacagtgagggccctacacattcactggcctcttcaatggtggagaactcatccccgcgtctctttctacagaaaacactgaacacatctgccacgtgcacattctggctgcaggaaggatccagggctctaggactgagcctcatccaactgtgtccccagaatttcttctgctttcctcttggattcctgaaaacaatagagatggtctatgtgaaggcccacctggggcaagcccaggttccagatgatgaggaggagcatgataaagatgatgatggtgaggatgatgatgaggataatggtgataatggtgatggtgatattggtaatagtgatgatggtgaggatgatgagggtgatgatgatagtaatgatggtgaggataatgatagtgatgatgaggatgatggtgatggtgataaggatcacggtgagagtgatgatgataagtaggaggaggaggaggaggatgacaatgatgatggcatgaatcaacactgtctaggactttataaagagctttcaaccaaggcaatcattcaaataaaatatagtaaaaccattagaacattaggatttagtaaactgccttcagcaaaatggcaggttataaaacatcaaagagtatttttaagcataagcagcaagtatttagaaaataaaatattaaaggacatcccattagtgtg

SEQ ID NO: 467923 - DNA, 615 bp, Homo sapiens
tccttccaacaccgtgcagccggcttcattactccatcatgattgcttggggcaaatggacccatacggtccgtcttctaatatttgaggttctccagaagtggggctctgggttgtccttgccagaccccactccccaccatggtggctacgaaagggcatttcactcttcaccctgtcctcctccgcaatccccgctttcctggaagcccccaccatctggcctgaatctgcactatcaactgcatgtactgctgatgggctactcgtgcctctggagaagtcttcacagacacactaagcagggcctggctctgcccagagtctgctggctccctggctctgaggagacatgccaagccctgcgttggcaggcattgggagttgctctcactcctgtgcagcatggagatgccaggcagagggaatgcattatgcaagcccagttctgagacaccacgcattgtgctttccagcccagccatgcaatgctgaccatgtgcagttattgcagcaaggctggtgtcctggggacagggcatcctctctgtatagccaatgtctcagggcctccttggtgctgctgtatcttgctagtggtctatcaattttgtc

SEQ ID NO: 467924 - DNA, 469 bp, Homo sapiens
tcgccacactgacttccacaatggttgaactagtttacagtcccaccaacagcataaaagtctcagagaagtttgatagtctgaagccttcttctctcaactcatcaaagtcattctccgtccagcttcatttcattgctgtcaagaccctcacctgcaggtctgttggagtttgctggaggtccactctgaccctgtttgcctggttatcagcagcggaggctgcagaagagcgaatattgctgaacagcaaatgttgctgcctgattgttcctctggaagcttcatctcagaggggtacccagctgtgtgaggtgtcagtctgcccctactggggggtgcctcccagtaaggctactcggtggtcagggaccctcttgagaaggcatcctgtctgttctcagatctcaaactccgtgctgggagaaccactactcttttcaaaggtgtcagacagtgacatttaagt

SEQ ID NO: 467925 - DNA, 681 bp, Homo sapiens
cagcagttctctctggccctcagtttctgcttcagtttatccaatggcttacttttttcacaaatacttattgaatgccaacagcataacaatgatccaggaggtgtatcttctcacttttgggcttaaacataccggtggtgtgggaaaaaaatgcagcaaatgtgttatcaatggaagcatttgctgtaagagtttttttttttccttagtttcacttgttctagatctaatcaaacacttttcaataagtcaacagaactctcctcctaaaaccctgtctggttttttcaccttatctttagctcctctcccacgcatgctccatggtttcctgacttggtgcctctgcagtgctgctgctgcctccaccacgcccagttcttcaaagcctcctctgggcacaaagctgagctcccatcctctgctcgtcctctgccctccccattcagtggagctggcgcccttcacttcacttcagcagatcaacgtgggaggaggaataacatgggattgatagcaaatcggcattcattcattcattggctctcgaatatttggtatgcattacaatatgggggatggggggaaggggagggaatcgatgtttctaacaggacccagagggtcctgatgcaggcagtccttggaccacccttagtgaaattgaactagatttgc

SEQ ID NO: 467926 - DNA, 704 bp, Homo sapiens
ttggcaattatgaacaaagctgctataaatatccatgtgcacgttcctgtggacactgattttcaattcctttgggcaaataccaaggagtgtgatcgattgctgaatcatatgctaagagtatatttagtttgtaagaaactgccaaagtctcttccaaagtggctgtaccattcagcaatgaatgagagttcctgccactccccatccttgccagcatttggtgttgccagtgttttggatttcagccattctaacagaaataattggtgtcccttcatcccctgccacttccctgctgttccttccaagatgaagcatgaagccttggtgatgggtagtaccagtagagagatgcccccaataagacaactagtgctgtgtttgcctctggacctaaggtatgctgctttcctgacagccagatgcaatggggtgcacagtgttctggtaaaggaggaaggcttcttggtcaagagcccacctggacactggcctgaggtgcacaatgatcacaattgtcattgccggaaaaaaacaacttcataatgggtttctggaacggttaccgccagatttttattaaagaaatcaaagccaaaagtttccctttaaaacatgcatggtgaagggaaaattttaaaaacagctgcctactgagctatcacttcaatataaagcaaatggtgcttcaggcacaaaac

SEQ ID NO: 467927 - DNA, 581 bp, Homo sapiens
gtgaccacagtaacccaggatcctccacttactaactgtggctttggacgaatttttccactcctttaagtcatggttctcttcatttccaagatgttaagcacaacgctttcggatgtcatagagtgcaatgcccaatggactcatcaaacagagaagggtaaaatctgttgccagaaaagcaagtgtgcctcgcaggtggctgcagcccagacatctcttttctggctcacagagaactgtgaaatgaacttctgttatttagaagctacccagtttacaatattttgttatagcaacacaacaggaaaacacagtggcactgtggccctcccaggcaggacactggcacgtggtgcagatcctcatccttctattccaaagtccagggagcctgtgccacccttgggcaacccccctcgtttgacccagcaccctctcagcaacacccagataactttttctcccacgagggagcctgcctcaaggggtgtaaaaccactttttcaacttctatttggggccagaaaactgaaaaactaataacaaccaccccctccccgccccagaccaaaagcctt

SEQ ID NO: 467928 - DNA, 599 bp, Homo sapiens
tgaagtgtaagcattgtttagtctctttaaggacggggaaactgaggcacagagaagtaaatatgtacatactggacaagcagagaagcagccagggaccaaaagccttaaactttctagacaagaggaaggcaaaattccctttgcatcctctgcagtctcctagagagaagacagcaatgagcagcttggtaaatggtcctaccccagctgtgaattacctaaggcaagcactgttgcatggaggattaagtttccaacacatgaatattagtggccacattcaaaccatagcaggctccaaagccagagcctccttccctactgattcttgtacagttcttgctattaaaagcctccctggggtctctggagataagcaaaatctggtgcccaggaacaactttctctgtgacccaaaaccaactagtgcaccctttgaagccaccacttctcaatggtgtgaagtccctgagcctcagatacaggaacatggcatggggctaggagtcacacctgctgaggtctcacctgggtccttcacctactgatggactgggtccctctgaacttccaccagggagaattaaatgtgtgtt

SEQ ID NO: 467929 - DNA, 511 bp, Homo sapiens
tgcacacgataccatgtatgctatacacaagtgcatgatataccacctagacacacacttgccactcataccacactgggcacaccatgcacacatcacaggcacacacactgcctacacgaattccacattatacttccagataccacagaaaacagcatccaaatcacacaaacacacaaacttatatttggaaatatacccaaatatattcaatagaaattggataaataacttgccaaatgctgaacaaacgaaagaggaaaatattactgatcaacccactgaaagaaaggaagataaaatcagaaatactggaaatgtgataaatgtaaaagataaaataagactattactgaatgtattggttatcagaatacatccaaaaataagtggactaaacttccctatccaaaggctaagtacctagagtgcttcaaacagcaaaacctgatccatctaaagtaaaatgaagcatagaggttgatactttgacacttaggagttaggc

SEQ ID NO: 467930 - DNA, 1157 bp, Homo sapiens
tcccttctccactgtggtgcccaggagtacacctgagcctgcagcttcctatgtttccaaacatgttgccctccgttggtgctgtagtccagcacggatgccttctggacatcctggtctgcacgtacctagccgagaaggggctctctggcagctgtgggctgacagaggcactggtggcctttggggagggcagcagtttaggaagaaagaactgcagagacccctggggctccctcaggcaggagcctcactggtcagaccctcggatctcttcatgtctagtggccatgctgaagcaggaaggcaacttcttcctcttaggagtgaaagagtggtgtgattaccagcaagatcattattcttatctccatttctcaggacctctaacctggtctttggaccctgcttctcggaaccatggcccttacaaggtggagaatgtgaaagtcagagatctggagtacaactgcgcccatttggctgcagaaagcaaaatggatctctgtattttctacccgatgcatcttcatcaacatgatccattctctgatatgcatagcactctacgagttgccaattttcacatccatttttcttatttgatattcacctatttagttagaaagtaaaagtagatgtaatttccccccatgttatagagggggaaattaaagagaaggcaggcaaaatgcttttgtcaaacaaagaaagtggtaggttttctgatatctagcctaaactatttcagatataccaggatgtaacaaagagaacatacttgtctgttagtctattacatgctaagatatcactatttaggtttaaatatattatacagagatcatggggagaaattggcctctgcaactttgaagatgccaatatagcttcaaacagctcttgaggtatgtgagagctggcaaatgaaactgactggtagtgagaatcacataaaaagtcaatcatgcaacttaataaatgtcacttacagaaaacccatggtaccatcttactggtgaaataatggatgctttccctctaagatcaggaacaataccaggatgtctgtacttgtcacttctatttgacattgtacgggagattctagcagggtggcaattagacaagaaaaagaaacaaaagggagccaaatc

SEQ ID NO: 467931 - DNA, 1004 bp, Homo sapiens
ctccttaaatatccctccctagacaattactgggaacccttgccctctgtatggtcctggctgtcaaagggccactgcagtttcatggtgtggaggctgaaaacaatggttccacattccttgacattcctcccctggagaggaagattcatgagggctctgaggaagaacttcccttctggtcactcattgaatgctgccgagaatgcaggggtggctgggaggccccctgcagaaaccagcaccagaaggaacgccatccaggtgtgctgctggggtctgggccctcacctgcactccctgagagctccatgccctggagaaaggcctctgtgagggagggaaaggcactgaacctggacataggctgtgtggcctcagagtggagaaggtgttctgtggtcctcccggggagcctgactgatgagacggccatcaccctgccctggacgccttgcctgagggtgtctgtgttactgttgggggtcaccacgctagagagcaacaaggaggcctctgtgggtgccaggaccaccaggtactgatccccaagggaacaagggccacatcccaggccctgagagcccagagtagctctggcattcatcagctccttttgggctagctgctttgcattagagaaactttgcattagagaaactacagggtcattcagctcactcttcacctctctcctggtgccacactctctttgcttctcttcttattttcttcccctcctcactctttgtctccctcgtgtttctgttttttccttccctcctccctcatccgtctctctggttctctctgtcacctcttgcttccatcctctccctctttctggtgcctggtgattgagtcaggaaggtgtggaatctgttttcctgcccccagaactgtgacttcaaaccaagggaggaactgtttgggagaaagactgaggagggtttagcagttatcaaaggcccatcagtgtcggggcggtagacttcctgtttata

SEQ ID NO: 467932 - DNA, 1184 bp, Homo sapiens
ccggggagaagactttccctagtctctgcatattttttaataccacggatgacccccgctgccatgcactggctgctcagggcccaggccaagtgtcagccaacattgccacattgcgtggccctgcgtgtgctggaccccttgagagtccaagtcatgtcaccctccactcgggggcagctcacagcccagcagaagtcaaagaagtgtctgatgcccttttggctcaagggtgaaatggatgaggaaccacagacaaggagaccagggcttgtagagcctctgagacttcccttctcagatctccactgtgactggccatacagtttatcattgaaaccaggacattctgacagagaagagggctctgtccttcattttcctggaacaacaggcaaatactgggacagtatggtcactttgttcctccaggactttgaaagggatctgaatagcatcttggagaccactgattgtccagggcaatgaccccctcaagtcccctcttgggaattttggagtttgagtccccacatttccaggaagccatgctttggtttctgcccctgtggcttcctgagaagtcagcagggggctccatgagccttgccccactggaccaggctccctgagaaggttctgtgttggggttcaagatgagccacactcatcgctgggtttgtgtacactagagcagtacacttttttgaccacaacctatgataaacgttgtattttacatcatgatcatcatcatcatcatcatcaggtgttcaccaacccccacacacacactcaagacttattcttccccacagtagatgtgacacttgccaaaatttctcattttattctcttccttcttttctatttgaaaacacattcttctttcttttctattttgttttttaaaattgctgcttctactagtttatgttaatttcacagcctgactttgtccagcatttcccatacatggattctcacttaaaccccagaaatatccctgtgccatccaaggcaaaccatggacctgagcctggcagcccctgtgctggcacatctggaaggccccagatgtggccgcatctggggccttccagactgaccaaggccggagaacaaggccggagactgcaaaccacaagagaaggttatttagtgcattggccccaaacagccca

SEQ ID NO: 467933 - DNA, 3650 bp, Homo sapiens
cccagctcacccagtgagtggccgggatgaatctgggctgtctggtcagagcctgtgagagccacactgcctgcctttgtcaggtggcagctcctcctgctgtgttctggggaaagtgctggggaaagtcaattaacggcactggacctggcctgcgagccagcatcctcacttgcaaataaggctgagtggagccttttgatgcaaagattaagtgtatgtgaaggtgccttgtaaactgtgaagtggcatgcacttggcacactgaggtgtcaggatgcttaccgtctcggctgctaatttttcatctgcaggcaggcagttttgcaaacaaggctctgaacttgaagctcagagggtgagcgaggcctcgtgcccccagggcctctgcttgctccatgttggtgccccaacgtccagggatgcaaagcacagaggacccttagaggccacacctggaagtgctcattcaatggaccgagggatgaaagtgaggagagcgttaggggagctgtgcacagaaagcacagctgaagggctcacgtattccacaccctcttttcaaggctcattaataaggagcccagggcaaaatcatacatgtggcaaactccacaaccaccaaggccggcagagcagtgagagctgcattaatggggaatttcagtgaaatgccgcccagctcctaaattcataccagatgagttccagaagattaaagttattacaataaagccccagggaatcaatcacgctctgccttgtaaccttcttggttttctgcatcattcacacaaaccactttctgcagggcactggggtgttccctagctgggctggacccacaggccccaataaagcacttcaggttagaaagcctagcaaaaggacaggcttggttcaggtaagtggctggggtctggcaagtggcttgtttagtgaccagtgacaatgcggtgtgggagcccagtggggaagggtgggctccctaacccccagcctgcctgaggcatgcccctgggggtggtcactgttggaaccttgataaaaaaacagcctgaaagttggaaagtgtcttggtaaagagtagaacacggcacagttctctttgatactgtttttatgttttcattttttatcctttttttttcccaaagtgcctcccagccatccaggttcaatctcaagtccttgtatgctcaaccaggctcctggtgagccagtgatcctgcgccattctcccccagaacccctggtggccacctgcactgtccctgaactcctgtccccgagtgtgaacacagtcctcattctgcattacacccctgggagcaggcatcagctctctctgcctccacttctatgagagttccagatgatagaggtgcagaataattcactaaagagtctgcaacctctaaggcccagacctgccctgtggtctctgccccagccatctgctatctccctcccaaatccaagctctacaaaagttccaagtttgtccacgttttggtgttcaagcccccaaactctctgccccatcctgaatgctccttcctgcttcgcaatattgagtaggaccatccattcccttcagagaagtcccacactcagcttcagaaatgtagcttggtccagtgaccaagcaagatattcacaaagctgactgacacaggtgcatttcacacttcttatttctttattcttatttatgataatatttaacttaggatcaatgctcagcgtttgtgagagctatctggagtttcctttttctgtgcaactttttttggttttgatgtcagaattctattagctttccaaagaagaatctacagactctcccctcccccaacattcttgctcttggtcagtttaaacagaattcagcatttgaaaaaccccatcctgaaaacactgaagccagtgcttttgagggctgtagttcttttacaactgtttgatttgccatttaggcattcctatctcttcttgagtccatttcgatcatttgcatgttcctagaaaacggcttttcattcaggttttcagagtcattgatatgtttaagtaattctgttttcttctttttcgtactctggttatttgtactttctcatactctgtttctttgccccctgcctccttccctccccctttctctctccttgctttctttttcttttacttgtttttgttttccttgactgggcgaattaatattttgttgcactccattttgtttcattctattccattctcctccgccaccaaagacatacctttcatgtcatggtcaattgtatgaggcttttctgttgtcactgtgattctatttttaatattctttttagtgaccttaatcaaaagaattattatgtaaaatacctagttcatttgtttttattggttcatatttttactgaaaatattaatggctatatatttttctatgaacacagctttaatagtattccaaagattatgaaaaggaatattgattttaaggaaattccatgagggactttcagtttttctctcactgaagtattgtttagggaagagcttttaaaagttcagaattgttctgtgttattattgcaattagtaaattttgttttgcatttttagttttcctttattgatgttaaagaaggtggtttttgttatttttctttttcttttgagtttgaggttttctttgtgaacaatagaaaaggatacacattttctgtacacaaggcatggggacatatataaaatgtcatacatgtttatatgaatatatgtgtgtgttatatatatgatcaatctattaatggaattatttggattctctgtttcactcttccttaatttcttgacatacaggattgagtgagagagctacactgaagtcttccaatgattttgtgctttgtcaaatttatccttttatttgttccagtttttgctacatttattaatgctatgatgctatatagtaaataaaggttcttgacagctatatctttaaatcaatcaagcaataaatattataaaatattttatattttatgttgaacatttatgtcaaatacaatattttttatattgaacacaatttcaatattttttggtcatgaatgtaactgtgtataatattgatactcagctttctatttgtttacattgaattggaatatttttgctcttcattctgctttcagtctttctaagttcctttattttaatttcatattttgtagaatacaagtaacctggaattaggttattttgttttggtcctgactgatgtcccttctcctttgggttaggcttatacactcatatttattgcataagatatacactgtaagacctagctttggtgtttctacttgaaagcttccttggtttttaatgtttctgtcttttgaactagagtctgtgttctgcctcctaaaaaacatcaccagtaattaagaagcaagaatgtcgtttttacaccaaaatgttgattttaagcttcacatggtgaaattagatacgatgttgtataacatttggcaccttggtgagaagtcagattagaaaattgcccgtggctctgaactttctgtgatttgacttcagtgtatttttcccaatagagtcacctgttgcct

SEQ ID NO: 467934 - DNA, 4705 bp, Homo sapiens
tttgttctcttcttgcctaaatactgtgttcctcccgggggagttctcaggccagaccagtagatggtctcctgcccgcctcctgttttttgacgctggtgcaattctgccctccattgttttctcctctgtgaatgtggtcggggcaatgcccaccttacagctgttcacagtcgctgcagtacatggcacctgtggcacagcccggcacagtgtctcgggcaggactgtggacacgggaatacctgagcagacagttaagggcacaggctgttggaagcgggagtgcggtgcctggctggcctttgcagcaggttttgggaacactggggctacctggacttcagggaccataatgagggaatgcctttttgctggctttgtgtatttggccctttcccacgagtgccttctggtctctggcctgtcagctatcagccctgagcacccagtggttgagcaccccttgtcttatacatactgtgcactctactggatgcagtatggacatcatgacgactgcagatggaggctgacctggcatctcacagtgtcctggggacgtctggtgggggagctatgtctggccctcgggacctgtcttgggctctacgtgctggcagagaggctggtcctgctctgaggaagccaacccttgctgggagctgctgtttaagccaagatgcaggaagcctttctccatgcaggcctcacgttcaaggtgtgccacttggagcttgggggtctttgaaggtagcttcagtctgggatgtggctggagccatttcctgcagggcagttttggagctgcacatgctctgagaaatcccagtcctggaagccgctgaaggggaggaagggaagggtgggagggcaattaatttcaatagggttttggggcacgggtggtgtttggttacatggaaaagttctttagtggtgatttctgagacttttgtgcacccatcacccaagcagtgtacactgtccccaatgtgtagtcttttatccctaaccacccctccacccgttcccctagtccccaaagtccattgtgtaattcttatgcctttgcaccctcatagcttagctcccacttatgtatagattgtgaagatatttttcccaatatgggttgtctgtttactctgctgattgtttcttttgctgtgcagaagatttttagtttaattaagtcccatcaatttatctttgttttgttgcatttgcttttgggttcttggtcataaagtctctgcctaagccaatgtctagaagtgtttttctgatgttattttctagaatttttatgttttcaggacttagatttaagtctttgatccattgtatttcaccttcctacccccaagtggggaatcagctcgaggagtcaaaagagatgtttctttttccactcgggtcactgtccagtgtccccaaagcatagatggatccgagcgagagctctttccctccttgctgccctcctgccctctgcctggtttagcctcatggcttccttcctgcattattttaatgaccacctgcctgtgtacccctcgtccccaggctccctcctccagggcaccttcccttagcagtgagagagatctttccaaggcatagctggggtccccactttctaggaagaaaatgcaatgtctctcaaataacattcataggattttcatggttcttgagggagaaacgggaatccacatatctcacctgcctttatataccagagaagaggcagcagactgccaattccctgcagaggccctgggatggaaggctccatccctgtcctagccacttgttcttcccctgcatctgtggcctccgggctagtgtgctcagggatctgactgctgccttggcaccctcagccccatcatccttcccatgaagtgccctttctcaatgagtagcctcatccaccactgtcacccaaaccccaggcccatcctttgctgtatcttccctacttatccagctggttgaagctgcctctgagtgcagttaatctgctcttggtgccctcttgtctcctggcccaccctcacctgtggatacctggcgctgcctctccaaggccatccctcccaccagtgtttgccttacccctgtcccctgcctctcaagtcagaggtaatccctgctgctgctagggtgatctgtctagtgataaaatccgacctgctggtacagcctgcaagcctcacttggtcctcccctcccctccacctcagctcccagcatccttgtgcacctgtggccaaccatgcccagctctttctcatgtgcattggcctttgaacatgagctgtctttgcctggagcatcttttccctcctgacactggcaagctgctgctgggcctgcccttctcagcatgattttacctctcccaggaagctctccagggacccttaggctgggtctcatgtgctggctcttgcttcctcagcactctgttcatgctggagaaataaagtggcataaagtagagtcctgctccttaaggttcgagtgtagacctctgactgctcctgcaacaatcacttctatcaccagcatcagcaggttttcccttgccactgcatctttccaacagcacatcagcttgcagtgaaagcttggtctttaaaaataggaatatgaagcttgtttcctgcctcaggaccttgttcctgaccctactccttcctggatggcccccgtgcaggtcttctcagggtcatcttgactccgcatccctcctgcaaccaccatcccacttctctgctcctctctaaaggaacatctgcagaagtggcatgtctaataccaaaatgttggttcctaccccagaactgccccatccccacagccctgttctacctagacagggtccgcatctcacggagggcactgccatcttcctgtttggccttcccacccaggagctcctactgctgcctaccctacttcccatagtgcttggggttatgatctccatgtgcttctactccaaaccacctgtagtttcctgtcccttccagaagaaaatccaatcccaacaccgtggcctgtaaggccctgaccacctcctgccatgccttcacttgccctgttccagctacactgactgtgagattcctataacatgaagctgttttttctcactccaggacctttgcattgactccactccttcctggacagccttccaggctcttctcagggtgtctccctcacatcgctcaagtacgttccctcagagaggccttcccacacctccggacctggtgtccctggccatgtcctctcctgctccctgaacacagcaagcttccttccattcatattatttatcaggacctgaaatggtcaatttattcacttatttattgtctgtttctccttctggaaatataaacttccgggcagggacctcatgtgacttatttatcacctaaacccagggcctggctggtactggaggagctgatgggccctgggggttcctcccagcttcatgacatggcccaccgctggccttctgcatcaaggctgggaatactgtagccagaaggaaaatctctctgttaacatggaattaataaaagaatgcttatacatggttgcaggtaatatatatataagataaaaatgacattctgccgagagatagagagaacccataaactgtttttcctgcatccttacattgtcttcatatgaaaagaaaattttaactgctggcttacacactagttttagatgtaagccaccatttatgagaccttttggtaagtgctgaagtaaagtgatgagcaggaaaccaggccagcatgtcccggcaccaagaatgggagtggccacagggcagccttccctggagaacttgctctgatgccccgtgaagtcctgtgagctctggggccagaacctggcctggtacccctgcgccccagggctctgccccagtccatgattctttctgggattgtcatggacttaactcattaccaaacacgcatagccccttgaggagttttggcacacaaggcatttgggatgtcttggggaagaaaatgaaatactttaatgtaatcaaaaacacaggaagcagatgcccctgaaatataatatgttctaggagctgctcccctgctgtgtggcctttcatgctctgcaatattccaatgccttttttttttccccacagaatcactcacatgtcactttggtgagaggatgaggcattcagattgggagaacttgttgctttgtcagcattattttcagacaagaagttttacttcttgtttttatattttgagagaacaatgtcttacaacattcaggaattagtactttgcattttcaggttcactttggtgcagcccttagggtgcttgtgggtctggcccaaccttccctggaatgagtcttcggttgagggggcctgacgtcagcgccctgcagggttcatctgtgtcacctaaaagtgtccggctgcttggcctggctatttctgctgaatgcacaaaaatacattttgccttttctccttccaagttgcagtttcttttctgcaaatgaagcagaagaaaagtgctgcattgacatgatgaactgaaagcacactcacttcagggacatgtttcttcagttgggaaattcctcttttatttgtgactagttgttttctttcctt

SEQ ID NO: 467935 - DNA, 526 bp, Homo sapiens
tcctccaaccccttgtgcttcccggccatagaggagctgaaggatacacaacgactaaatgttatgcggtgtccaggatgggattccagtacagaaaaaggatatgtgggaaaggccgtgtcctggtggaggatgaggtgggtgaccccagatgtcagaggacaggaggcagagcagatccaccaaacctgctgagagggaccacccattctgccctgctgtctcctgcagccagggccagatggcagaggctgtgctttcttcctctgttttgggtggccatggttgcgggtctgtgggctgctgctgatgctccagcctatggccacagtgaacacccaggtcccagccaactgcctcccagaggactgctggatggaggcggctgcacattctctcctgctcctgcaaagcaacccaactcccatgccccatatcctgaaacaaagaccatgtgctctacagtgtggacaagcatgtcagttcagcatgaaaggagaggtggtccaatgacgtagtcacatga

SEQ ID NO: 467936 - DNA, 763 bp, Homo sapiens
aatatttgctgttctgcaatatttgctgttctgcagcttctgctggtgatacccaggcaaacagatgggaaatgactttgatgagttgacagaagtaggcttcagaaggtcggtaataacaaacttctccgagctaaaggaggatgttagaacccattgcaaagaagctaaaaaccttgaaaaaagattaggtgaatggctaactagaataaacaacgtagagaagaccttaaatgacctgacggagctaaaatccatggaacaagaacttcgtgatgcacgcacaggcttcaatagccaattcgatcaagtggaagaaagggtatcagtgactgaagatcaaattaatgagataaaattcaccaagtttgaaatgaaggaaaaggtgttaagggcagccaaagagaaaggtgaagttacccacaaagggaagcccatcagactaaaagcagatctctcagcagaaaccctacaagccagaagagaatgggggccaatattcaacattcttaaagaaaagaattttcaacacagaatttcatatccagccaaactaagcctcgtaagtgaaggagaaataaaatcctttacagagaaccaaatgctcagagattttgtcaccaccaggcctgccttacaagagctcctgaaggaagcactcaacatggaaagaaacaatcagtaccagccactgcaaaaacaagccaaattgtaaaggctatcgatgctatgaagaaactgcatcaattaacaggcaaaataa

SEQ ID NO: 467937 - DNA, 775 bp, Homo sapiens
agttcacagtgtcctggacatcttcttacccatcgatcctgctggggcagggaggacagttccttgcaacagtcactacatagatgccacactgctgtggaaatgaggtttgcctgggcacagccccagcgagtgggggtcctggcaccacatgctaagccttccccatgcccagtctttcactctgcactgaagctgcctgggtctgccttccctcagcacctacaggaaatccccatagcccccatgctgggcaccaagagtgggcagcatatagcaacagtccatcagctgtcaatcaggttctcaaatacatctgggcacctactggaaaggatctgaatcatccttttatccagcatctccatgttgtagacgctccctgctggtggtccctgacattgtctgctcctggcacccagccacaaacatgctcacggtgcaaagatccaggatcatctgaggcagataattctccatccaataacttgtcagaaggtcaatggcaggctaacgctgcatctcaatgcctacatcacgtaccccaacttcctctacatcgcacaacagcacaagaaaaagggcagttacactctaccttggagagcaaggtagaacttaacagtgatttttccctaaggccatggattttcactgtgctcattcatggaagaatagaaagggggaaattcggcttggtcggtccccataacttggagtattagatggttgtagagagctcggtttgatatataacagctgtgacattgctgtt

SEQ ID NO: 467938 - DNA, 638 bp, Homo sapiens
gttggtcaaagcattctcacatccatctgtgtctgtgcttctgctgtgagtagcaggtggtgatgtgggtccatctgaagctgctgctgattgaggaaaggaaaaggaaactccccatctggtcttctctggcattgccgatgcaggtggcacaagcacaccagttgccactggttatggagtctcaaggagaatggttccagctttcactcattcagtgtgaagttggctctgtgtttgtcatagatggctgttattattttgaggaacaccctaactttccacgcctaagtaacaaaggtccagaggcttctccctttgaccttttctgcctggcaagatgggaaattggctgtccacaacaaatggacaggagtgtgacctttgtaacttcacttcagcttctggttggctgctttctgcaaccaatcagactgattgccggccaccacttcatttacatgaggctgctccttcatggtcctcagactcaggagaacaggcttctgtttgggttctttttgtctattaatattggtatttataagtagttgacttcttcacttctatgtttggaaaatatgaggcaaaaagaaaatccaaagagctaacaatccttggtttctaaggttcctact

SEQ ID NO: 467939 - DNA, 606 bp, Homo sapiens
cgccggcctgccttcccatggcagaaccatgcgtgcacattttaaagtgctgtctgcagaggcagtgtcaaaattcaatccttgaaccacgagagaattcaaagcttgtcctgtggcaaaaactgaaatatatttacaggttcaaaatggcattttccacccaaatactatcagtgctatgctcactaaaagaaaatagaataaacaacagtaacaaaagatggatgggtaaaaattatgtgtgtgtctcacggggaacatcagaacacaggggctgtgaagagaacaggggcaaagtcctcagaggaatggaaaatattgagaggatgccctctgaaaagaaagtaattgatggagtgaccatgattttagtgatattaaccacctgcacaagagattgtgctggaggaaggttaccaaatgccatgatgagaatagatactagcatccacagtatctctctaaggaaagtaaaatgcttataaaataatgaatgtgtacttaacaagtcatggtttaaaaatgcttttagagttcttagcttattcaatcctcacaacattctgagaggatacagtttgaagtgaaccaagagaaatgggtgca

SEQ ID NO: 467940 - DNA, 654 bp, Homo sapiens
tgcttttctaaacaaaggagagctcagaaacaaattcaacttggaaacagatttcattcagacagtgattgttaatgtgctcatttgatttaggggctaatgctttcctttgtggcataactggaagaaccattacaggaaaaagtattcagcgatacttgttaaagcatggtaaggccgactgcactcaggatcctcgcaacaggtatccggacaatgggattttgcagtggcgaaaagaaattgacctcaactcccagtacagcaccagcaggtggggactgacagccaaggagcagggtgaagatgtaacctggtggatggttgaggatgaggaacctgatcagatattgagtggcaggttctggctaaatgggctgagcagtgttcttgctgacactgaattttgtaaggaaatgcacagatgggtccaggagaaggatgtgccagtgtgcagtgccctgagcattgctttcctttgtgtaaaaggaaaaggggctaatgcttccctttgtggcataactgtggctttgctttgtggcatcctggctgaacctgggttcagccaggataagagaagcccctctatttccaggaaacagggcagctgctgtgagtgtggcattgacaagcagattccactgtgatattttt

SEQ ID NO: 467941 - DNA, 596 bp, Homo sapiens
ttctgcagacttaatctttcctgcctgctggctctggagagtctaggtaatctggatgagagagattccttcagcacagcatgccagctcctctaaggaacagtcagactgcttccttggaaagcaacaacatcaacatcaacaaaaaagacccccacacaaaagccccatccaaaggtcatcagcctcaaagatcaaaggtagataaatccatgaagatgaggaaaaaccaacgcaaaaatgctgaaaattccaaaagccggaatgcctcttctcctccaaatgattgcaactcctctccagcaaggacacaaaactggatggagaacaagattgacaaattgacagaagtaggcttcagaaggtggctaaaggagcatgttctaacccaatgcaaggaagctaagaacctcgataaagggttacagaaagtgctaactagaataaccagtttagagaggaacataaatgacctgatggggctgaaaaacacggcataagaacttcctgaagcatacacaagtatcaatagctgaattgatcaagtggaagaaaggatataagagattgaagaccaccttgctgacataagacac

SEQ ID NO: 467942 - DNA, 548 bp, Homo sapiens
agaacggatccagggaactgtacatggcagagcagggtgccttgagaaaggaccttcccgtcaggggacacacaggcaaggaaacagacaagttcctagacattattaagaaaatcattgaggagaaaggatatctgcctaaacagaatttgaataccagtgaaagtgctccattcttgggaaaaaaatgccacaaaaaaaacccatttattggtggaattgacaagagttgccaatggaactgttgtggaattaaggaaaggccagggagagctccaaggcttatgccccgggcaactaatatgatggagttgacatttcaggagatgctgagactgtggaggaacaagtgtggggagaagggcaagctcagttttggacgtgctgggtttgaagtgcttgtcacatatccggggaaggatgtgaaaaagatggctggacagaggggtctggaagcgggggcagaggtctggtaaacatttatatgtcatttcatcacaaatcattcgcattttaaaaattccttggttaattacttagtgtttatt

SEQ ID NO: 467943 - DNA, 681 bp, Homo sapiens
tgcagtccatattgccagaagcaggggtatgtctaggggcaggagccagggtcagaggcagcaaagcttctggaaagaactcacaatggctttaaaggataaaggcaaaagagtaggggtttgccaggtagagaaacagaacagcatctcaaggagaataaacagaccagtcaaggcacagaaatatgaagtaactaatgtgttaggaacagatcctctggacaatggggagacaagccaggattttaagcgattacacgttcagacttgcctgtggaaaggtctctctgcagctgtgcaggagatgaatgagaaggcaagatgtccattgcacaaaaccaaagaggaagcttctgcaatcattgggtggaacagggtgaaggagtacatgtgttggggctactgggaatgccacagagcttccatggctgcagagataccggtgcatgggagcctggcagttccacagaggcagtacagtatggcccagcaaaaccagcccagctcccactctgccagttactatctgggtcaaatcaactcatgttcctggaccagtttcctcatctatgaagtggtcataatcatactacttcatgatacagtgaagattaaataagacaacttatataaagctctagggcttggtacataaatgtgacatattttaaatcccttcct

SEQ ID NO: 467944 - DNA, 700 bp, Homo sapiens
ttctgatgcatttgctttcctggggtcaagtaggaactaatagtttaaaatattcctcctcaattaatcctgagaggacatggccttggaatgcacagagtcttccagacttcaaaaggcaactccagtgcccaggggacacctagaccaaggttcgggctgtctgagaacctcatttaaagttctctctctaatcgtcagctcagccactagagctgacaggcataagcataaaagagtgaggaaggggctgcacgaggaaagagagatgaaggacttgacttgtgcccaagcccataaaaaggctgaaggaaaagaatgggttacactacaaagatataactggccgcctgagtcctgcactgggggagcctgcaaagtcctctatgaggtgtctgcattgaagcctggctggggccctgacttattttgggggattggaggggttcgtgccctgacttggggaaagctcacctctccagagagacgtgctgtagaaacacagtggaagacatttctagggttagtgagccaaggaaaaaaaaacaataataacagcatagtgataattgtagtactaattgtaggtaacaagtgcttactatgtgcttgatgatctgataagccctttacttacatgatcttatgtaatcttcatgataatattatgacatagtaggtattaatattatgtttattg

SEQ ID NO: 467945 - DNA, 821 bp, Homo sapiens
ttctgctgctggccaggctgcctctggaaccagcagttccaggagccgttttccctgagtgcagagcacgccactgagtctaggaacatctttccccagacacctcatctatttcaaactgagctctctgggccagaaatcacagtcacggtgtccttcttggaaaacggcttatgactcaatggctgccaaactcagctcttgggctggaagtgttctcacagaaagccctggggccgtggggaggatgggaaggactgaagccctgggcactgtggagcagagaaaagccatttccacaatactctaaattcttcacccacgaaatctgtggtaacgcttgtttacctgacgctcacctcctgctgcgcagcccggctcctaacagattggtactggttcgtggcctgggggctggggaccccaactgtagtggacagctgaatctgagcccaccctctgacaggagcacaggcctgtctgactctatcaccatatgtgacatggtgactgaactgaagagtgatcccttaacatatctgggcatgaatatcataagaagacaaagaaaatgggtgtttttatttgtttgattgtttgtttgtttgttttttccttattttttgtcattgcagattatatacaaaaaaaatacttagccatatgacctcataaaaaagatagcattgtcagaatatgtctgatagcaaatatctctgtagtattttagggggcaaagagaaatgcttcctgtttatgcatgaatcttgaaaaaattaatcaacctgataccaaagggtaatttcaaataataattatat

SEQ ID NO: 467946 - DNA, 594 bp, Homo sapiens
agccttcagctgctgggggccatgtgcaacgggccaactaagctgttaacacacagccatctgcagatggaggagctaagagagcactgcaacactctctctggggctttggggtcacaggcacccccacctgggtgcggccgtgggccctgcatggagcttgtttccactggtgcctggagcagctggctggatcttgcactcactcgctttacatgcttcctcctgcaagtggttaagtgcggtgggctgagtaaatggggcaccctagtaacactttatgagaatggaacaagaaacataatggacgcctacctgagggtggagggcggaaggagggtgaggatcgaaaaactacctattgggaactgtgctcattaccagcatgaccaaataatctgtacaccaaacccacgtgacacataatttacccatatgacaaactgcgcagtgtactgtagtacattgattttttaatgttaatcaaccttgtgttcctgggataattcccatttggtcatggtgtataatcctttcatgctcttgtatttagtttgctagtatttggttgaggatttctgcatctatattcat

SEQ ID NO: 467947 - DNA, 1346 bp, Homo sapiens
cttcgtaacaacctcgagccacactggtgaaaatgttgatggcctcataaatgtaaatgcgctctcttggtgactcttgcgtgcgcttgctctctctctctctctctctctctctctctctctctctctctctctctctctctctctctccaggacagtccaacagcccaacagcattctgagcaaaggctctgtagttaataaataaatgtgtaaatgccctctcttgtgactctctcacgtgttctctctctctctctctcttctctctctctttctctcctctctctctctcctctctcctcttctcttctcttcctctctctcttctcttcctctgctctctctctctcctctctctctcctctctctcctctctctctctcctctctcctctcttctcttctctcctcttcctctctttctcttcctctccctctctctctcctctctctctctctctcctctctctctcctctctctctctcctctctctctctcctctctctctctcctctctctctctcctctcttctcttcctctccctctctctctctctctctctgtctctctcctctctcttctcttcctctctctctctctctctctctgtctatctctctctctctctctctctctctctccaggacagtccaacagcccaacagcattctgagcaaacactgagggcacagttggagctttggtagctgcaacttgtggaggaaaaagttaatcatcacccctgctgggcctcctgctttacaatctcagccctgacagggcaggatgaggaacctgagacttggaagtggggtgtcttgactgtctggacctcccctttgcactccagtctaaagactaggatgaaatctcatcacagcccactggggattgctggccctgtgaagggtagtaggtgccaaaggagctccaaacctggctcacaggcactggcaggagccagagcgtggacagagagactggatcctgaatgtgctggatcaagagaactggacctgaagttggataagagagagtttattggaacgaaaaaacagccgcccaacttcttaggattaacagttatcatttcatcatgtttcttaaatgccagggaagttgcactagcggtgcactgccttgcacaagtatcccatcccagttcaccacaggcgagagctttcaaaattgctctaccactgtgtgccccgctatcagcaccacacctaccaccagatgggattcttgttgccaaccaaccagtgagtgacccagcttccaaatccctttttaaggtctcatttctaggaccactcacagtaccaacaatcttacggtgaat

SEQ ID NO: 467948 - DNA, 788 bp, Homo sapiens
gaaagaccctgggttgtgtgggatagcggaagagttgctggccttgtttgcacagcaccgggcttcacagaaatgctcttcggggtttcccagaagctgtgctttaatccctatgacagtggaagaggcttatattcagccacagctgtgagcgtggtgggagagttgctgcagggacacaaagaagaccaggtcctgagcgaggagctccgccccagggaggacagcctatctgccagagcatcctgtgagaggatggcccataagctccttgtggaccagaggcgcaggggaagagtgaccagaaggctgagctccagacatggtgacacagacctaagggcaccaatcacagagcggcaggtcgaatgcagggagtgtgtccaaatgaagcagtggcttggaagggaggggccagaccccccctgtcctggcccatacctgcaggattcagttactgccttgggaggaagaggagtggggaccaccagaggccaagacagcaacttggaagggaaagaacactgtctaggaatcgaagatgagaccatctgcatctctcccacctccagctgaggaccttgggtgcaagcctctgactcccccaacctccagctttggaagaataccccttgtcagcctatcccacagggatgctttagagcatcagtcggaggaagggcaggccagctcccaggccctatgatggccacactgcaaatctaagccttactatgggatgcagtaccagcgggatcagatgaacaccccagatatctttatcagcc

SEQ ID NO: 467949 - DNA, 924 bp, Homo sapiens
tgagctcttgtttagagaatggggaatcagaccccacctctccccagcatggcccagtccggaacacgccatgtcctggagacagcccgtggtgaatgttgtctgggggaatccaggtttacaggagccgctgtctccatatgtgaaggggcctactttgtggctcagctgctggccatctgcttccagtgtcaaccagggtccctggcagacagagtaagggagaaagcccactggctgggctgcttccagaagttcctggcctacctgctgctgtcggtggcctgcttcctccacccggtcctggtctggcacgtgaccatcccaggctccatgctcatcatcaccggcctggcctacttccttctgagcaagcggaagaagaggaaagctgcccccgaggtgctggcctccccagagcagtacacagacccctctagcagcgctgtgagcaccaccggctctggggacacagagcaaacctacactttccatggggccctcaaggaggggcccagctcccttttcatccacatgaagagtatcctgaaggggactaagaagcccagtgccctccagccccccaacaccctgatggagctgagcctggagccagccgactccctggccaagaagaagcaggtgcactttgaagacaacttggtccgcatagtcccctccctcgccgaaggtctggatgatggggacagtgagccagaggagaccacctctgacacgacacccatcattccccctccccaggccccactcttcctgtcatctcttacagccaccggcctgttctgagcgcttgctccagcctggaggacgctcagtgaggggtctacctagctcaatggccctccctggagtttcagggtcttctctggtcagcttttcaaggggtaaccagacacccccaca

SEQ ID NO: 467950 - DNA, 922 bp, Homo sapiens
tagcatggtgccagcacagagatacggagagaatttctctgattcctatatttactcagatattcttctcatccccaaacatcttaataggaaaggtaaaaacatccctgtgacatcattctcctcccaactgatgaggagctggggatggccccagtggaggaagatggcagcgcttcacagatgcagtgcccaagtctctctggccacggaatcccccagaggtaaatatcctccacattactgctggcatttccttctctactccacgaactacttcactgggacatattccaggccacttcctgctgcttggcgcctgctgtcccttgagatgagctcgcagcaaagatctgagtgggagccaggggatgagtcagactggagccacaacccgcaggaaccagaagccaaactggatactgggaacacaataaataaatacctgttggtaataggagggcagctcctatccaatggtaggaccatcccagtacaaaggtccagtcctcttgggtcatcacaggacaacactgaggccatcctagatccagaactttctgtggatgggcctctgttgcaactgcattgcaaccccttcttcttctgcccagtcctgctttcctccctcccccatgtgtacggaacccaagactacgcccctgtcaaactttctgcacacaatctcagtggctctatttcccagcaaacccaacctaagatggtagtggctgcagttgctggaggggcactggaaaggcatcatttctttaataaacactgggcccattgccacagctaaagagtaatatagtaaggaagaagagaaaatgaaaactggccaggcaatgggaagtcttagcttttcaatatattgttttcttcaataagtgctcaggtagccctactccaggccctggag

SEQ ID NO: 467951 - DNA, 933 bp, Homo sapiens
ccacttgtgggtgtaatcaggcaccccctaatgattaatgacatgacccaagaggatatgctccagagcaccctcctgggtggggaaacagggatcaagcggcatttgccagggaaggactggggagtggagctgctgggccgtgtggagtcgtgtgtccctcagtggaggagggacaaaccatgttccagagtggctgcgccgttggacctcctctccagcatgttacttggtgctgcccctgctgagactgtggtggacaccgaggctcagagagagcgtgggccctgctgcggctccaggcccttaagccccctggacttacctgggtggcagcagcagtcctgcaccctgcaacgctgtagaaatgggcacagtgtctttcggttcctgctcctcttcctttgcctccacctggggtccctgctcctctccctgtgcctccccctggggtccctgctcctctccctgtgcctccgcctggggtccctgctcctctccctgtgcctccgcctggggtccctgctcctctccctgtgcctccgcctggggtccctgctcctcttcctgtgcctccacctgctgttccgacctggttacccagtgagggaaatggggaaagaaacctctcctaccagagcagggattcctggtggcaagaacgtcctaaagctttgcaaagctctggtgtttgacgttgaggaagtggattcatggaaactgctggaaccctttgaggacttggattgagtttattcatccagggaacaggattgtgttcagcatgctcatttctataaatccttccatctcggccaaagatggtctcatcatcttagagcaatgacagccctttctcgtggaatgggcacgtttgctctgttcactgcagcccctggaaacagccacatgatgcacatggatgctcactgg

SEQ ID NO: 467952 - DNA, 497 bp, Homo sapiens
cctcggggctgtgggtgtggatgcgctggcaggtgtggcggtttgggttctgcaaaccctccctacggcggctctcgggtcctggagcgagacgccgggtgcacgacgccagaatcactgaggtgccggctccccgcggtgaaggctccaaggaacgcgcctgggcccggccggcgcggctggagcagcagttctccggcagccctgcccttcctcgagttgggcctttgaggggccttggggcctcccggggcggcggccttgagccattagtgttggctgaagtcttaatgacaggcgagagggacgcctttgcggtctttgaagctacgctcagttctgactggcagagggaggccgtgggctgtgggagaaaacacatcatcatcgtggggggctaggagctctgtcatatggtggttgtaagcaacagaaatgggctctggctggctgaggccacagaggagcaccgcgtcagaggggccggcccccagatg

SEQ ID NO: 467953 - DNA, 1499 bp, Homo sapiens
ggactcgaatggaatggaacggaacagacttgaatggaatagaatgggatttaatggaatggactctaaaagaatggaatggaatggatttgaatggactggaatggaacggaatgtactcgaatggaatggaatggaatggactcgaatggaatggaacggaacagacttgaatggaatagaatgggatttaatggaatggactctaaaagaatggaatggaatggaatggaatggatttgaatggactggaatggaacggaatgtactcgaatggaatggaatggaatggactcgaatggaatggattcgaatatacgcaaatggaatggaatggaaaggaatgaactcgaatggaatggtatggaatggactggacacgaatggaatggaacggaatggaatgattgaatgtaatagaatggaatggattcgaatggaatggaaagcaatggaatggactcgaatggattgaaatggaatggactcaaatgcaatggaatggatttgaatggactcgaatgggatgggatagaataaattctaatggaatggaatggaatggactcgaatggaatggaatggaattaagctgaatggaatggaatggaattaagacgaatgaaatggaatggaatggaaagaaatagactcgaaagaaatggaaaggaaaggaatcgaccagaatggagtggaatggaatggaatggtcacgaattgaatggaattgaaaggacccgaaaggaaaggaattgaatggaatggcaaggcgtttaatggaatggaatggaatggaatggaatggaatggaatggagtggaatggaatgcaatggaatggtatggagtggaatggaatggtatggaatggaatggactctaatggaatagaatggaatggaatagaatggaatcaaaattaatggaatggaatggactcgaatggaatggaatggacatgaatgtaatggaatggacccgaatggaatggaatggaatgaaatggaatggaatggacttgaatggaatgcagtcgaattgaatgtacccgaatggaatggaatggattagaatggaatggaatggaatggacaccaatggaatggaacggaatggactcgaatgaaatggaatggactcaaatggaatggaatggaatggaatccacttgagtggaatggaatggaatggacttgaatggaatggaaatgactcgagtggaatggaatggaatggactcgaatggaatggacgggacacgaatggatataatggatggaatagacacgaatgaattagaatggaatggactcgaatggaatggaatgcaatggaatggactcgaatggattggaatggaatggaatggaatggactcgaaaggaatgggatggaataaactctaatggaatggaatggaatgaactcgaatgtaatggaatggaattgacttgaatggaattgactcgagtggaatggaatggacttgaatggaatgga

SEQ ID NO: 467954 - DNA, 1430 bp, Homo sapiens
ggattggcagccagtttgggcagctcggttggaggggttgttctccatgcccacctgctgattcggactcttagcgacccctccacagcactgtcctgagggtgaaatgagatcggggacaaagtgccaccaactggaaaaggttaactcagaaccatctggcacccaccagaacttcctacgccgggacgggctcacgggcctggcgggcccaggacaaggggtgggggtaggagaagggagggctgggggcaaagcagcctctccccggcctcgccccgggcccaccaagcctggtgacccaccccgccaccgtctccatggtgacgataaacaggcctcctccttcgccttgccagcgcccccacgtacccagtctctggtggaaactagggagatggaaccctggggtgaggagcaggccctggggtggaaggtggggggccggagggcctggcagggcacgggcggcctgggcccagcgcagcaggcactggggggacagggggggagcccccgagcttagcctggcagggccggaccagcctgggctccctacacttgcttttccagccatagcaccaggcaccaagagcaccagacctctcctgcctgtagagtgttaacactggttcccacccttgatagctcagcaccttcacatcttcctctaatattgcctgtgaaaccttccctaactatcctgttttagaatggaattctgccacactcctcttccttcccgcctaattctaccctttcccccaatgataacatcttctctaactatggtttaatatcaaagccaggacgctgatgttgatacagtcctcagagcttgtttgtacttcatcagtgtcacatgcactcacttgtgtgtgttgtatgtatgcgtgtgaatagttcaatgcaattttatcacatgtgtaggttcgtgtaaccagcaccacaatcaagatacagaataattatcaccacagaagtccttcatgctaaccctttacctatgtccgccccctcctcctctgcccctaaaccctggcaactgctaatctgattttcatctgtctattttgtcatttcaaaaatgttatataaatggaatcacacagtatatggccttttgaactggctctttttcactgagcgtaatttgcttgagatccatccaagttgttgaatatatcaattgtcggttcctttttattgctgagtagtattacatggtatgggggtatcaaagtttctttaaccattcacccattgaagagcatttgtgttttttccagtttttggcaattgtgaataatgctgctgtggacatttgtggccaggtgttggtgtgaacagttttcatttctctgtgataaatgtgagtgtggtttctgggttttatggccagtatatatttagttttataagagactacc

SEQ ID NO: 467955 - DNA, 690 bp, Homo sapiens
cgcttggctgacgatcggcagggcaggaggctgagcctgtcctgtgcaccatcggcctaacccctgctgaaagctgggctgtccagcacgtggcccagctgccctgagtgttgtcatcatgatgagtagatatcctcatcaccgggacctgggctgtctgacagtgaactgattccatgtccaagcccctgactgtctccccattggacctggccagcagctcgtggctgagtaaaaacctcctccccaccagttgccaggccgccggccgccagtctgatcgtgggaggcaccagaagcaagtctacctcgaggaccagtccgtacttgaggcccatggagcctggagcagagggccctgtctgggggctcctagtgtggccccagagtgcctaggggccacagagtccagcagcgtgtggagcccatatgcacactcagctttcctagtgacaggtgaagccagctggactttctgggtccagcagggtctgcgggacagacccccacagccggtgcccccacgtgatgaacactgggaaggaagcagaacggacccgagaaaggaaggtgaaaaaggaaacacgtggtcagtgagtaatcagtaagtcattggtgcccacttgggatttccaagttcgggggagattgttcatgctgagatttcatcatgggacaacagttatcagc

SEQ ID NO: 467956 - DNA, 929 bp, Homo sapiens
gtcagacacaaaagattcatagttacacttatggcttttatagtctcagccatagtcatcctggcaactgctcgcgttgctctcgcatctattactgagtcagtacaaacagctgcctttgtagataatctggccaaaaatgtgtctaatgaagtcttacagcaaggtatagatcaaaaaattcttgcacgtctgcaagcccacaaggcagctttagaatacgtgggggagcgacaagatgcactggcattccgacagcaattaaactgtgactgggagcataaacatatctatttactaatgtggggtcgagggtatgcttgtgtttttgcaggagatgaacaaaccatgtgggtgccgtcaagatgtgtgcaaccatggaaagggagactggagggacccatggattccaactacaggcctggttcccccagtatgagcaatgagccagttgaatctgaatgcgaaaacagaacgaggaccaaccagagtcacgctgacaccaacccccggcagccaggcttcacacctgcagttgatcccaaggcgcctgccccaagagaggcccacgacaaagctgtgtggccctgtgtctcagaagccatacgctatgagttaaggcagttattgagggccacccaggtcaaggggtggggacttggactccacctctcgatggaggtgtatccaggtcataccgtggaaagagcatacgtgaccacctttggaaatgcaatcaagagctcctagatcaatgtgcagcctaaatcacagtctattcaaaaccatgtagcccatcctgctgacaagttcttacttatgtcctccccaaatgcctctttccctaactcccatcttcagtccaatgtggctgttgaggaggggtggaattattcccacctgcaaaggcagatttcaacttttggggt

SEQ ID NO: 467957 - DNA, 1812 bp, Homo sapiens
agcagtcctcgtgaggccacctgctctccgctaccaagcctggggccctccctggagatgacagggcaaccctccagtgtacgtccctcctgagggcttctgcttaattcacttttgtgtaatttgagcttcatctgcctcagtttgcgctcttggcttcatcacgcggtgtcagctatgctgcaagtagagttgggagttcgcttcagcatccacagccccttggtgtggtcccctccaccaaaccagccccagagcatgggggagaggctcagctgccccactgccctcaaggagggctggcgaggtaccctggacagggctatgggagaggcacgactgtcagtcatgcccttcacagaccagcctgatccttcctgctgtcgggaagaaggtccttctgtcctggtattcgtcacccaggaattctccccggagcaccgcccccaagtgctgtcctcggtgctgaccaacagcgcacgtctttgtggccggcagccaaggaccctcagacagagagaggttccaactttcgcagaaagctggattaggctgcagagttgcaggatcctgagccttaacgacagcagatgtctgacactgcctggctgtcctcagcctcagaagcgggtgctgagagccctatgtggactcgttccttgcagagctgctgctggggcgcattccgcacttcagaggcggaagctctccagggtggagagacatcagtcttgcccatagccctaaataagtgttgctttgatgttgctgtctttcactttccatgtaatagaaacatccccatttcttctgtgaaatgagagacattggatctccttaaggaggcaaagtgtaccttaccctcaggtacagagaggacaggactccccaccacctcttgtgacagggtccttccaggtctgataggacttcctggctcctggctcaggaattcctgacttaggtcgaggactgaaacccaggagcccctgctcccttcccactctggaatggtgcccctggctcggtcctgcttacatcatctgtaaatgtccaaccaggatttggaccatgttcctagcatagatcttctcacgaagctgcttgggtgaagtggaaaaaatgggggatgctggagtctcatactcagtctcttcccactcctcaggggctcacagagctcacactgaaaaccttaaccctagaaagagccttgtaaacagcagcctttgaataggtccgggtggggtgaactgaaaagtgcatcctgggaacatttgaagatcctgccttcctctaccttccagctcctcctgcctccactaatttgacagaaatacactctagacaatagtttcaggtacaagccattagcccagatgagacaaataatgcctcagttcagaaaatttgcccatgatcacattctagaggcaaaaagaacatttagcttttgtacttgatgcaagagacttccagataaaatggctacatttgcatgcacctctaagttatttccaaatttccattgaaataagccaagaacagaacacagaaatagaaaaagcgtgcatcgatgccagaaattggaggggtgtgacattgacaaatcagaaacttggatattcaagatattcttccagaaaaggatgggacaacaccaaatagaaagaaatcctgacccaactactggcagagccccatgaccatcgcttattgtgaagatccaagaactagaggcaagacggctggggcatctctggattttaccctccctctgagaagggactggagccttgggtcactgagaag

SEQ ID NO: 467958 - DNA, 1315 bp, Homo sapiens
tcgcctgcattggacctcctgggtgcttcaccacagactccggtgaagtccacggatgccaccccagacagctgttaggatccttactattgcggtgttggggaaccttgcagggctgtccccttctctacatccagagattggcatgccggcatcctggcctgtgcctgtgcgcgcgtgcgcatgtgcctgtgtgcacgtgcacgggcctgggggtattgctgttcttccagcttcctcctacctgagcagcgtggaggtcggcaatgggcttggcctggcgcagtggggacggctccaggtccgagcggtcccggctgtggaagagactctcgggctgggtgggccagggagcagccagccagcagagcagcagtgtcggacggaagatggaggcggcgagcattggcctgagtttgccatgtcctccgataattacatcctccagttgccagtgcctgtgggttccatttctatggagatatactgcgggcaagtttgccgctaaatgagctgtggaattaacagaggcacgagactgcgcccctaacaacatgcctctcagagctgagcctgagtttaaaaaccctgaccgttagtttgcttacagtttgggtcactttttttttcttggtgaactggggtttggagatttttagtttgtttctcacacattttttgtgtggcttttcttctttttgtttatctttatataaaggagatcttctgagcagatagtataaatttgaacattcttgcagatacatatgcacagatgcctagagaagtatttgtgtgtgtctctcattttacatgaactctattctctgttcttacaagccagcacaacgttacaggcacttttctgtttctgaatgtaagtatttatcgttctagttaatgactgcacagcgtcccattctgtgggtaaagatttttatagaaggataaactagaatcacctcagcccactactttttcccctcatggagaagcctcaagtttctttgggatcctgaagacagagcccctgaactgggcttttatctgagcagatgtcctcctgagagtgcagactgactgggtcacagccgtccatgggaatattgagaatcatagaaatacggagaggccaggtgcagtggctcagacccataatcccagcgttgcgggaggctgaggcaggaggactgaggccaggagtttgagacaagcaagggcaacaaaatgagacctcatttctatcaaaaaatgtttaaaaattagcttggcatcggccgggcgtggtggctcacacctataatcccaacacttt

SEQ ID NO: 467959 - DNA, 527 bp, Homo sapiens
cacccccaaaacagggagttgaagtccatgctccagtcggcaggagggtacatgtaaatatgtcgttccaaaacgtggcacagtcgtgcaaagcaggagggaagaaacggtgccagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagatttaaaaacccagcatgttgggtgacctacaccttgactttgacaccagaactgatggtgttcaaagttgagagagtagcctgaggtcttatagagaaaaatgtattaatgtacatactgtaggacatttaatgtgtagggttctcttttcttcttcccccttctcagcaactcaatctaaaatatttccatgtaacttgt

SEQ ID NO: 467960 - DNA, 851 bp, Homo sapiens
aaccagttccccttctccgtgcatgacaatcggcacagcttggagaactctggatgctaccttgactccttgtgaacaaacagaatgtacaattttgagtacacagtaattatcaggttcgcacgtaaggtgctgagagtgaatgaggaagcctgtgggccaggacctaaaggtgctgggtccttcagggagcccttagggttgggaaagaattcagcctcctcagacttttcagagaaagaatcatcattggtcccactgagtgctggggggcagctcagtgctggggagcagggaagctcggagaagtttgttattactgatcgtctgaagccttcttctctcaacttgtcaaagtcattctccatccagctttgttccattgctgccgaggagctgcgaccctcagctgcaggtctgttggagtttgctggaggttcactccggatgctgtttgcctgggtatcaccagcggaggctgcagaacagcaaatattgcagaacggcaaatgttgttgcctgatccttcctctggaagcttcatctcagaggggcacccaactgtatgagatgttggtcggcccctactggagctttgttctccaccaggtgcattttcttttcttctcccagggagtcctcacaaaatcctcacttgtggagccttctgcctcttctctcctttctctgcccaaacaccaacagtctctaacaggagtgacacataattccacttatgggaagtgaaattcaaaaaattacccaaaagacatacagaaccaaatctgcaattatgtggagggacacagagataaatgagtgggaagggtatatttaccacccatggaaac

SEQ ID NO: 467961 - DNA, 984 bp, Homo sapiens
cacacgggttaatcccactaacgctcacacgtgtgtccactctgagccaagattcacaggtccaggaatcaagggatgaaagtggaagtggcaccactcaccatcacctctagtgatccactagcagaatttttgcttcctgttactgtgacactatgttctgcaagcctagaggtcttagctccagagggaggaatgctgtcaccaggagacgcaacaatgattccattgaactggaagttaacactgccacctggccactctgggctcctcctgcctctaagtcaacaggttaagaagagagttccagtgttggttggggtgattgacctggactatcaagatgaaatcgactactactcctcgatgaagtactaccatgccctgggattaaggtcaatggctctacgaccataccacactgaatccatcccatctcgtctgatcttggaagctaaggccaatgggaaactacagcctaatccaggcaggaacaaatgacccagactttcaggaatgaaggatcacagtaccaggtgaaaaatcatgatcagccaaggtacttgctgaaggcaaagggagtacagaatgcgtagaagaaggtagtcatcaataacagctatgaccacgtgaccagttgtagaaatgaagactgtaattgtcatgagtatttactccttattttgttaaaaatatgtttgtgcatgtatacacctgtactaaggaaatatcttcattttatttcttttctttttcctttatcatgtaacataaaatttattgacttcatatcagcatttaagcgttgtttgtcttagcatttaggttaaggattagtgtgcttcttgttgtacgaaggatagctgtattatgttaggcataattacgaccttattattgtctttatgtggagattaagtatgatttcaggacatgtgtatgggtgcccagttgacaatgggtagacttgtgatggttaatatt

SEQ ID NO: 467962 - DNA, 602 bp, Homo sapiens
cggcgtttccatgagggtattcgagtcacaagcagctgagctcccagccagcgtcaacttccaactttgcgtctgcactcagtgacatcatgttggtagcttgaaattggccatggtagaaatatttacaccacagaaatatgcagacagtataaatcagagcctttgtttcccagagaaatttccatcagaagactctagtcagagagagttcttcaaacaagttaggacaggcattttgacccacaggtggcctgaggacatctgggacacattggtggcctggggacacctgtgggtcctagagaccctttcaggagatggacatcttgaaatgcagaggggcctgcagacccccagtgtgagcactgagaaaactgatcaagcttgtgtgtcccatgcagattctcactgggactggaacccagtggcacaaagtggtgacaattcaggaaccagagagaggctggtggacccgatgcttggcagtgacccaaagatgaagttccccagcaggtgaagattgactttgactgacttctgtacctggaccatgtgagaacagccaatagtcacgggctttagaagggaggtgttccttc

SEQ ID NO: 467963 - DNA, 641 bp, Homo sapiens
gcgttccgatctttggaattaataagcagtgaaactttccacttggctggggaagcctcacaatcatggtggaaggcaaggaggagcaagtcccttcttatgtggatggcagcaggcaaagacagaatgaggaagatgcaaaagcagaaacccctgataaaaccttcaaatctcatgagacttattcactacacgagaacagtatgggggaaactgccccagtgattcaattatctctcaccaggtccctcccacaatacataggaattatgggagtacagctcaagatttgggtggggacacagccaaaccctcacaattatggcatcatggtggtgtcggtggtggtggcagtggtggtggcggtactgttggttgttggggtgatttatgatcaaccgaatgacttgggactggtttatggttcaaagactggtcagcatgatatactggtgctagccaaaattgggttattgctgcatttcagctccagcatagccccaaaagacggcgatgaaggaaaatgtcctaactccatagaacttccagccacacactcacctgttcctgttccattgacagagaagtggaagtgggttgagatatgaatatatatggaccgttggcagtgagaaatgaac

SEQ ID NO: 467964 - DNA, 438 bp, Homo sapiens
tagtaccatatgcctgcttttttagaaggctttgcagagggggaggtggaaatagggcagaccacacctgtctttgtggccccatccatgactctgctctgtaaaatcatcaccttgttaaacaagttctgtctgttgggattaagctggaagaatagccttttcccatctgagtcagaagtcctcagcatgcctctgattctaccatctttggtcacatgttcatctctaaaccaatcagtgtggctgtggatagagtgggaccaccctgattggctcagaaaaacaatgacccctttctggagctggagggtggtggtagaatctcggccccacccggaaccgcgtggttgctacaagatttgggccagaaaggcagcttgacacagatgtcggggagctcagctttgtcatccacaacacaagttactagatttc

SEQ ID NO: 467965 - DNA, 657 bp, Homo sapiens
cacagctctcttcttaggaactggatccagacacgcttccacggtgctggatagaaacataccatgctgaactccattcattcaaatactggacgagcaggagagcatgaagccaagcagaaagttttcctaagtgcaggatgttgtgcctttgcacggggtcacaagcccatgaagctaggcctgatgataggagatgtgttaaaagttcagaggagccagagagggttcgcagacctcgtgggtgtgaacgtagggagtgttgtatggagtcagaccaaccaaacaaagggagttggcatttgcggtcactcagattttatgcagccaggttactgctggctctggatggttgacacacagtgtgatgtttcactgcatttgtatcaagataatggcgcaaccatccccccaaaatccagcattattcataatcgcatctttcatcatcaatttggggaaagtctttggtacacataaattcctatgggagaagggagctgtgctctttcagcttggaactaaagtgggaccttaatgtttcattctccataccactgtattgtatgacaataagcatattctaaattattacatctggtgatgttggtaacatcctgtgtccttttgatgccactgttgctgtgtcttatttaa

SEQ ID NO: 467966 - DNA, 456 bp, Homo sapiens
agctgctcagagtcaactgtttgccttatttatgtctgcaataagtgacagaaatagtgaatccaaatcaggggacagtgaatggcaggtgcaggctcagagctgttccgcagacctggggaacaagcagcccgtggggcaggaacaagccaagttcccacagggcaagtccttgacaatagaagggagaggatggaatagatgggagacttcaagtttggatatacttgaggatatgcatttgtgttgttgttgttgtgttgttgagacaggatcctttgcaggcaggtgtggtcatgggacggagttctgctcaaagtgggcagaagtgatgtgcaccacttccagtccacaaccaggtcctggaggccaagggaatctttcttctccaaactcaaaatctcttcttggtctggggaaagatgtggatgcagaactctaagcctttgctggttg

SEQ ID NO: 467967 - DNA, 744 bp, Homo sapiens
catctgcagtgtctgctgctgccctcatagaagaaaacgtggcggcctgctgggtgagatcgccctcttccacggagagctctggcacggcccaggtgtgtgcgctccggtgccaccagctctcctggatgttcgtggctttgtgcatgtgtgcacaccctccccgggacccactctgtgctgccctcagtgctgggctggtgctgtgttcttgtgatttgtcatactgaagccggcagctcctgtgcctctctgagaactccatgattggaaaggaatcctttccaatcctccatgactgcagcgtggaggccgatatctgcatccttcacttccacaagccgataaagtccttccagcccctgatgaagacgactagttgggctgcatttctggctgctgggagggttgctccctcccagatgcaggtgtcctggctctggaaggggctggcccttcaccaccttctgtcccatgatgctcagcggttcttgttgggtgtcagccatcgcccatttaaccgatctgttccctggagggtggggcgaggacaagactccctggtaccagtggggaaactgagcctcagggccatgagggactgggtgcgggggtctctggagtggcagggctggcacctgggggagtgctggtgctgtcaggagcctgtgatggagcaggggccggcattagcatttgacctggggctgcgcagtagttagtgttatcaggcgctgactcgtg

SEQ ID NO: 467968 - DNA, 676 bp, Homo sapiens
agtcccaccgcacctaggggcgcccctcgatgacagcacaggcctgctcccggcctgagcacctgcaaggccgcgaggaaccctggaacatccggttgctggcgcacaactctctgggaccggaagcaggtgaggcagagtgggcggagccgctcaaagcccgcgtccacgttctgctcccatgccctgctcccatgccctggctgcaggcgcctgcggagtctattgccctctatccctcctgctgcagccaagcaaagagaggggcagagagcagctacagtcaccatagccactttctaaggcactccagaacttttcccatctcaggcagaaaaataaaacccagcaagaattctttcccctacttcctgttttacactagaccacaattcttaaacttggaagccaagcatttggtccttcggatattttggtctttttggtttcactctcctttggggtagaggtgccagagaaaatacagggcgctcagtctcaggaaaacaataaacgtttaagtatcgtccatgcattacttgggacatactgaaactgttgtttatctgttattttcaaatttaactaggcatcctctggttttatttgctaaatctggcaatcctactttgggaaaacagaggccacttcttgtaccctcagtcagggtagtgtc

SEQ ID NO: 467969 - DNA, 1154 bp, Homo sapiens
tcctcacagcttaggtcccacatatcaagatgacaagtaccactctgagatatggactcctgctcctgctgaagcacccagagctcacaggtaggaccacagatgatgaacaaagtgaatttcagaacaatgctgagaagatggtgccagtgttctccatcctgtttctcttagagaagcttcattctttaaatttctgtgtcatcagctgtaatctgtctaaatttgatgacatgattaaaaaggacatctttgcacaatggaggaggatgactgagatgaatcaatctcagactgctgagctagcagcaagcaaggctccatgggcattggacctgctgcaccaagcacgggagggaatctccaggtcagccagttgtgaagaccatgggaaaagtgcagtatttgggcaggagtgtaccattcctccaggtctggtggagtttgctggatgtcttctccagactctgtttgcctgggtatcaccagtgaagcttgcagaacagcaaagattgctgcctgttccttcctctggaagcttcctcccagaggagctcccactagatgccagccagatggagctctcctgtgtcatatgtctgttgacccctgctaggaggtgtctcccagttaggaggcacagggatcagggacccactggaggaggcagtctgttctttcaaggtgccctgctcagagaggaggaatctagagaggctgtctggctacagcagctttgccaagctgtggtgggttctgcccagttcaaacttcctggtggctttgtttacactaaggacaatcttgagcacatgtttcatcatgcaaacttcagagtcacattgatagaaagaatgctggaaaagcatcacaagcaagggcagcaacctcttcaaggccctccatgctgtgatgatgtcataccacttttcctgtctagatgacatttcctcaaaagcataccaccaacatcagggaaacagaattggctggttgctgcatcatttgctgctcacacaatgacaaggatgacaagaagattcagaaagaaatgcagtatatttttgtggaatgtgatgttccactttatgttgttctatgttttgaaatgtaccacacaaaaaaactattaaatactgatctttacatacatt

SEQ ID NO: 467970 - DNA, 788 bp, Homo sapiens
ctgtcacaggaaccccacttgggttgctttaactgcccccgattcggcatcctccgaggcccccaaaaggcttaatgaactacagctttcatctgtttcaagtactgagtcatgacagaaagaattaccctgttttctgggagaggaagaaacgctttggttatcagcagggctggccagaggcccggcagcctccagaaaggtccgtgggatttgaatgccaggggtggacattcatccagctggacacgttcacaccccaggagcgcggtaagatcctggttcactgcgtcatgggccgcagccggtcagccaccctggtcctggcctacctgatgatccacaaggacatgaccctggtggacgccatccagcaagtggccaagaaccgctgcgtcctcccgaaccggggctttttgaagcagctccgggagctggacaagcagctggtgcagcagaggcgacggtcccagcgccaggacgtcatagcagaaagtatttgcaaattgttgtctgctgtggaatgggacgatggggcagccagccaggcacgatggctgcgtgatttccactctgaaggagaaaacggcagcagacatgaagcgggtagtgacagcttccagggccaggaatcccaaaccagacagaaaccaaagagagttgctgctgttggagatgccggccgtcaaggaccaggcatggaaatggcctggagaaaccagaatgtgataaaggccttctaggaaaaaacgaaaaggggcccggttcttcagtttggttgtagtttt

SEQ ID NO: 467971 - DNA, 1830 bp, Homo sapiens
ttcattctctctctctttttttttttttttgagaggcagtctcgccctgtcccgggatattatatttttattagtagtaacaattattaagattgagagtcttaagaaaggctattggaaataataggtaaaaatgtagaactcagaatatgagaaatagaatgtaaatgatataattgtgtaaaaaatgcctagtttagaatactgaagtttgttttgtttcattttatttaacttttaaaacttagatcttttgtttaatttttattttttggatggttaagtacatgaaagaagaaaaacttggttaattttgcctgattattttaaacattggaagcaaaatacaagatttgtatttcatactacaggaccgcttccatcatccatctggagagacagagagagagagggagagagagagagaagcgcggcggtgataagtctcccagtgtgagagaaatcggggaggggcgaagaagggtaggcctcttctgttccattgataccacgttcattcacagggagccggctaaaacagactactcccccgtgcagtcgttccctctaccctaataaggctttggcgcctctcccagaactcggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggctgctcggagggagaaaggggcggctagcaacgtggcggagccggtccccgggcccactggcggctcctcgggtcgcttcctcagccccgagcagcacgcgtgcagctggcagctcctgctgcccgccccggaggccgcagcgggcagcgagctggcgctgcgctgccagagcccggacggggcgcgccaccagtgcgcctaccgcgggcatccggagcgctgcgcagcctacgccgctcgccgcgcgcacttctggaagcaggtgctgggagggctgcgcaagaagcggaggccctgtcacgaccccgcgccgctccaggcccgcttgtgcgcgggcaagaagggccacggcgccgagctgcggctagtgccccgcgcgtccccgcccgcacgccccaccgtcgcgggattcgcgggggagtccaagccccgggcccggaaccgggggcggacccgggagcgtgcgtccggcccagccgctgggaccccgcctccccaaagcgcaccgcccaaagaaaacccctcagagaggaagaccaacgagggcaagaggaaggcggccttggtccccaacgaggagcgacccatggggaccgggcccgaccccgacgggctggacgggaacgcggagctcacggagacctactgcgctgagaagtggcactccctctgcaacttctttgtcaatttctggaacggctgagactgcctgccggcttagggagggttgatgggggaggcgtggggaagggaaagctaagggcgtcttagaccggggggtactgtgatagagattggggagaagtccaggttctcgaatgggggtgggggcaaggctaaaatgtaagtatgtatctcagagtcattttgaccattatggaagttgtatctctctgtttcatgtaactaattattaatatatttcatttttagtgtgatgtaatgagagactgtgtgtgtatgttaggtgctcaataaaaactgtatggttagatttaaagaagtggcaaggcaatggaaattctacctgcatttgatctacttccaagtacaccttgaattaagttcttaaa

SEQ ID NO: 467972 - DNA, 1046 bp, Homo sapiens
caaacttttaatgtagaaaatatgcaaatctacaaaaaagttgaacgtgtagtgcagagcactcagcctagatccctcgcatgcacagttcacaatagttctcattcctatgagaatctaagcctccgctgctctgacaggaggtggagctcaggcggtaatgcccactcgctggccactcacctcctgctgtgcggcccagttcctaacaggccaagctcaacccggaggttggggatccctgctcagtacgacatactacctttgagacttttagcttctccagagccctccctttatttaatacgtgaagagcctgcagaagctctgatgcatgtggaaggctatgaatttgggactggtagaaaggcattctggctgagcagaaacaacggattaacagagactaaaggactgaagtatttggtggaggatgttcaaggtctatggcctgatgatgagacagctatgctgcgaccgcgaaagggagtctcgtttccttggaggagtcagggaacattctgctccacccgcttcttgtggaaggctgaatattatccaggcctgcccgcagtcatccggaggcctaaacccctccctgtggtgctgtgcttcaatgcgcacgctcctggtccactttcatgttcctcctgtactcccggttcctctttgaagttcgtagtagatggcggtcgaagaaatagtgaaagtcttaaagtctttgatctttcttataagtgcatagaagaaaatgctgacgtatgctgccttctctctctccttcagctacataaaagggaaagcacccctgtcctatgatcatgtgacttgcttcaccttctcaatcacttataagattagtcctccttacgctgccccctttgtcttatatacaataaatatcagcgcgcccagccagaacatactttgtattatttaaattattttaaatatgttgcaattcattttatggtccagaatatggcctatattggtgaatgtcccgtgcatatttgaaaatgtgtagtctgctgttctgctgttat

SEQ ID NO: 467973 - DNA, 1150 bp, Homo sapiens
cctgaagattccccagccgattctggggtggacccccctcacaacatgttagggcatagtgagaaggcagctgtctgcaagcgggaaagaggatccagatttttctggtacttccagtcttggaccatgtggaatcaccactccctccccacccctgccagcctgcagattcggtcagaggagatttctgtccctagaggcagaaaactgctgcaacttgccctccaagaggtgtggaccaaagaggaagctgatgaaaatctaactgcctgcctcaatgaatcttaccatcaaggaatgagccactgccctggccctttctcttcttgttctgttcctacttttttcttctttcctcctcttcctcctcctcctctccttctcccttctcacccctcccccttccctccccctcccctcctcctcctcctcttctttttcttacaaatggtataatgccaaatggatttcaaaagcactcacaccaacagcaatgtatgggatccagatccgaacacctgcattgctaagttttttacttttgtcagttctggcaggtgcgtccaggatactcttaaccttttacagatatttcctgttcacctgattctttgacatatttttgggggaaaaaagtgcacgagtcacctgttattcttatttttattcgactggttcatttgtattacctttcttcaatctttacacttcgatttctactcttttagtgattatctttgaaaatttaatatgcatacttgacttaaagtctaaatttcatcagcatcttaaagcttctatttcccatactattgtcaactagtactttcattccaccttgttttaaaaatctcaaatctattacttgtgtattgcagacaatgcttattatagtgctttaaatagtcctgttataaaattcaaaaggaataaaaggatatacagtttagtctttcacatctgatcccagtggcactgaggtttccttccaacagttcacgtgtatcctgaaggaattttattcataaacaagcaaatgcatgttgtactttttcctacgtatacaaatagtagcaaatcatacagattggtcttgaatattattccttatcagttatattatttcagcctttttactgacatgtttgcc

SEQ ID NO: 467974 - DNA, 1087 bp, Homo sapiens
gccaatgttcgcggcaatacgggcagtagcgacagctttctcctggaatagcggatcacgttcacgcttgctggcaaaatggcgagcaccactaacagcaaggtcagtgcatggatggaaggccataataaaatccggtttgtcatacacacccgcgatcgtatcacgttcgaacttctcatcaatgaagacgttcacatactcaatgttcggatgctctaccctggcgttgtactttgcgtaatctccgtgatcggctccgtcaaagttgaagcacatcaccttatgaccttgctttgccagttcatggccagcaagaccggaaccgagttaaaaatcaccgatatgattcgcctaacctgcgatgcaatgtaccgcgacaaaggcatgaatgagttctctttcgtggctgatgatatggccctcgaggccgcgcgattctacttccgtgaccaggaggtaagtgatgacgatcttgaatctgccgctgccggatgggtggaccagaaccagggggaggtagagaagcgattcaagtccgctttcatcactccgatcattaccaggcacttttgcaagtatggcaaggtggcaaaggtgaaggtaggccggaatgacgctgcaatcacaatgataacggttatcgttaccgacgaagaggttcccgtgaagaagcgccgcagtcggaaaaaagttagcctggccgattgcctggattcgtttgtggttgatgtgggcaaactggctgatagcgaattgatgactcgtgacgtaaacgagatcgttcgccagatgaaagcgcatatcgaaaagtgcgaagcatttcagcttaaccccgagacttttggattcaatggtgattatcgtacaaccttcgaatttgtccggtatgtaaagaaggagtttggattcgaagttattcacgcaggtcttgtcagtggcattcagacgttcatctttaagccaaatgagattcgctgcttcactttgatgaaatagcactttttgttaaaaccggatcgggataacctggtatagtaaccccagggggttcgagtagcatgagagacgatttttaccctcagtt

SEQ ID NO: 467975 - DNA, 2475 bp, Homo sapiens
gtgatcttgattcacacatgaggaactcaaggttcacagaagtggaacctctgctgcgtgggagccctcgcgggctggctggaccgacccagcctctgcccctggcttccgcttctaccccacttcgcttctttcccccagggttgccagagagctgctgccagttttcccagcacattgctcacaggaaattaggatctaaaggtgcaagctccactcgccctgtgcgaaagcactgagaccccaccttcctcgcaggctcctgcgaccgccctctccagtgctgagggtgcagttccaccacgggccatgaggggctgcttgcccggagctcctggagggggcccgcgggcctggctcagctggaagaggacagaacacagcaggttccatccgaagctttacctgttggcagagtgggtggtccctactagccaggtttccagagctgcaaatgacccaatgctagagattgttggaaatgtaacaaacagcagccagccaaggctttccaactcacagctctccacggtcatggctgctgaggctgcagaggagagcatcaagttgcagaaacagacacacagagaagagacacataaggagaagcaggagagacctcgtgagtaccagcatactggagtgaagcagccgcaagccaaggaacgcctggagccaccagaagcaggaagaggcaggggaaggttctccctcagagcctttggagggagcacaccctactgaaacccagagtttagatttctggcctccagaactgtgagaatatcaatttctgtcatttaaagtcagcaggaggagcaaacctgtcccatgcagggtggttttccattttctgtgtttatagggtcttaccctctatttgtgtttcccccgtcatggtccatttgggctgctataacaaactaccatagacagggtggctcttaaacgtcagaaatgtatttctcacagctctggaggctggcaggccaagatgaaagcactggcagattcggtgtctgaactttgtgttcactgttttatcattttcttccatcaaatgctgcctgattctcagggtcctctcccagccctaccccaccattgtaagtggattgctttttgttcttggatacatgagaccattttcttttactttgaagtgtagtaaattcatcaagtatgtctcagagttgagccagcactatcacttcttcccagaatccagagagccctttcaatttcctagccagctctttctttcttttcttttatactggtggatattttttgtatttcatgcattgtagtctttcttttggggaaacaaggacccataggtagatcattatctatccctcatagcttaatcttcatcctaaccatttcgactttattgtcttttccctacactccttctatgattatctcaagcttttttgaatgtgatgaatttaatatttgactgttaattttgtttcttgctctttcaaatttacttaactctgtaattgctgttttgatctgcaatttttccttagctctgtaactaccatttttccatcttattttattgtctcatctaagtatttatttatttttgtttcaatgaattcatgtttccttgtttttttctagatacaaaatacttgtcttagattttttccctatttcttaggcttatattagatttcaggatggatttttcactttcccgtttatactatatttcctcttcttttttgtgttaacctctctgcatagttgccatgaattttcttttattcctgcagaatttttaataaaaggagctctatcagcgcatcccatttgcctgtatatggtgtaaatcaattttacttggtcctcatctcaatgtgtctgagtcctgttgtcttcccttcagtagtgtttgcttctattcttacaatctttcttacccttagcaagttacttatgctttctgtgcctcagttttgtcaacctacatcctatatacaggttcagcactaaatgagccataatgtgtaaaatgcttataacagtgtctggcatacacgaaggctattatcttcaggaagggaggctctcttctctccaatttcttttttccccccagcttttattttaggttcaggggggtacatgttcaggtttattatatgagtaaattgtttgtcatgggggtttggtgtacagattatttcatcacccatgtaataaacatagtacctgacaggtagcttttcaattctcaccctcctcccactctccaccctcaagtaggccctggtgcctattgttcccttctttatgtccatgtgtactcaatgtttagctcccgcttataagtgagaaaatccagtgtttggttttctgttcctgtgttagttcagttaggataatggcctctagctccatccatgtttctgcaaaggacatgatcttgttcttttttatggctgcatagaattc

SEQ ID NO: 467976 - DNA, 726 bp, Homo sapiens
acagaagactttctccagagctccccaccaggaagaggaacgcattgcaagtgctatgtaactacaagagcagggacacagctcagtgggaacctagaaccaggaccctgacatccgcagggcatgcccactcccctttccaaatctacttttctctgcctgtgggattctttcctgctgcaggataggctcctccacatggcaggagacacagctggaaacaaaatccatgcctcccagataagcctgtgtcacccagaccggatagccagatgccattgcggagtgaacatatcccatatcacattccagtcacacagccacgactctggtccagtcttccacccttctggattctggtccaatcttcagtgcatcctgaattcctgccctaagtgctgttttgatgctgttctcctaactgcccttgaagatattacttctccagttcctctctcacatggatgctgtttttctctctcacttcccctacaaacacctgtaggtttgaaactgtactcgtggtcctccattgctgcttgcaaaccacttcgtttttacttaaaatctccaagcctctggaatcaggccattagaccatgtccacccccgtccctctctcttctcttcacccattgacctactgatcatttccccttgttctttaaaggttccagtacttgcttcactgtgattctctctatttcatattccatagccacgagg

SEQ ID NO: 467977 - DNA, 2328 bp, Homo sapiens
aaaggacccatctcagccatgagtaaaagttgatctctcctcaacaagatctttctcccacttcacaatgcgtgaccctctctcacactgtgacccaaaggtgtcattcccctgcatgtggaaggtctttcacgctctcacttgtcaccagcaggtgccttcttcaaaagggtttctcaccattcaaactgggaaaaacctggttgatatgctgctcagactggaaaaagtagatgatttagagtcacaaaacctaatatcaagaccaaatcctgctacctatcaaatgtatgacttttcacacatctattggcgatttcttcttcctgacacccactacaatgacagtaaaggggaaaataaaaggaatcatcacataacatcaaagagcacaggtgagggaggatcagcagacaaggactttcaagaaaatcctagaagtatggagaaagatgaacaagacacaaggaagccactcctcaggagagtgctctagcacaagtgtgaacttgtcagacagaattcggagtggcttggaattgaaggcagagctccagcagaccacaggagatccaggagtaaatgatattattgctctaagcagaaacattaaagaaaaagaaagcagctaatggttatggaatacctagtatgtgccagcactctgctaggcacttttggtccaggatcctatggaacatatttcagttatatgagaatatagcaaatgacatctgcccactgacaatgagaacaaaaatagggcatacagatgaggacttctagtatagacacattattacattatccaggcacatggctgagaaatggttcaaaggggcattgttttaaccaacatgtagaattagttcacaaaataagataaactaccctattacagccatcactagcaggccttatgggtatttcacttacatattctctgagtgtctgtgcatctttcaacttggatatgtacaaacatattgcccagtaactgatgaagactcagattgtgttcagttctgggtagcactctttaagagtaatatcaatgaacaagcatatttacagtaaacatattatagaagaaatcatgaaaaaattataaccattgagcctgaaaacagttcatttgggtcatatatgacagttctctcaaatggaaaaagagtgtgtcacataaaagcaaaagaagaattacttagaggaaatgagtaaaatcaataggtagaattttcagaatgataaaaactacaaatttatatttcaccaaaattcaactgttgagttgtgtcatgttggaatttgcctcatgttttgaagtaatattatttatagtgtgcttctgccgtggtgattatttaaagtgagtgctgaatgagtatttgtgtaagaagtactagaaaatgattcctatgctgaatggatagactgtaaaactctaggtctttctattgtacagttatgtaactataactctataacctacaatcctcacaatcacagggctaatgagtttgcctagaggaattaacattttctttttttcccaacatacatacactttctttcttctctttgtaatcccccaaatgtaagggagtaccctatttgcacagaagtgtcaagaataatggaaagaaactctcaaatgtcaataacacttccatatgtggagatctttctagttaggatgcaatttgggatggaagaacaatccttattattactttatactcagctataatcaaagggcttctatattaacaaaagaactgaaaatcagaccaagtaggtaacacaggtcaaacgccgctggatccttcttaccctattggtgtcattagagtataagtgatttactcagactctgatagaaagaaccagagagattaatatgatctttgctccttgagaaacactgaaagttcattaattggagaagggagtgaagctaagaaattttctcagtgaatcagaataaagcagttgcagatagctctaaaaatcagacacaaacaataaaatcttttctttacacatacattatggctaccagtgtcaccagatattaaacgataatgaaaaaggcttagcactttaacaaaatgatttcttgttaaagaatgctcatttcatactgagcatatttaaatggaatggccatccctcagtcccttgtctcaagttttttatttttagtctcatgggtcacggagtttcactttctttaaaagaagaaaggcaggtatttaataaacttaaagggaatttcaccagttgtcatttctcttctctggaattttctgacaagctgtgctctaa

SEQ ID NO: 467978 - DNA, 727 bp, Homo sapiens
cggattgaagatccctagcgaatgctgtccttgcctccatacacagcacagcttattgacttcagtttttgttacagacaacagatagatagatttttgttcccacagtcttttagcagggactatcttcgctgcagcccaggtcacttaaatctacatgctacttcctggatagcgcttctgagcctctgggattcccaggtcagtgacaccagggtcaaggacatggctggagtgagtttgggagtctgctctgctctcattacctgcctgcacatgggaggtgcaggccacaatggaagagaggaaacaaaggggatagggatctatgagggggaaaaagcaggcgcctgtgttggggtgtggaaagcgccctcggagcccaccctggctagcagaggtcaactttgtgtaaacgcagcccactgctacagaggcctgagcatcgcctgctccagtgatgaagagcgatgaggcttaagccgacgtgggctagcaaaagttttaaatgtactttataattattttatgacctttctttctttgtaaactgcatgtcatttcccctctccttccctgaccaccaggctgccccgtgccagagctctgcctcaaaactggaaaccttgccagaagcgagagctgaaattgctttttggtgggtccgatttcatgctgagtgggaagcggcagctcagagatgaattggaaggccacgcttgtcagc

SEQ ID NO: 467979 - DNA, 615 bp, Homo sapiens
gtgccatgaatgactctgatctctaaacttccactctcttactttgcaaacttctctcctgaggcttcacagtggtcctccactcagatgcccgccttcccccgccatgccctgtccatccagtctgcctcatggacgcctacttgtcttccagtcttagcactggagtcatctcctctgtggagtctttcctgtttcctctccccagggagaactgaccttggccccttgctgatgtgcacacctgtcccctgcacacctttgtataagaagggagtttggacacagatgcacaaagagatgagaatgtcatgtgaagacacagactcagagggaagacagtctgtaaagacagaggcagatattagaactgtgctgccgcaggccaaagaaggcctggggctgtcgcatgctagaagaggcaaggagggaccctcccctagaggcttcagaggggcatggccctgccaacaccttggtttggacttctacccttcagaactgtgtgaagccatccagttgatggtgctttgtgacagcagccccaggaaatgaatacagaagcttacgcctagtattcagatgggacttagcattcgcggactggggagggag

SEQ ID NO: 467980 - DNA, 811 bp, Homo sapiens
atctgaatccttctctcactctcctcaagcatgtctagagggcagtgcctcccattacaagataaagctcattttcatgatgatggagcttaacagacagcccaagtctttccagttgcaactcaattgctgtttccgcaatatattctatcatccagaatcttcttacaagccctcagggccattgtggctgcatgacaggagccagagaatagcagaaagtgaacaaagaccccagttaattacatccacttggagtgtgaaggacaacttgattgtctcaaaaagccagaggccatataatccatctcactgctctcacaaaacaagttcccaattgtctctgctgcgaggaggtaagagggacacccctggcaatgtgctgacacacattccctgccgcaaatggagaagtcacaaaagaagtgtctgttcctctccctctatgggcaaagagaactgccttgtggccctctgctccagatccacgactgagactcttcgatatctccacaatgcttagtgtcttcccagtacaagtcaatatcgcttgatccattctgaacttggtaacatttatatgcaactgagtttgcacatctaattacacgacctggtaatatggttcgtctcttgtgaccatacattttctgttccaatataatatttatggactcgtttagatttactacatgttacccaatgtcttgcttctgtatacggaaaaataaccagaaattaaaatttgttgtagctatggccatgatgtctttatccctttgtccttaatccttgaaatggaaagcagact

SEQ ID NO: 467981 - DNA, 490 bp, Homo sapiens
tccctgacccccgacttcttatgctgggcactccatgcattccatttcttattctgccaacactccatttctacaaggaaattcatcaggtgcacttttggggcctgctctggtttatctgaaacttgattatgttcagttacatagtatgtcatcaaaactagctctgatatttaaatggaagagaaggcagatgggaggagggagggacctgagtctgtgctcatgtttctccatatcccgctcttgtggacgtcagacaggacagtattcagctttccatgttatggtttgcaggttcagtttagaaagaaggaaagggaaatccccttcctcattcaaacatgaatctctagctcatggcctttgcattcgactatatttctgcagttccaaggttagaatgctgagtgtcagtgatgctgaggagtggctgagtgacttggagcatcgcttcctggacccaggttacagtacttctcaatgacag

SEQ ID NO: 467982 - DNA, 602 bp, Homo sapiens
agctcctcaagcctgcctgttggaggagtctgagatagcagcaacttctgcttcctggcacagtgaccaaaccatctgctgaccaggggaagcagcctggatcatgttcacatgtcggaatatctcctaagcaataaatcagagggttctctggacccagcaaaacgcagagtagtaagaattctttatccacatttacccattcagacacaagcatggtacctgcccacctgccgctcgtgctcattcctatcagtctggctgctcgagtctcccttttctaatgatctcattcatctaccagagtccacagtggtttgtccagattggggggtgcagacccatctggaaggagcagagcagagggctacgctattgctgtactgccacaaatcagattcaatgtcacagcactctctgggtgcccacaaaatggtgatttcgaaggacagctggcagagcccaatagctcacctacctttgggacacagaagggctgctgtctcactctgcaccctggcccacgtctttgacaagaactgagggggaagccgaagatttatattggtgccgttagcagaaattgctggttgtcaccagac

SEQ ID NO: 467983 - DNA, 589 bp, Homo sapiens
ctgcatattgtccatcaagactatgaaattggaaaacatgcttggatttagaatgtgttcagttgaaagtgagacactggagatgcctccctcacgtgaccagcagcactggccctgcccgcctggctttgattccagctgtttctctcacattctctggctggctcgccaagctcatgccccctccattctgccctcgcctcctcccacccttgacctttgtggtgtggtagaagcagatggtcttgcagccagacagaggtttttccccttgaagttgctctccatcccaaaaagctgggagcttactgagtcactgtggaatctgctgctgaatggacagcccatggttgaggccagtgaacacggcaggacctctgcttcccttgggcagcggctggggcgtagcctagagtccttcccagagccgaatgtaagaagcaaggctaagcgtggctggggaaactgagtacactttgcggaaagaaaacgtgtgcttcgtacgtgcatatgtttaagaagatcatcttcatcttagttttgctgagttcccgattctactgcgattgtgattcagggattttgttgt

SEQ ID NO: 467984 - DNA, 939 bp, Homo sapiens
cctgggggactgcagcttggggagtgtggcaggccagggctggcaaggagaccagctcagctccatggactgtcagcagcggatagaccaagcaggcccacgggaggcttcgtccctccccagcagggcctctgagcacagcacagcttgtctctgcgggaagtcatttgttacagatctgggccccccaggagggcccccctttccccagggacctttcagtgctggctgagccttctggttctgcgatgagtgagtgacatggggaagatgagagcagcgagcagagaaccctgcggtgggggctgggaggaggaggatcctggcatgtggctggggaagagcgtatcccttgctgctttgctgggttttagcgcagaagaaatattctttgctactttctgaaatgtactacttatatggggatcgagccctccactctgtattacctgatataagcctcacacctccagctaagggacaccaggtagactcaagttaccaagatggcaaatccctctggctatcactggtttttgtgtccttgccctacccagatccagcatctataaaatatagcaaaaggaaccaagccccaaaggagggcctgaggagtgtctcccatggtgaacttcctcccaccaaacccggacttgtcaatcgcaatcagccgccagcgtgggttcccccagccaggccagctggcaggaaggctgccaaggcagcagatctgacgaaagaattctcaatcacatttacatgtgcatggtgcaaaaagggaaaggaaggggggaaaaacccctccggaatccaaaaagaaagtcactaactaattcacacaaaaaaagaatcagccacagatttgtctcagatgttctcaaattgctgtccttaaaagctctgcttccccgtcttcctcctcctcccatccgtccaata

SEQ ID NO: 467985 - DNA, 582 bp, Homo sapiens
gggccattgttagcacagacagacaggactagatactcccctgaatgcaccagagccattcccaaagctcggttctgcagggccatgtggcaggaattatacctagcttcatagaaaaggtctgtggttgtcccttggctgtgccctggagccgtgagacccctctctgtcctccaaagccacagcagggtaacctgatacttgctaatgaccaccagatggctgatgaccacaagggggcatggccctttgagcgccccttcagggtagaagctatcactctgcaggagtgtcaggcaaagcaggatgtagcctgcccgaccctgacagccaaggattgtgcccgtcgaaggagcccacaagataaatcaaggggcagagagaagaaaacagcaaagaggagtgggaagacggagaaggagatccacttaaatcttgaaaatatgggccaggatgtcttctgataacaagctccctcatgtttcctctgtctatgggattctgtatttaagaagattctaacacatcgtgggcatccgaaacgttccaaaacttcttgagtcacctctttggacagctccc

SEQ ID NO: 467986 - DNA, 645 bp, Homo sapiens
tgcctgtgatggctgcacagccagatggtgattccagcaccggccagatctgtgctgcgttcatctctctcatcaaaccctctcttctaattcctccgtgctctctctgttcttgtggtaatttccaccagctggcccttcagagaagcgtgtgtgtgtccagaagcatggaggccgcaggtgtactagctgatcctgtcctccccatgcaggactggagaggccttggaagcccagctcatgtcccacctgtgcactgcctgtgcagaagcctgtccctacgaacaggctccactgtcaacccactctgcttgccagatgaaaactgggtgagtcaagaaaaggcagcttctacctactcactccacttgttcgttccaggcaatgtccccatgtttactcacgcacgcattggattaggagacctggaatctgagatgtcccagcaagctttagctaaggtcatggttacctccatgaaactgctgctcttccaagtcaggtcttggtttgaccccagggaagcctccctgaagtccttgtcctgggctgcttggccaaccatgtgcacgtaaaccctggactgcccttggtgccttcacactcttatgcatgctcctcatccatttttctgattagaccacc

SEQ ID NO: 467987 - DNA, 784 bp, Homo sapiens
ccagtgggtggagtgacactgagtctccccactgggaggcaagcattgctcttcaagaccagaccacaagaatggcaagcattgctcttcaacaccggaccacaagaatggcaagcattgctcttcaacaccggaccacaagaatggcaagcattgctcttcaacaccggaccacaagaatggcaagcattgctcttcaacaccggaccacaagaatggcaagcattgctcttcaacaccggaccacaagaatggcaagcattgctcttcaacaccggaccacaagaatccccactgggaggcaagcattgctcttcaagaccagaccacaagtatggcaagcattgctcttcaacaccggaccacaagaatggcaagcattgctcttcaacaccggaccacaagaatggcaagcattgctcttcaacacctggaccacaagaatggcaagcattgctcttcaacacctggaccacaagaatggcaagcattgctcttcaacaccggaccacaagaatggcaagcattgctcttcaacaccggaccacaagaatggcaagcatgctcttcaacaccggaccacaagaatggcaagcatgctcttcaacaccggaccacaagaatggcaagcattgctcttcaacaccggaccacaagaatgctctcgtcccttgcttcttcttcccccttgacctcattggcctctgggacctcctagcttttaaccagactgttaatgcctagtacctagcaggcaatcaataaacacatgctgattgcaact

SEQ ID NO: 467988 - DNA, 748 bp, Homo sapiens
gcctggattttattccaagcataatgcaaagccaaaagagggctgcaagagataaaaggtacgaagctagtgcagttcctcaaaaatgtgctggctggactctggttattggaggcagggtgagaaagaacagaaatagggacgccgactgggaggatgttgcaggagcccaggtcatggtggaggtgactgtggccaggctggtaacagctctgattctggatgagaaaactgaggtccaaagaatttcagaaacttattcctactctcaaagcttccaaaccagcttccctccagataacaattcccacaatatcttccctacagccctgaaaggagcatttgtttggactcgaatccagttatgtctgtcccagcacctgtgcatgtggccatattcctcaggtggattagctacagagcaagctcaggcttttagttttgggggctctgtagaaagaggacgacaaaggctgacaggaagaagttcatgtgattctggtagctggcagctcagctgtcctgtccgtgtgcccaacataggcactggtggcacgtgctcaggatgacaatagcaactgggctttctgggcacagggatcatccactcacaatgggacctagctcagggctaaagaatgaagcccgtttcagcccttgctggaggaggttggtaagaaagagtaggtgcaaagcccagataaacagatcctggttctaaaatgaacactagctctgaatgtaaaaa

SEQ ID NO: 467989 - DNA, 733 bp, Homo sapiens
ctgaaggctgatggttgaactcggttctccccctttgggaagggacgtaggttcagttccgcagagggaacaagtcacctttattgccccagcagacttccccaaccaccaaatgagggaaggcatcctagaacacatggcctcgtttgagccaccagccggtcacagtgatcaaccaagccattccagacaaactgcccaaaactgtccaggcaccctaccagcattcatgaaaaataagaaatgtttgttgttcaaagccacaggttgggggcaatttgttaggcagcaaaagctaactgatacacaagttaagatcaatttgccaagaggtgcatatcacttcggggtctgtgaagagaagggcattccggcaaagagactcactcttttgaacactggtggatttcctggatctagcccttcaaagatactgactgagatccagaatatagcaagtgcctccaacacattattaaatgaatgaataagtaaatgaatgttggtaataaaggaggagggtaactctgaaaagaacgatgagaaaataaacatttccaagtgataaatatggttcaagaataaaggagaggagggatcacccatggtaaaaagtttctagcctgaatggggtggggggaatggagggtaggaaaatttgcctcacatcaactaaaatccgaaagtttctttctagtcctaccctattgcattttctaaatccttaaggggt

SEQ ID NO: 467990 - DNA, 1336 bp, Homo sapiens
gattctgccaatggctccaggtgccaggtgggaagcacacttgagccagcacccaaaggtgggggcaggctgtgcgaccagcgagcctcctactcacctggaccttgggttttaggcacacctgaaaaacctagaaaatacgcacctcatgaaagtggttatgaggatcaaatatgatgacagatataaaggcatgctttacacttatcagctccattcctttgtccgtaaaatggagataacagcatccagcatgtgcaggcatggagaggatttgaagcaggataatgaggctgggacttcatccttgctccacctcaggagatctgggtgcagccagctgtggagctccgtggcacccgagctggggagccaggcctcccttggcctccctcgggcccacagccaggcccttgcccctcgctggctggaggccctgccagtcagcttcggggtaggcatggccgtgggttctgtggatccctgtgagccaggggctggaggctctggtctcagctgctgcgggccccatggtttggtgggtgtcggctgctcattagcagcaaatcaagatgttcagatggtgcaggagccagaccctgcctctcaggcaagggtggcagactgtgcccgcacccgctaccaacttcctgtcagccctgcaggcctctgtgccatgtgccatttcaaagagaacagacccagcagcagcacccatactgctgctgcgtcctgcgcctgtgtccccggctcccagcccatccttccagggacacggagagtcacaggcagcttcatcgcttccttacatccagcacagaacttgctggagctgcttcctgcagaatattgctggggtcatgctcttctcttcactgttgcagtgccagcacaggtccatagagatgtgattcctcaagagctctgggtgaaggcatcgtgccccagccctggctatgggcagcacctgagcaacagctctgttttggggaggcagctgaaagtggagggctgtgggaaaaagatcaggatggagaacgatgctgagctccatgaagataggcgctagatctttaaattccttgtagctacgaccatgtactccttatccctaactactaaggagcatttactccaaacaaaggccccatgagcaacccactgcagactcacaattacacgccagccacaccagtcaggaggaccgtcccttcccttcagttgctacttagcttttcacactgtaacccaggcctactgccttcctggtaatgatattataatattgtctttgtgtgccctttgccaagtcattcttggcaatccatggaaattc

SEQ ID NO: 467991 - DNA, 803 bp, Homo sapiens
ctcactcccacaacccttgctgctctgctcgcctttggcagtcatgggatccaggccagtagtgcaagctgagcacagcctgccaggccaagtgggcccagcagggcagctcaaggatgtgggagtggaggctgtctgcaagctgcatatctcaagcattactgatctaagggctgtgaagtggtatctggagctttgcaggcacaagatgaagtggctgcagtgtcttgagctgatcctggttctatgttttagagttttgaaaatggagagcaagtggattagaaagggcttgagcattagcactgtgcagcacagctcagcagaacttcactggaaacttcaaaatgcaccacaacgcagaagtgaaaaccaaggaagaaagtctgcagtaaagggggcaaagtgggaagcaaagcaccaacttagtgtcacttccaatgaacttgaaaaacggaaagaaggaaaagccatctttaacgaaccaccagctctcccagaatcctccatcacttctctcctgccacccctagaaaatgcctgcagaatcctggcccatcattcacggccaagccagagcctgcccctctcagattccaagtttgccctcccgctggcgaaattgatacagcagccgaattccccttgcagccaccctcccctcatctctgaggaaggaagtttcctgtcctccatttctcacacgagtgctgatgaggggaaggaccacacaaggcgaaatcctaaacccggaccttttaaaccatttgtgcctgcttgttgtttgaagaagtagggtgctg

SEQ ID NO: 467992 - DNA, 485 bp, Homo sapiens
ccgccatttacctctagtgaaaatgcagacggttgcctcattttctgctctgaaaccccctgttttcaatgctttctggctgaaaaggaggcttccattccaagctatgtcaataagttcagaaaagggactggtagcggcagcggggactggtagaggtggccggaccaggcctcagggtgaggttcctggaatcacagccagcaaaagaggttaccttcctgtgtcacaaactaacatgcagaccacagtcatgtcatcatcttttccttctggggatcctattgcgatgtctaaaaatggtatctttattctgcccattttctaccaaggaaaagcgcttggttcaactgcaggtgttttgcaagggctcagcgactctgctagaagtcatcaggaaagctgtttgtttcccccagtaattctggactcagcgcatttgtctcaggctcctggtgatctgggacggcacattatttgatgtc

SEQ ID NO: 467993 - DNA, 702 bp, Homo sapiens
gccctgtgcgcctcatgaaatgaatgatcaaaagtaaattacagacttgcaaatgggtggttaacgactgagacaatatgagtgcagggagaagctcatcagaacacactgggcaagagcaggggagcggagtgctgaatacaaatgcttgccgcaaaaccgagcatcagcgcacacggcccccagcggagggacgggtcattccccacacctgtcaggggcgaggggagaacgtgcttgtggagccttctttcaaaggaggggtagaggaagagactgcatggagagaaagaacagcggagaggaaaaacaccaatgtcacggagcccccagctccctgggaagctgatgagaccagccctttcttccctagacagtgggctgctgctcatgccctgggaatttcaatgaaagctggagagctcaaatgtggggagtgttttactgggaaggaaggtgccaaggcagagccatgctaccatagaggaatgcgggccatatgtatttctaggggtgagcacccatgtagcaacctctccactactttgtgacagaatgagggatttagtgaaccattagagctggcttctccaaagaccaatcctactgcatactacagagctctatgcattctgtggaccgtggttaatcatgaaatgcgtacgtttgaacccttacgatgtaccaggtactctgctaggt

SEQ ID NO: 467994 - DNA, 582 bp, Homo sapiens
acatcaaagaccaaaggtagataaatccacgaaaatgaggaaaaaccagcccaaaatggctgaaaattccaaaaaccagaatgcctcttctcctgcaaaggatcacaactccttgcctgcaagggaacaaaactggatggagaatgagtttgatgaattgacagaagtaggcttcagaaggtgggtattaacaaattcctccaagctaaaggagcatgttgtaaccaaatgcaaggaagctaagaaccttgaaaaaaggttagaggaattgctaagtagaataaccagtttagagaagaatgtgaatgacctgatagagctgaaaaacacagcagaagaacttcacattgaaggtcaacttaatgaaataaagcatgaagacaagattagaaaaaaaagaatgaaaaagaaccaacaaatcctccaagaaatatgggactatgtgaaaagaccaagtctacgtctgattggtatacctgaaagtgatggggagaaaggaaccaagttggaaaacactcttcattatattatccaagagaacttgcccagcccagaaagacaggccaacattcaaatttagga

SEQ ID NO: 467995 - DNA, 1874 bp, Homo sapiens
agcagtagaaactgcaggccaggatgcggggggctgaagtcaagcagcagccctcccacctttgtatgaggaggttagccctgcttttcctgagggagcttaatgtcctccccaggcaattgccttgtaagacactgctgactctcctcagaaccgtcccaccacccttctttgcttctaggcctttagctagattcaagtcccagcaggcctcaaagggtgcaatgcaaggagacccaaaatgtcactgtggcccttcagtcagagtacaggcttatggagatcaggtgatcaatgaagttttagctaagtggggcctagaacaagagaaggctctgcgacaggtccaaactgacatgaaagctgccctgcaagttaggcccagtgatccatccgatccaatggttgttggggagtcaatgtcagacaaagatgttatctggagtgtttggctggcatatcacaatgttgactcaggactttatattaaagaaggaaagtggccagtcgtgcaattatataccaactcatgggctgtggccaatggtgaggctagatggtcaggggcttggctggaccatgattggaaagttggtgacaaagaggtgtgggaagaggcgtgaaaaagtgggcttcttcaaaattaagaacttttgttcttcaaaagataatgtaaagcaagccacaggctgggagaaggtactggtaaagcacttgcatctataatataaaaagaactttttcaactcagtagtaattttaaaaattcaataaaaacaggcagaagattataacacacatttcatcaaaaatatatatacaggtatcaataagcacattgtaagatgttcagcattgttattcattagaataatgcaaataaaaacacaattgcatattagaatgtttaaaataaaaaagaccatataaaaaaagccccataccaagtgtgtgaaaggctgtggagtaactgggaccctcatatactcctggagggaatataaaatggtataattactttagaaaacaggttatcagcctcttaaatagttcaacatatgcctatcacacaaccctatcatattactgataggtacaggtgaagtatcccttattcaaaatgcttgagaccagaagtgcttcggattttgaatttttttgaatgtttgaatatttgcatatacataataagaaatctttggagtaggactcaaatctaaatacaaaattcatttatgtttcatatacaccttatacacatagcctaaagtaattttacacaatattttcaataattataaacaaaaacaaaattttgactgtgttatgactaagacctgtcacgtgaggtcacatatggaattttccacttgtggcatcatgtcagtgctttgaaagttttggatttgggagtatttcagattttgaatttttgggttaggaatgcttaacctctattttcccaagagtaatgaaaggacatctccaaaggcttgcacagaaatgctcacaccagctttatttgtaataaacaaaaacaaaaaagtgagacaatattcatcaacaggtaaagaataaactcattatcatacatccatactatggaatactactcagctataaaaatataaactactgattcatacgacaacgtggatgcacctcaaaataattatgcatgctgagtgagagaagtcagacacgaaaaggccagctcaaaagtcatctcttctgtgcaactgttcctaattttctgccttcccatattttgacatattttgattatagcactttttacattgtgtcaatatccatctcttgcattagactgtgaattctttaagaagataaactatataaagaccatgtttgaa

SEQ ID NO: 467996 - DNA, 919 bp, Homo sapiens
aacaaggtgcaggggatggtgaaggctcagaaggttccagggtgagatggaggcagtggcagctgtttggataagacatgataggagcttggactacagtggtagccatagcaatgaagagttcggaagatgtttagaagtgcaggtctgcagcttgtggcaagccaaggatggaggagacgtggtcatgtgccacagccctgttttacagctgtgcaaatggccaccatatatggaggtggaagtcaaaactaaggtcacaggagatgaagatgatggacagtcctgtctcctgcaccaggtgatgaatggttctgtccccttcatcagtgagagctggtctagctgccagagcacagaacgacacagatacaatgtgatgtgtcaaccactcatgtttcttttttatgagatcaacatttataactctgcagtcagcccactgacagactgtaaaacttgccttattggaagcagacacatcaaccacaaggcaccacttgttgaaggctgattccagtcttccctggactggaatcattaactcaggcaggcacgtggtcagcacgtcccactcccatcagcctgctgggaatcagcattattgggaatgacgtcgtctgcccctctgcaactccccgaagagctaacttaattgttgggaaacatcggagaaaaagatgtcattcctctacatgagtggttctcaacatggggggaggagagggacttgtccctgaggggacatttggcaatgttgggaaacattttggttttcacaactatggaggaggagtaccagtggttaatactctaacgagagtgaccagggatgctgttaaacattgtatagtgtgcaagacagcagccttgctcccaccccaacaatggatgacccagctcaaaatattactagtgc

SEQ ID NO: 467997 - DNA, 731 bp, Homo sapiens
tcttgggtatttaccccagacaacgacaccacttcaattaggccatgggggctctgccccacttgattcatctgcacgctccatggagggcttggtttcagatgtaccatcatgctgatgtctataggcacatctcaggatcctttcagacagaggaatgggaaggtgatgatgtccaagcaaggaggatgtgtttttctccaactctgaagtcccactcaacaagagactatgaagtctccacagttcaggtgagggaagctgtgcagggtgggaggaggggaatgggaattcagcctgtgggctttggcatctttgccccagcccactctggcctaaacatgtatgttcttttgaaaggagagaagggaggtctccaacttccgctttataaaaacactgtgtgcctctcacccatcctgaatctcccaaaggcacatttcttgcactgtgaaaacctcctgggtgccacacacagggacacctctggaactcatctgtcctgaaggagattccccgacagagacgtaaggacatattttccttagaaaatactggaggtgaagggcttactgggtgtaaggcctaaggagaatcagcaagaatccgaaaaggaggctgaaaatctaagaacaattggaaaaaaccagtagccttaattactttactttgctttcatttttattcagttttcgttttattaaataattttccttccacacagatatgtg

SEQ ID NO: 467998 - DNA, 614 bp, Homo sapiens
cagactttctttatccaaaggccacacaatgatatgggtggaggtggctgtgcctagaaacaggcgattggcccatgttggagaggattctggatgccatccaagtcctggaggattcactgcagtgctcggtggccttggagcaaggccagctcagaaagtttcccaagcccaaattagccacagcctgggatccactcatgggaaggtgtcttggctaaagaaggccccccaggtggggatgaggaatagagaaaagcaggaaaaggagaggcaggagacaccacagacagaactcactcccttcaataccttgcccagggccagctctgattttgacctccagatgcttcctactttttctggctcctcatcacagttggtggtgattaagagcccaccactgggtgtacatgcagagaaaatgaggatcttgagagatagcgtcagtcccatgttcgttgccttatttgcaatagtcaagacatggagacaacctaaatctctgccaacgaatgaatggaaaaagtttggtctatagaagcatatttaatttacttgaggaatgaaatagaaaggaggcctgtgacccacgagtcctgccttcttcccac

SEQ ID NO: 467999 - DNA, 680 bp, Homo sapiens
cgccgggccttagctgccttcccacggggcagggctcaggacctgcagcccgccatgcctgagcctcccacccactccatgggctcctgtgtggcccgagcctccccgacgagcaccaccccctgctccacggtgcccagtcccatcgaccacccaagggctgaggaatgcgagtgcacggcgcaggactggcaggcagctccacctgcagccccactcaaggtttgtgatgcaccaatcgacactctgtatctagctgctctgctcaaggtttgtaaacacaccaatcagcaccctgtgtttagctcaaggtttgtgaatgcaccaatcgacactctggattgtaaacgcaccaatcagcaccctgacaaaacaggccactcggctctaccaatcagcaggatgtgggtggggccagataagaaaataaaagcaggctgccagagccagcattggcaacccgctcgggtccccttccacactgtggaagctttgtaatacagggagggatgttcagctccataaagcatagtaagatgtaccctgggagctgaagacacagctaactacatttttcctaagaaagcctgtgttctttgaggccttttgttctggaggtaaagcacaaaaatcagtgactcagggggacaaaaattgggctttttaatttctgttctgtc

SEQ ID NO: 468000 - DNA, 578 bp, Homo sapiens
aggacacagggtgtgacgatttggaggagacagaactctggaggttaatgctttactttgaaggaaaaaaaatcactctgaagcttaagagcaaaaggatatcctctctgcagtttgaaaggaaactggagacagagctttataaaaaatgcattagttgcaagccgagaagaaacccatctgaggtgcaaactatccccagaatggtgaaagccaccaaaatcactgggaaccctcactttagtggggagacgtttgctgcaggtggctgggggagcaggaaagagaccaacaacatcggcatcacctggaaatgtaatagaaatgcaatatctctagccccagctcagaccaacagctcagaggctctgggagtgggactggtgtgtttcatgatgccctccagtgagtgtgaagtggtacctcactgtggttgtgatttgcatctctctggtgattaataatgctgagcatctttttaaaatatatatttttacattttttatatttaattgacaaataacaattgtatataactatggggtatgatgcgacactttgatatatgtgtacattac

SEQ ID NO: 468001 - DNA, 666 bp, Homo sapiens
agaccagctctgagaaggcaggggcaactgaatttcccacacgtcatctgcaatgaactggaaagaagatggagatgagacatgtccctcggggaaggctttcatgggaagatgtggccgaatttaggcaccaaatggcttctgcttgccaccccgctgcacactctacagaaagaaggagaactgcacggatgcctccgatgtgggtttatctcttgcacatcagtggtggtggaagagcatggaggacgagaagactgcctaggccagcgtcctaaaactgtggacactgaaggcaatgttttgcacaccagtggttgtgacctttttgtctgttcagtcacggacaccgtaactgtgctcctgggaagtgtagctggcgatgctgaagagcctgactcacaggcaccagcccttgcctctgggatggaccagcccacccacccctggccttgcttttcagctggcaaacatgactctgtccccaaacttctcatagatacttactctcctttggctttctgtgttctttgagggaaaagtttgagaagccgtgtgatagctcattttgcacagctgtttcttgcttcatttcctggtatttctttgctctttttgaccctaactgcccatctcaagccctttgtgcctttttggctttcagta

SEQ ID NO: 468002 - DNA, 614 bp, Homo sapiens
gagatcttgggtgataccaaaggcggcacatccggaaggctggttatacctagcgtggaggggagagggagaactgtttcttcccttctgcaggatgctggcattccttggattatggccgcatcactccaatctctgcattgctctctctgtcttcacatcaccatctcctgttcctgtgtagcacacaggctgctgcaggcaaatgactttccagaagacaccacatcaaaaacactaaaagcaacacggaatggaattcagacaggtcagtgtttgcggatggggagaggggacatgcaggaagaggttgccaggtcggatgagaaggacctgctgtgtttcacatcagacaccacatcaaaaacactaaaagcaacacggaatggaattcagacaggtcagtgtttgcggatggggagaggggacatgcaggaagaggttgccaggggaagaagaaacaggcctcacctcttgatgagaagtggacgttttggaagaatttgtgggaatgagaagtattgcagtggccatttttggagtggggccacagatacacaaactctatatgtacaagtgtgtgcatctatagccccagtccaaaaataagctac

SEQ ID NO: 468003 - DNA, 538 bp, Homo sapiens
aacttcaaaccaggtctgtccatgattttatcaactaagttaatactgcctcaaggtagagatgaaaaacaagcagtattaaggggaaaaaacatgccagttgtgggcttgctgattttaacattagttcctattgtagcccccagagaaagggaaaatgagtacaaagtatgggcacctggtggccggggaggcagctgtggcccagctatgctagaaatcgacataaatccaatgcataagtttccaatgtttactaaggaatttccttggcatcaaaacctgtgggaaaaagaagaaagtaagagtggtcagaaggaaaagttcatctgtgatgtatgccctataacagtctcagctgaccacccgggaagatctggagcaagaacagcccttcagatacgtcttgccacggaccaagatgaacagcagtttttgttcaaatgttaatcttcccacatatctttgggggacccccctaaaaaaaaacctaagggagcattggtaacagaagctacctgatatggtttggatttgc

SEQ ID NO: 468004 - DNA, 704 bp, Homo sapiens
tccttaggacgtttgcaactgtgttggtttcgttctcaagtaggctcttcccacttggtggtaaaaatggctacgaaagctctagacttacatggtcctcatgaccattacaaagcctcaggcatttatagcaacacaaatgaactaaggaagacaactggtaccaaggagagggtggttgctataaagatacttgaaaatgtggaagtggctttggaactggatcaagggatcataaggacctttaaggatcattacacatggtcctctatgaaaaggactgtcaacactatggaagagaaccctgattcaacattacgaaaatctgaagaaaactgtccagatgttgtgcatgacttcacaggatttaacttaagttttgggggagtcaaaagttctataaaaaatggtttgcaaagtaataagcccacgttacatgggctttttctactatttgggggaaaaacagcttatctaagaaacaaaacaaaaacattactttagaaaaaaatctttagctctatttagagatctctgcaacgttcttttaatttctaaattattgcttttatacaatggaataaatacatattcatgtttgtttttcaacagtgtcacactccaaaatttttgcaaatactacaaaattctattattttgaagagatggcaaataggcaattataacatctgataatgtcaacc

SEQ ID NO: 468005 - DNA, 983 bp, Homo sapiens
ctgggactgggcacaaccaggcgcggtatggtgggacttgctgcaactgctgtggggaatgggggtgtggttcccaggccaatggagttgttcccataaccattatggctgcctctgctgcatcacacaggtcaccagggaattgggggaaagtcggcagtcacaggccccactcagctcttatgtaacccacagcccaaaagaaatctatggaactttgaacttgagagatgatttagggtatctggcagaagaaatttctaagaagcaaagcattcaagtggtgacagaaaataaaagtttagaaaatttgcagcctgatgatgcagtaggaaagaaaagcccattttctgggaagaaattcaagttggctgcagaaatttgcgtcagtaatgaggagccaaatgttaatcaccaagacaatggggaaaatgtctccagggcatgggccccctgctgtgtgcagcctctggagttggtgccctgcaccccagccactccagccatggctaaaaggggccaaggtacagttctggccattgcttccgagggtgcaagctccaagccttggcagcttccacatggtgttggttctcgtgacctggatgtgagacatggagtccaagaagatcattttggaactttaaggtttaatgactgccctattggatttcagacttgcatggggcctgtagcccctttgtttcgagcttacacagctgctgagtttagcggtagacctgaaattggacccagtcccttctctaccagcctggcctccagatggcagcacaagtctgagagtttcttctttatgtaagaaaggaacagtgttttgttgtggatcattttatacaccagacaatgaactgtcaatggaaatagatgtcagctgcattcaaatttctagtttatttgtttttatttttttaaaaattgtccttaagtgttccttcccttgtgagaacaccaaggccttattt

SEQ ID NO: 468006 - DNA, 584 bp, Homo sapiens
aataaggtgttcctgcttgaagatgtcaatgccctctgagtgtctccaagagaaggagacagtatgcagacttctttataggtatttaaacacagaattcttttgtcaatttctgtgctttgtagcaggtacttttgtaaatgctgatccagttgcaccctttcattttgcagctgaagactcagcagagaagcagaggctcagcttggcttcttccgggtctagtggggagccacaatgggctggccgctggcattcccaatccatgttggaggaatcaactgagctatgcttacaattagaagtcttctcattttgtccacaactgagaaggaggcagcatttaggctctgagcgaaaagatgagaagataccagcagggaagggttctgcaggcaaagagaccgtgtacaaagtcaccagcaagctcacattccttgtagcatttgattttcataacaattcagagaagcagcaaaggcaggtataagccccagttgatacctgctagggcagtggtcctttcagttcacagtgctgaggcttccaaatttttgtgacatggacagctggagaatagtctt

SEQ ID NO: 468007 - DNA, 706 bp, Homo sapiens
ccctgctgttctccccgtagatggcctggcctcttcccgccatgaccgtcctcaacttccctctcaaaagaatgtatcagctcagacttagcgtggagcaggacttggaacagctcaggtttattctgaggggtaaggatcagttgacgagggcccaggccagctggctccgagggcagacattctgccagcacacttctgtctggggtaatggaaagcagagacacctaatccccaaacttcatcttagacacaactgtagtttaaaacctccgccttcatcggagctgctggtgatccgtccgtgcggcgggcagcgatgccgctgcctctccttcccctcctttgtggatgtgcgacgtaatggaggagaaaccgtgcaacagggcctgcgtcatgaacagcctggacagccagcctcggatggaactgacggaatgcaggccgactccaggcgagagaaggcgaggaagcagattctcccccctggagcctcctacgggaaccagccctgccaaccccacgactttagcccagtgacagtgattgcgggcttctgacctccagagctgcaagagaatatgtgggtgctgtcagaggcaactaagttcaaataaccatttgtgaatgacaagtgttatttacatgttaacatgttaaatgttatttacaaataatatttgttatttggaaataacaaataacc

SEQ ID NO: 468008 - DNA, 544 bp, Homo sapiens
cgatcttgaggaacgttggctccctgagtcccctgaccccttcctccttcttatctctgcgtcttcatgcatgctaagcatggaatgtcctcaccgcgccttcccattcctagtaacccaaccttatcatctgtatagagacccccagccagccagagccttccagaaggtgcctttcaggaacccacagctctgccatcgttcctgtcctctgaatgtagttaaagttgggattcaaaacaccagggccctggggaagactgacacatgctgccacctggttagacagagatcagcaaactgcagctgtttctctctcgtgaaatcacaagaaatggtgctcaatcctggcaggcagaaaggaggtgagggggaacctggggccaggccgacggcttgggatgggcagagaaaggccatattggtgatattgaacaaatgctcattccataccaaggcagccagaaagggaggaaagacagtttctgccctcaaaagatttgcagtctagttgaagtatgaaaatcaaccctggcagtgtttc

SEQ ID NO: 468009 - DNA, 1236 bp, Homo sapiens
gttcatctgattttttttttttttattgtaagccatgaaaaaaggatgcttcaatgtttcctttcaggaagaagaactggaatttgattgtaggaagatctgtttcatggctgtgaccaacttcaggggatccacacaggtgggctgctgtcctgaagaaaagtgggagtgtgcttccccccctctgcaagatgaaaaccattgctgccttcattctgcttcagctaggtgccttagcgtgcccgctgatgttgaggaggggacaaaagccctccctggccaccttctgaggcagcagaggtgcctgcaagatggtagctttcctcttatggtttacgatcctccttcttcctacctggggccagcgagcaggctaaagaacgaaaatgagcggaatagtcagacgcacgttgatccggggtctgaagcaatctgcagcctcagagctatggcaaaatgcagagcgtttgactgaagtacttcgtgcagttggttggccaaacaaccaatgtggttgggaaaagaagctaaatttgatggacttgatcaattcataaaactgtttgcccatgtgtaatgggaaagggagttccaaccaatgctccagcgatctaaagatgacacagtccaacaccaactcaggtagaggtgacactatccaatgccagctcagcaatccaaaggtgacacagtccaacaccaactcagagtagaggtgacaatatccaatgccagctcagcaatacaaaggtgagactgttcaacaccaactcagggtagaggtgacactgtccaacagtgagcaaggtagaggtgacactgtccaacactgactcaggtagaggtgacactatttaacacaaactcaggtagaggttacactatacaatactgaccccagtagaggtgacacggtccaacaccaacccaggtagaggtgacactgtccaacactgacccatgtagaggtgatactgtccaacaccagtccagagagaggtgatactgtccggtgctgaactggtagaggtgacactgtccatcatgttaccgagccaggtagaagtgacgctgtctgacactgactctgtagaggtgatactgtctgtgactgatttgctgaaaatgacaacttcttccaaagcagcattttgagaagttaataataatgataatttttgatttccatcacaacttggctcttttttcactccctgtccttggtgtgaccgtgta

SEQ ID NO: 468010 - DNA, 736 bp, Homo sapiens
gataacgccatggagttaatgtttgtgggtggcgaatatggtggcaacataaaaccaacaccctttctgtgtttaatcttgaagatgcttcagattcaatccgagaaagtgaagaggaagaagaggaggatgagaagttggaaagagtgccatcacctgatcgcctccggagaagctacggagacttggacaagccccgtccatctcccacactgtgctacagaaggagtaggagtctgtctcccagaaggcggaatcgatctcccaaaagtagaagccccttctcccgccgagaaaggcatccgagcaagggtccaagacatcaccgcagcagatcccgagaccggcggcacagatcccgttccaagtccccagatcctcaccgtagtcacagacacaggagctactcaaaatctcccaaaaggtctaagaagagccacaagaagagccggagagggaatgaatggtaacacagacacagagaagcaaagccacttgctcagcgttccacagctcgttggtgtccaagtcaagcttagaattagggtgttggtgttctggccatactatatttctgcaatttttccccttcagcgtcacaattctggcctaatcttgtttcgtaatgttgaagcaattcttgtttaaaccaaaaggtattctgtttattacttaaagtgacatttgggtccccagcctttaaaaaaatttattttaagttctggggtacatgtgt

SEQ ID NO: 468011 - DNA, 855 bp, Homo sapiens
taagattctgtctgaaagaaagaaagaaagaaagaaagaaagaaagaaagaaagaaagaaagaaagcccaaacaaatcaaaatcttttttctctgctctggatcctctctctctcctgttgccatggaagacgtgactgcttctccttctgccatgattagaaattacaacggaaacgagaaatgttatgaaccagatgccgaaaaagtcccagtggcaagaatcagaagagggcacaaagaagccataggcttccactggagcgggcgggattcacacaaggtacacaacactttgtcaggcttgttagatgctgtgatgaggaagaaccaaggatctaagcccctcactctgtatgaaagatgccctgaacaagcacacgtttttgagaccaactcatcggaattgtcaaatccaggggaagagctccaaggtcctactcagatctggccagcccatggatctcctggtttcctaaagtgtcgcagagtcaaagatcagggctggtggctggatgtcccacagtcaccttgtttatggattgccactaacgcgggggaaattgactgcaagccggttcacttggattcctgctcttgtgtatcagccattgacacagctgttcagattccagttcaaaggtgttagaaggctgattttctccttctaaattatgtcttaaaatagtttaaaaatatttttcccttgtatggaatattttaggttactcttcaaagatctaaatttaaaatgtgatcattcttcagtgtttaaaacccttaacatgaaactgacataaatctctatttaattttattacaacattttggtaataggctctagtattatattaat

SEQ ID NO: 468012 - DNA, 535 bp, Homo sapiens
gccccgttactcagttcaagagcaaaataattgtcacctagttttgtgtgtagcagtgtgggttgggagattcgtggagggccatggttcccatcagtgcatggaagccttgtgaaaacacaaattgctgggccacaccaccggagtttctgatttaccagagaggattctccagcagatggcctttgaacttgaactggaacctgggctttcttgggtctgcagcctgccagcctttggactggaattggagctttggctctcctgggtctccagcctgtgctgtatgctgcagctttcagacttgccagcctccaagctgttcaaaggatgctcttggaggtattagtgagaaacatggattgatctctgacagagatggacagagctatccacaaatgataggagactcaataagtaatggttggaagacattaatcaagggcacagcctcctggacatgcagaaggaaatgctatggttttgcatgtgtggaagcaccgaaagcctaggacagttctctccaggatgctgt

SEQ ID NO: 468013 - DNA, 1627 bp, Homo sapiens
cttcagctatttgggaagattaccgatggaaagacttccaggtatgcttcacctggggatcaccagtgtttttcaggtcacaagctcatgtaggcaaataatcagagataaaaaccatctggaattaacgtccactgacttttcaaccacattctctgactaccaaccaatagatctgttaggttgctgcaacagtaactgcagttttaccattgaaagtaaaggcaaaaactgcaactacatttgcatcaacctcatagcctctcagagaagagaaaccagggagatgactggacaaccagcagctcttctctcttcctgtgttttctggaagatcttgtacctcacctgtcatctccaagcattgggcataaccacgctgccttcactcacagcgatgtcaggggagcccacagctacaccagatgatcaaactctcagagatagagatagtacagaggtgattcagatagcagatgagtggttggactcgcagacacttaccatccaattctgattcggtaactcctgaaattgattaagaaaacaattgtcagtgacagaatttattcacacggagtcagctctactttatcgctgaataaggaagggaatagcttaaggaagctgggaaatagcccaaaacaaacgtcaaattccctgtccttccaggaagaggaacagaagaacaggaggtgctgtggagttgggagactgagactgtcaggagcgaggagggatggctgtaattttaaatagtggcatcatcaggatgaaccttgctgaactgaagccccttccatgacactaaagtaagaagataattctggtcatttcatccaagcccttcagattggcaggtgtttggttcaaacatatattcaggacatgacttattttgatatttgaggagccctcttctctccatcccctccggaaaaaaaaaaagttgattttccttgtgattcttctggaactccgaggcaacctgttttcccaagaacagggcaccgaggtggtcgcaagggtgcggagggaggatcgcccctgtgggagaggcgcgccggtctctctcagggacctgtagctacacgcagaagatgctgccaattgcgcggaggtctctgacgcttggtgctgaggacattgtactaatttaaatggtatcagagtgaacacgatgctacatgtagaatgaaacttcccaagccctcacctgaagagacaaggctgaagtcataaacatcatacgtggaaaagtattgcaaacctgcttctcttctgtgctggggtctgtaccaatgttcattgaaccaaacaaggtccctatcttacagaagatgcttcttgaaggatggcgtgttaatcttctaagtatgttctggttgcgaggatagagcactgtcacagctacagctatacctgtgcaaagccaggaataacacgctccctaggagagtctctagccttaatctgtagctgcaaatagaaatgacaattcattttctcaataatgaaatgtttttgggtagggctaaaagcagaatgaaccaccaaaaagccccttttgacatggtgcctgtgtaaagacaaacgtgtgtaatgtgtctgcttcttttaaggtgct

SEQ ID NO: 468014 - DNA, 606 bp, Homo sapiens
tctgctagtcacatgatgttatgcaacttactctacctccctgagcctcagtgttcccatctgagaaatgggaataatagtgtccacatcatgaggttaccggagcaagcccagggagtgggttcccacaaagagaacctggagatgactgggaagtggagacaaatctaccgcgctggattcttgaactactgctgctccaagcatgtaagaataatagatgaaatatggggaaaaaaggtaatctttgctcaaaagcacaatgaacatctccatggactactgaaaatgaacctgaaaaacaagatttttaagcaaatgaaaaaatctaaccctaagaaaaaagccaacaaaatcaaacaacaggaagaaaaatttaatacagataaaattaaaataataagattatctgacagatactttaaaatatgtttaagttgctcaaactaagaaataatatgtatataagaacaaaataaaggtgaaataggcagaaaaaaagggaacaggtgagtaatgaaaaagaaccaagtaggaatcttggcaaaaaaataaataaacaaaaaagagtattccacttttggcctcgatggattaacagagacc

SEQ ID NO: 468015 - DNA, 638 bp, Homo sapiens
aggcggctagacattgcctgacatcacctctctttggtatctaatggggacattggacttccagtttcacaccatagaatttattctcattttctccctttacatctttgcagcccatttctccagtggcaagaattctggtttcattatcctgaatgtgttgccttctttgattaatccctctgtatgtgaccaatgtccatgtcctccactaatccttccctcatcaaacactctcctctccgcttgggccccaaatcccccattccaggccacctgtcacctacgcatagatgctctcatcagctcgggaactcagcctccccacatatgccaggaccctcccagagagaggctggaccctctggtccacttattgctggtgcccccaagagatttgcatacgaggaaaagatcacaccctccaaattcagacaagcctgaacttgaaccttggcatgtgtgtgccctaagctaagtttcttcaccttcccaggcctcagtttcttcatctataatgtaaggccaagtcatgcataccttatatgggtgttgtgaaggttaagtgagtgtccttcgttattccataagccaatgtttgttgaatgtttgctgtggttaattttattgttttcaaa

SEQ ID NO: 468016 - DNA, 755 bp, Homo sapiens
gaaatatggccagaagtctgggcacagggatatgatttccacatggccaacagggaaactgaagcacagacagagccattatgcccatggttctgcagcacaggtgacagatctgggaccagttgctgatttccaggctggggctctctcactagtgccttcaggtgagtggttctcctctgctgaaataccttcatccttcctcttcgtgaacccaaatccacctcagtctgcagacaccttccaagtcactttcctacctgaccccacttcaccccaccaggactgtgactcaaccacgctgaccaagagtctacgatggggccagtcattgtttctagggtcttctaccttcctcatctcatttcaacccacagaaaacatgtgaggcagattttttttcccccattttagagctgatataacccaggctcaggaaagttgagaactccagcttcttgactctccaggttttgtgctcttttcttttccccataactcaaggtgttttttccctcatcaatgtcttttcctttataaacattctagtatttctgtgtaccattcagaagaactgcaagaattttagatccagggttagtaacttgttttttgcatttcattgctttctcccaaaaatacttatactagatttagggattttgtattaaatatcttttaaattataaaagataatttaaaccagaaaatgtatcagcttacgttactgttaaataatgtagttttgtgtttaa

SEQ ID NO: 468017 - DNA, 671 bp, Homo sapiens
agcagtggaactgctgctcacaagttcggcttctcacgttcagctttggtggatactaccaaagagtgccctgaagggctttgatggttttacttcccaacagagataatgacaaaatgtcctcaaacagaaaatctgaaaacaaccagattaagattggaataagctctaccctagcatatttcttgccatatgaagtggtctgccagaatccaagcagggaacacagcgatcttactcatttgcatgctattgcccagaatgctctacagcatttctctctcttgacaccttctgaggaaagacctcatgccatcctgaatgaaagctttataagaaggtcagggtcatgggtgaaggcacctgctcccatgtgggagtggactgatctcttggctgaaatgaatgttgtagcagttaggctgttcccctgctacaagggccacagcagtataccactggtcagggaaagagaagttctccatactctcctgaatctcgagtcaattgagaaaccatagaccagtgtgttaaatggtatattaagaaaacatgtcccatttgttaagggatacaaaattacagctaaacaagaggaattagttctagtggtccatactactggagtatgactaaagttaataatacatagtttcaaatagctaggagga

SEQ ID NO: 468018 - DNA, 719 bp, Homo sapiens
tgtttgtcaatggggagaggtcaatgcttctggaccagaggctgggctctgccacatccccaacatggagcagctgctcacatggtacagttgaagtgacgaccccggagctgcccttgagccctttatcaccctggacttggccatggcagagctgtttgcctgggacgagctgggaagcctttggacctcggagtccccgattgccgcctcagctcagcattgtcacaaaaatagcccttcttggggaaggcagtgagaaactctttcacggcagactggctgttcacaaggcagatgtatttcaggagatgaagctgcagcccaaaccctttatggaaaaggagtcaaggttgaccggccaactgttggcgctccctggcttccacaactgtgtggagtcagaaactccaggccggggcccttctgaggaaggggaggaggagaaaccgccacaaccttctccatctcccgatgatcaagtcagatttatctggctttgcccaaagcgcctttctccacttatagatgaaagagagtacaggaaaaaaaatcacagagtaagtgtctggttatgaaaaaaaataataatccccccataaccgtacggtgctctaccaattacacagccctttgggaaccctattccaatggattctctcttaacaacactgtgagcaaggcaagcattgttcttcccacttcgtcgatgataacac

SEQ ID NO: 468019 - DNA, 530 bp, Homo sapiens
agacttcctcatcctttggctaagatatcagagccagaaggggagaagggacttctaacagtcgggggatgggatgtacagcaacagtggctgcccacgtctttgtctgcgtctctgtgttcagaagcagttaccagaacacaggtctgcagtatttggagggcaagtttccttttgttcattttggctcccacaagctgtatgccagttgctctgggaacgtgtgcataagttcctgccaaggggctgttaaacctgttcttccccaaggcagcctcagagcaaagtttgatttaattggctgtagcccgagaagcaaagaatctcacggagccaatctgagaacagccactaacactgggagcagtttgcacctccagtgggtgagtatgagaggtttttgggacatggatgaagctggaaaccatcattctcagcaaactaacacaggaacagaaaaccaaacatctcgtgttctcactcacaagtaggagttgaacaatgagaacacatggacacagggaggggaa

SEQ ID NO: 468020 - DNA, 835 bp, Homo sapiens
ccgttctcctcaatgaagacttctttgatcaaccatctcccttctttgaagcatgttttatgaactatttgggtagcactgaacagactgtgatcatgcctggacctgtcatatcccctttctcacaggggcagtagtaaagtgcagggggtacatgtgcacaatgtgcaggttagttacatatgtatacatgcaacatgctggtgcgctgcacccactaactcgtcatctaacattaggagagtgcaaaatccatggcatcacttatgcaggcgattatgcgcacaataagaggaatggcttgccacaaagagatcagggaaaattaggctttatggatccctggggtgctgcccgaatcccagctacaccattaactagttatgtgatcttggtagttatgggagattatatcaaggacagcaaacccaagctgggtgttcagggaaagcctctaggaggaagtgacatttcagttgaaacaaggttaaatggcattttccatttacaaatgatgctgcatgacttatttctcatgtttctgtggccaaaggcccgagggcccctggcaaaccactggtgtaggaccaatagcccaaaagctgaagaacttggagtcctataatagtttttcaactctttttgtggcctcaccttccctgagccctttaagctccctgttttggatttttgtttcattgagtaattgcttaagtttttcataaaaaattctgatactttctgagttgatgcatatttatagtattcatctttgaaaatggtgagttctccctggattcgctgttggtaggaattttatgtgatggaagagcta

SEQ ID NO: 468021 - DNA, 468 bp, Homo sapiens
tcatagagggagaagactaacaaagatattcaggacctaaacatgacatctgaccaaacggatctaacagacaactacagaactcttcactcaaatgcaacagaatatacattcttctcatctgcacatggcacgtactctaaaatcaaccacacgattggccataaaacaattctcagcaaattcaaaaaaccaaaatcataccaaccacactggaactacagcacaataaaaatagaaatcaatacaagaagactgctgaaaaccataaaagtacatggaaatataaaaacctgctcccgagtaactttcagaaaacctacaaaaatgaataaattcctgaaaacatacaaccttccaagattgaaccaggaagaaattggaaccctgaatggaccaataataccaaccagaaaaagtccaagaccagacagattctcagtctaattctaccaggtatataaagaa

SEQ ID NO: 468022 - DNA, 679 bp, Homo sapiens
ctgcactcccgtttctcaatgctgctttcagcttctacccttctgctgagacagccaatcaaagtctccctggcagccctgctcttcaaagggccctcacagctgtctccaggaagacccctttcccagaactactctcaaccctctcctcctgcttcctcaacaatgaatcaacacatctgggggcatcagggctttggcctggagataagcacgtgtgcttcacactcccaggccaagagaaggctgcagcatagaagtctgtaccccaaagctctctaccatctggacattggacctagggtagaagttcttgagtcccagagggcaggcttggggcatttgggcagagttccagggtccctgcacttggagcatggccagttgtggagaccctcttgcaggcatcaggccctgaagatgcctcctctgcagggacagtgtcacctgagcagggccaccatggagccctctaaagtagaggcctgggtccttcttgctcagatctcaggacagttctttttgctgtcgggtttcaataatctaggccaggatctaataagaaaaatagcaaacattattgagcactaagttgcagatgttttaagctctttgcacatgtgacccgatttattctcacaacaatttcatgagatggactatgatttatatcccttct

SEQ ID NO: 468023 - DNA, 491 bp, Homo sapiens
tcagtaaattatcaagtgcaggaatcaatgtctgtattacacacagaggaccccaaggcaggacctgccaaaagtcaggatcaagtgtccggtggtggaatgccaagtgtcagagggcagatccaaagtagaattttctgggaattcaaactccatggggcaggaatgggaatccccgggaggcggtctgctgaccatgagtttgctgttctttcatttccacattttggaatttctggaggaagtcttgctgtccaccgcagggctgaaggagctagaagctggcctgcaggctctgtcaacatctccaacttcacctgctattccacaataacgttttgcctgatgaataagcaaagacattacctgtggatcagtaactctcagcttgtggatccctgtgaggacagggatggggtttgaccacttctgttcttggcccatggaagatgccagtgattgctcataatattccctgatttccttttata

SEQ ID NO: 468024 - DNA, 606 bp, Homo sapiens
ccggctgcctctggaaaaaggggttggagcatccccctcagacatggcttccaaagaatcagcggacgtctctgataaatgctcgaccggggatgcccaaggtgtgcctgatactctagcagtaccctttgagaatgggatgagcagcttcttgctaaaagtacaagacgacccctctcaacagaaccaattgcattatccagacaatcacaccttcctacatgcctctcaggaccttcccatagaggaaagcagggataagatttattttttacaaagtctgcttctgttatggggatctggctttgacacacattacaagtatttgaccaggaaaattatccctaaatcactgcccagttcaccaagatttagacaaattcacgtggtcctcagtgaagtagcttcctccttactgtgctcagcagaatatcaagggtcatcgtagtggtaggtaagtagaaaaatcagagatgcagggctatatattttttctcccctcacttcctaaacatagctatttagctccaaatgtaaactcctctttttgttgttattcacgttctcactgaaaacgatcactacatattagcagtctcctcacac

SEQ ID NO: 468025 - DNA, 869 bp, Homo sapiens
aggtaggtagatggtaggtagataggtagacagatagatgtagatatattgatatacttataatcacgttgtaataatttatttatcaaccccatcccctagaatgcaaagtccttgagctccatggacaaggggaaggagtaaggcctggcttctctgggatgatagccacaatgccggagaagaaggaggaggcagagaagacagagaaggcaaagctggatggcaccaactgctcaaggactcggggcctcacctccttcgggccccacctggtgcttgtctggcttttggtttccatgaccccaaacaggaggcgcttccagtttgccccagtgctgaaggtaccccttgagcagtatgtggagaacaagccagaactttggggccacacccgttcaggtggtggtgatgcgagtgatgagaatggagatggtgctgaaggagaggatgatggcagcgggagtgacagttctgatggcgaggaggctactgaaaaggagataggagacaaggggctcagggatggatccttcagtccaaatgggagaggtggtttttgtttggggagaataatgctttcaaaaccccatgtaaccctgggcaggggttgaacggagtcttcctcacttggccctggctccccccaccacagccccacctggatccagggtcaggaaggaggccttaggtagagagaagcgtccccctgccctcatttccttgctcccattatccgtgttgcagccctcagggcctgtggcagctttctctgtaaacaatatctcccttcctcaggccaattaaataagcactataataaaggcaaaggcaaatgcaaagcactgggcagccctgtgtaaagggct

SEQ ID NO: 468026 - DNA, 792 bp, Homo sapiens
atagacagctttcatgagctgtttggcttacgaagggcatttccaagtattttcttggtattcaattaatttttgttctactttggttagcagttttataaaccagtcagtcctttcattacagttccaggaattctcacccagtctaaatgatatgattatgaagttgtcagaaacctgtattcaaaagtgcttttcagggtcttttccatcctttcctgaacttcctaaaatacatcatattataggcttttgtgtacttgtgtggagcccaggacaccagacagaagtccacataacatctgactctttccagcataatcagggggaatggctaactccatatgtccccaggcctcacctagaatctaatggctccaaagcagccacatgtactgtaaaggagcagacaagatggcactaatcaactagaaagcccatttgcataaaaacattagggtgggacgacagccttccccatgcactgtgacacaattggaaaaattggttattttatcaaggctttgactggaagggtatgcttccctttaaggagtcaacctgtacctgcagagctgataaaagccccatggggagaactggcctcataccttgtttacacagtcctaaatttccctagtgtgtgacaacaaaccccagggtacattgtcagggggtcctagactgttagaagttatgttaggtctcctcatgtgtgcatcaagagtggtaagaagacaaaatggagaaatacaattcggttgactgaaaataaaaaacaaaacttttttt

SEQ ID NO: 468027 - DNA, 578 bp, Homo sapiens
caaagatcaaagatagataaatccacaaagatgagggaaaaccattgcaaaaatgctgaaaattccaaaaaccagaatgcctcttctcctccaaatgattgcaactcttctccagcaagggcacaaaactggatggagaatgagattgacaaattgacagaagtaggcttcagaaggtgggtaataacaaactctgagctaaaggaggatgttctaacccaatgcaaggaagctaagaaccttgataaaagggagaatggaaccaagttggaaaacatacttcaggatattatccgggagaacttccctaacatagcaaaatgggccaatattcaaattcaggaaatacagaaaacaccactaagatactcctcaagaagagcaaccctaagatgcacaatcatcagattctccaaagttgaaacaaaggaaaaattattaagggcagccagagagaaaggtcaggttacctacaaagggagtcccatcagactaacagcagatctctctgcagaaaccctacaagccagaagagagtaggggctaatattcaacatttttaaagaaaaaaatttcaa

SEQ ID NO: 468028 - DNA, 552 bp, Homo sapiens
ggcatagaatagactcgaatgtaatggattgctatgtaattgattcgaatggaatggaatcgaatggaatgcaatccaatggaatggaatgcaatgcaatggaatggaatcgaatggaatgcagtggaagggaatggagtggaatcaagtggaatggaattgaatggaatggaattgaaaggaatggaatggaatcgaaaggaatggactggaatggaatggattcgaatggaatcgaatggaacaatatggaatggtaccgaatggaatggaatgcaatggaacggaatggaatggaagagaatggaatggaactgaatggaatggaatggaatggaaatggaatggagtgtaatggaataatatggaatggagtggaatggaatgcagtggacacaaatggaatggactggaatggaatggacacgaatggaatggactggagtggaatggacacgaatggaatggaagcgaatggaatggaatggaatggaatggaatggaatggaatggaatgaaatggaatggaatggaatgaaatggaatagaaag

SEQ ID NO: 468029 - DNA, 2857 bp, Homo sapiens
gactcgagtggaatggactggaatggaacggactcgaatggaatggactggaatggaatggattgaacggaatggactggagaggaatggactcgaatggaaaggaaacgagtggaatggaacggaatggaatggcttgaaatggataagaagtgaaaagaattacggaatggaatcgaatggaatggaatcgaatggattggaacgaaatcgaatggaacggaatagaatagactcgaatgtaatggattgctatgtaattgattcgaatggaatggaatcgaatggaatgcaatccaatggaatggaatgcaatgcaatggaatggaatcgaatggaatgcagtggaagggaatggagtggaatcaagtggaatggaatggaattgaaaggaatggaatggaatcgaatggaatggactagaatggaatggattcgaatggaatcgaatggaacaatatggaatggtaccgaatggaatggaatcgaaaggaatagaatggaatggatctatggaatggaatcgaatggaatggaatcgaatggattggaacgaaatcgaatggaacggattagaatagactcgaataatggaatggagtgtaatggaataatatggaatggagtggaatggaatgcagtggacacaaatggaatggactggaatggaatggacacgaatggaatggactggagtggaatggacacgaatggaatggaagcgaatggaatggaatggaatcaaatggaatggaatggaatggaatggaagggagtggactcaaatggaatgaaatcgagtggaatggaatcaaatggaatggaatggaatggaaatgaaagtaatagaatggaatggagtaatggaatggatcgttatggaaagacatcgaatggaatggaattgactcgaatggaatggactggaatggaacggactcgaatggaatggactggaatggaatggattgaacggaatggactggagaggaatggactcgaatggaaaggaaacgagtggaatggaatggaatggaatggcttgaaatggataagaaatgaaaagaattatggaatggaatcgaatggaatgggatcgaatggattggaacgaaatcgaatggaacggaatagaatagactcgaatgtaatggattgctatgtaattgattcgaatggaatggaatcgaatggaatgcaatccaatggaatggaatgcaatacaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatgcaacggaatggaatggaacagaatggaatggaactgaatggaatggaatggaatggaatggagtggacacaaatggaatgaaaccgagtggaatggaatcaaatggaatggaattgaatggaaattaaagtcatagaatggaatgtagtgtaatggaataatatggaatggagtggaatggaattcagtggacacaaatggaatggactggaatgcaatggacacgaatggaatagactggagtggaatggacacgaatggaatggaagcgaatggaatggaatggaatgaaatggaatggaatggaatgaaatggaatggaaaggaatagaatggaatggaatcagttggagtagaatggaatggaatggagattaatggaattgaatggagactaatggaatagaatcaaatggaatgtcatcgaatggaatggactcgaatggaatgtgctcgaatggaacggaatcgaatggattgacatcaaatggaatggaatggaagggaatggaatgtaatggaatggaaccaaatgtaatggacttgaatggaatggaatcatatagaatggactcaaaagcaatggtctcgaattgaatttatagatatagaatggaatccaatggaatgcaactgtatggaatggaatagaatggaatggaatcaaatggaatggaccagaatgcagtggactggaataaaacggactcaatagtaatggattgcaatgtaattgattcgatttcgaatggaatcgcatggaatgtaatcgaatggaatggaatggaaggcaatagagttgaatagaatggaatgcaatgaaatggaacgaagtggaatcgagtggaatggaatcgaatggagtgaaatggaatggaatggacgcgaaaggaatggactggaacaaaatgaaatcgaacggtaggaatcgtacagaacggacagaaatggaacggcatggaatgcactcgaatggaaaggagtccaatggaagggaatcgaatggaatgaaatagaatggaatggaatcgaaaggaatagaatggaatggatcattatggaaagacatcgaatggaatggaattgactcgagtggaatggactggaatggaacggactcgaatggaatggactggaagggaatggattgaacggaatggactggagaggaatggactcgaatggaaaggaaacgagtggaatggaatggaatggaatggcttgaaatggataagaaatgaaaagaatgtaatggaatcggatggaatggaattgaatgtattggagtcgagtagaacagaattgaatggaatggcatcaaatggaatggaaacgaaaggaatggaattgaatggactcaaatgttatggaatcaaagggaatggactcaaatagaatggactcaaaagaaatggtcttgaatggaacttattcgaatataatttaatc

SEQ ID NO: 468030 - DNA, 641 bp, Homo sapiens
gtgaagagaactcagagctaaaaataagggtgatgggtgtctgaaacgatacttagataatctcttcaaagaagcttgggagaaaaaagatgaggaaactgaggcaccaagccccttccactcatgttgacccggatgttgagatcttacacaattgtgagagaaactgggggaataaaggttggaaagggctcgttggaagatcggagtcgcaaaccggacaatctgagaagctgagcatgtccagccaccacagagggactgtgcgggaggagctggtggtagaggaatatatagggggttggtgcctctgtgggtctgcatggaagcttctggtgacagggctggagcagctgctcttcagcaggacccgccctcaggaggaggctgtggacaaaacctggaggacagccaggcagctggagtcagggacacttttgtgtcgtcattgcatcacattgccctggccttctgagaggaatggtggttgtttcctttctccctccaacatggtgtgcaaactcctctttggtgctcaaaatcacaaccataacatgaaggggttttcgtgaaatgttctggcttaagcaacttgatacggaataaatcacctcaagtttagagcctgaaatagcaacagc

SEQ ID NO: 468031 - DNA, 621 bp, Homo sapiens
ggcttgccaatcagctgactgcagcagcagcagcagcagcagcagcagcagtgatgcacagatctgatctgcgttggcaatatacttgtaattcggacatgcatctccaggacaccagccttagcaggaaggggagccaatcaaggggaaacaattatgcaaatttaaaatgtaaactctctggagcccctgccacaacctgctcagtactccccaaactgatctccaattctgtgaaaaatcacagccctgccttcatcttattgctcagcgtgctgctgctgagagttgctgcagaaggaaccctgatccggcagcttagctggatggatctctataagaatcatgatgtttccaaggcagcacatggtttggggaaattggagagaatactcccgatggaaagggataacatcacagctgccacaacaatgctatccagtgagcaaatgtcggatgttcagagggaccaagtcatcttgattagaatcgtggaggtatgagtttcaaagtggaataatctcatatttaataaatttgcaatctcttcacagtgcactggaaaagggaacatgcttaaaataattccagggacttggctcctgggcttattcagatatc

SEQ ID NO: 468032 - DNA, 626 bp, Homo sapiens
attgttttatgagtctatcacagattatgacggacatggaacatggaaaccagtttctaccaaagcctgtgaggaccattctgtacaaattgggagagagtgcacagaagcctggagagctgaccggggaggagggccacagtgcattgcgtccagccctcttccacccttgcactcttagctgctctcatccccgtctgctcacaccttgcttacaggaaactgaggctcaggggcaatcagataagaactggcatgtgaaagcatccagatttgggtatgtgtcttttaattccaagtctcttgttttctccactccactggagggaataattgtctctggggcagaacttcaagaaacatggggtgcctgggcacaggaaaaatcccctggtaagggagagggcacagaaaagggagatggggaaactcaaatcacatgtttttcctttactgctatttctggggctacatccagctggaacaaaaggacattgaggcagtcccaggtggaggcaatagacgacttccagcttctccctgcttgtcccgagccctttggccaatgcttcaaagtcagctgagcagaccgaagaccaatcacttctaactctctggaaagtgcc

SEQ ID NO: 468033 - DNA, 1256 bp, Homo sapiens
ggcatatgaagactgacgcagattggacttcttaagttcatgcagcattatgggtggtagcagagttgtgctgtggggaccaggactgggagttgtgtcaggtgagaaaggactgcagcgagtcacgcagctgcaagtcaaggaatgccagcagccaccagggctgaagcggcaaggaacgggttctcccctggagcctctggagggaggctggccctgccaacaccttgatctgcaacttctttccagcttccagaactgtgagagaagaagttctgttgttctaagccatcaacttgtggtaatttggtatagcagccataggaaaccctatgcaaacagtgaacttgatgtgtatgagcctgtggaggacacgtttctgcttctggacgtactccaggtagcggctgccgagctggcgggagtggaaatatgcctggaaataggggcaggatgtggtcaaatgtttgctaccaatattgaaggaaaagttgatcttctggtgtttaatcccctctatgtagtgactccacctgaagaggtaggaagtcatggaatagaggcagcttgggctgctggcagaaatggtcaggaagtcatgcacaggtttttcccccttgttccagatctcctttcaccaaaaggattattctatttagttaccattaaagaaaacaacccagaagacatttggaaaataatgaagacaaaaggtctgcaaggaaccactgcactttccagacaagcaggccaagaaactttcagtcctcaagttcaccaagttctagcatacaatgtgtgcccagtgctactggaaactgaatgcatttagcatatcttgaaactgaagtcattcattaggtaaaaaggaattttatcagaaatttgtcattaaaaaaaaggtagaaaggtggaacattccctttcactcaggcctatagaattatttgcacaagtataagtaaatatgtatcttatatttataatttgcattttaaatataaaagttatgtatgaaatatttatttcagcattatttagtaaggcaacagaattgatctggcaaatgtcttttttttcataccagtccataaaggcagtttgctttcagatggcagggccagcaatacaccttcattgttgtatctccggtgtatatcaactctccaactctatgtcataatttagttcatagagatcttgattgcctttcccttccacaaaatattacactgattggttatattaatgacatt

SEQ ID NO: 468034 - DNA, 464 bp, Homo sapiens
ccctgttcatgcctggctgtgcattctctgtagcagaagttccagagttatctgccgatggctgcaaatccacagacaggtttttcacaactcagagagaaactcacagatcagtggagagaaaaaatgtatataattacaaattttacaaatgatgttaagcgtgctgaagagaaagaacaaggttctatgagaaagttttataaagagaacaagttttatattgaaagatgtgtcaacagtgaccagaacgtcaaaggcctggccacagatggagcttactcattccaggcatgggatgtagacaagactgtccagagcttctgctacaaaaagcctctaaaaccacatggttccaaagtccatttctgttatttacaggcaaagaattctaaatgggacagtgctttttgctgatagtacatctaaaactgaagttcttaatctgaggtccagagacttgg

SEQ ID NO: 468035 - DNA, 791 bp, Homo sapiens
cggcaccaggtacagctgaaggaagagatcttgtactaaaaatatgggctccactgcaggtctgttggattttgctggaggtccactccagaccctgtttgcctttgtatcaccagtggaggctgcagaacagcaagtattgcagaacagcaaaaattgctgcctgatccttcgtatagaagcttcatcccagaggggcagccgcctatatgaggtgtctgtcagcccctactgggacgtctcgccttctgtgggctgcacgcactgtccacccactgtccaaccagtcccaatgagatgtaccaggtacctcagttgtaaatgcagaaatcacccgtcttctgcatcagtcacactgggagctgcagactggagctgttcctattcggccatcttggaacccaaagcccagactttttatcagagcaaaagtgtttggtttttacaactttcaatttaatttttccattcatggattgtgcttttcctgtcacatctaagaattctttgcctagctctaggtcccacagcttttatcctatgttttcaccctaaaagtttcatagttttacatttaagttcatgatccatttttgtataattaattttataatttattaattacaaaaaaagataatttttatagaaagttgctattaatttccttcttagcactgctttagcttggaaccagaagggtccctttttttttaagtgatttaatcgttttatttattttattgattctcttcaaggatcttcatttcattttattaaattttctggatttc

SEQ ID NO: 468036 - DNA, 517 bp, Homo sapiens
cggcaccaggtacagctgaaggaagagatcttgtactaaaaatatgggctccactgcaggtctgttggattttgctggaggtccactccagaccctgtttgcctttgtatcaccagtggaggctgcagaacagcaagtattgcagaacagcaaaaattgctgcctgatccttcgtatagaagcttcatcccagaggggcagccgcctatatgaggtgtctgtcagcccctactgggacgtgattgtgggctatcatctagcatctgggccaatgtctgacccttggtgggttctcagtgaattctgtggaacgaatgatgagccagtaaacaacatttgggaagtcaacgcatctgagctcctcttatttagcagaggtcttggtcatcagttgtcagcagtaaatatcaaaacaagtgtggttcattgcaaaccacaccttggtcctttggcattttgtttttcctttccttggcaggcaagggaggaaaacgtgtccatctgaattaagtacagc

SEQ ID NO: 468037 - DNA, 790 bp, Homo sapiens
gtaacccaatgtattgtgaatgggaatggaaaatggtacagccattttggaagacaatttttctgttcatcaaaaagttattaaagttactataagatccaacaattccactcctagtctctatctgctgcagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaagagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagtacaggaaacaatgagcagttcatggaatagggagtttagtggagtgttggaaggtgaggctggaaaaagacttagtcatgactgtgagccaaacagaagtacaatgcctcccttgccaccttcgacatttcaagccaaagaaatgacaagtcctttggttagtgatgatgatgtattcccactggtgagttgctggttgtgggctttttttttctttaatgggttattgctttactcttacactgatgtcaataaactgac

SEQ ID NO: 468038 - DNA, 513 bp, Homo sapiens
atgaatttaatgcgcacccacatccctccgtccaggtcccatctgaattttataaaaccattatgctgtttcttgacaaattgagcttcatagatgaattatcagaagaagctgaaatagaagcccacgagggtgaaagtcagggatttccaaaaacaatcttggaagtcgaaagcaccgggtacttcagaatgaatgaaaaaagaaatccaggaccagacaaattcacagctgaattttcccagaggtaccagctcttctttggacatctggcagaatttggctgtgaatcctggtccagggatttttttgaaagacaatcttcaagctattttggctgtcagcgcctgcattgttttgtcatgatttttggcttccttgcattgggttatgacatgctgctttacctcagcaaaattcatttcatttttttaatctacactctgaagcctacttctgtcacttcagccatttcattctcaggccagttctgaacctttgctggagaggtat

SEQ ID NO: 468039 - DNA, 1930 bp, Homo sapiens
gatgtgataacagcaggatcttgagatgggggaatcatcatggattatggattttcactgcaaacgttaccgttctccatacctgctgacacagaaaattccctgtacatagttgcagaaaagtacaggaaagccctgctgggacacaggggaatgtccataactctgcctctggagagtggaagtgacctgcaaggactggttcccacggatgcatggtatgacacaacacccaacaagaatgagtacacctattacggctacaagagaaacaccccgaccaaggaatgcttcaccaccaccgtggcttttcttgcctcggtatttcctgaccaaggaatacttcactgcccctgtgatttttcttaccttggtcctgaccaagaaatacttcacctcctctgtggcttttcttaccttggtcccaaccaccaaggaaatactttgccgcttttgctacgtttgttacattggtctgtgcacagagttacctggtcaccacggtacatgaaaatcctttcccaagctgctggcctgtttcttcctgcgttgctgagtccgggtttatccatcacactgggtgggtctcaattccttacccctgaggccactgcaatgaggcaactgggtgcgcctcctcacgggagaggtctagaccctccccagaggagaatgggaattctggatgggcccccaaatttgtcagaaataaattttcagtgccacgaaagaaatagcattcgaacattaattttctcagcaaggcaattttacttctatagaagggtgtgtctcacgggtgaagcaatggcaagagcatctctaatatcctttatgtagcaccggtgatgagaaatttgagagggatagcaggaagctgggactcagagtacagtaagatcagcattgaatctgggctaaagttattcaagtagtgggataggagaagagtgaaaggaacgtctgattcagaatcaggacacctttttgttaacagtatgatcactggttagataatcacaaatgaaacgtaaagaaatactctatacagaaagtctgttagcttttctcaatctcgattttctcacctttacagtgggaataactaataatgctgacatttacccccagagttgttataaatgttcaatgagaaaatgcatataaaattgctttgtgaatcagttcaaagtcatgtacttccctaagagagacaggacagtaaaatgcatcaatttttaggatgggaatgatgaccacttaaaactgacaggcaaattgcagatgtacttggaatgggaaataccagctgacaacgaagtcaagcatttttaaaacaatgtacatgaagaatataaagcccacattaagaaaattgaaaagctcgtaaaagaaatgttctgtgaagaatgatggcatcaccctgaatttcatgttttattgcatctctaagtattcttacagactatttattttagttaatctctaccatcataaagatgaaagaataaagtgtataatcgtttggtgcttacttttcagtgaatattataatgctagattcatccatattttttgcatttcattgtagtttcattcagtccaactgctatattctgttgctgaatataacaatgttctattatatgaatattcatctatttttctcttaatggacacctgtactgcttcaaagtttcaatatgtgaacaatgctgctatatgaatattctttcatattgtcagcctaaataacaaacaagaagaggctctctaaaagaaaatatgtttgtttgggaatatagtattgcaatgggaatacgtatgtcatagtgaacaatgtgtatattcagggaggtaaaggaagacaaaggtttttaaagggaaaaaatgaggaagattacataactgttttgaaataattattctt

SEQ ID NO: 468040 - DNA, 597 bp, Homo sapiens
agccatgccaccatctccactcagatggattctaacaacagctttatcacgagcggcttaggcctgccctgtggagcatccctgtggggcactctggccagcttgagtgatgcggatcctgagagtgctcctaggtaggcaattgccccagtggaatgcctcaccagagcagtgcgtggcaggcccccatgaaggatcaatgcagtggctgaacaccaggaaggaactggcacttagagtccggacatctgaaacttgggaggaaacagcgttccttggagacctgaagggattcagtgagcttaagaattttcaagagcttatcaatcagtcagcccttgttcatccccgagtggatgtgtggtggtattgtggtggacctttactgggccctctgccgaataagtggagtggcacttatactttagtccaattggctatccctttcaccctggcatttcatcaaccagagggagaaaaaataagacatcataaagcgagagaagtcccttacgggtctttcgactctcacgtctatttagacgcaattggagtcccatggggaataccaggtcaatttacagcttgaaatcaaat

SEQ ID NO: 468041 - DNA, 649 bp, Homo sapiens
tctccgggtatggtttttccgactctcccctcttctcagtctggtggtcctcttcaactgccagaagttaatgcagatggtgaactgctccctttacctcgggtagctgacccccctactagtcctctttctgatgatgaagaagaattcgatctctccttgttttctccccaagaggaggaacctggtgatgatcccctccctccgcctcctatcatggaaactgtatatgttaactcttcttctactaagctgttgccccctctgccagaggaggacatgcggcattcttctgaatggtctgtttctcgttcctcttgtccttttggacctctccccttttctaagcccactgtttcttttgatgctccgggaccccttctttcagaggcttggaaccctgcttcccctcagtccgcatcccagcgccctcactctccttctcttcctctgtccctgcacaatggatgcgtgagtcacctgtttaggtagagcagtggccactgtccaaacacaagttggaggctttaattgaaattgttaatgatttactacaagcaaacactactgagccctcattgtcttcatggaactctcctgtgtttgttgtacaaaaaaagtcaggaaaatggaggatggtaacagactt

SEQ ID NO: 468042 - DNA, 1063 bp, Homo sapiens
atagtaggggtccagcaaagaacgtggcgctaatgatagctaagaaagaatcatctgacccaaaatgtcagtagtgttgctgtggagaaaccctgcattatatcctgaagataatgccacagaagtacagagatactcttccagctttggtggacagtctttcttaacccagaacaatagtgctttgaaacaccatggcagcccggtgacagagctggggagccttcagaggacaatgatccccccaggcaaagagaagactatcaaagagccactaaaggcggccatcctgggatggcacatgaggaactgggaaaaacccactaagatacctttggcctggtgtggccacagagcccttgacaaattctacctcatgtgcaccgaggagaagcattcctgccaccactgctgggaaagccgtggtaagtgtgagagaggcctggattggcaggggctggtgaggtggtcaggccctaagatagctcagcagacagagtaatgacttcctgatggcaataccaatgacatacaagtatgtactttggaaactcttagttcccacttcataaaaaggtcatgactctggagacacagagtgacttgaatactttagacaagaaaatctcttggcacccttcattaacttccttatcttggccctaccaaaaggtgcctcaaagttcacctaattctctaactaattctaaacagccctggagataagcctaactgtatactagccacaaataaaataaacaaaaacaggactcaaagagtgtgtacattcaaagtcttgtaatacatgtttccatattaacttgaaaaaaatgaatgcatgtcagtcacctggatttaaaactgtgaatcactgtgaccttagtacttagcatctagaactgctcctagcctatggtgtgaactctaaagatatttgtggaacaaacgctgttaaatgatttctcatctggttctaataaaattctaaagtaaaagtatcattgataatttttgttgttgtttttaacatgaatcagttttgtgctttggagatccagcatat

SEQ ID NO: 468043 - DNA, 527 bp, Homo sapiens
gacaaggaggtgattttgtgcacgatgaagacattgagagttgtgactgtgacagatggtggtccctctccaaaacagtcaaccatttgggtggtggttcaggttctagatgaaaatgacaacaagccccagttcccagagaaggtctaccagatcaagctgccagaacgtgaccgaaagaagagaggagaaccgatttacagggcttttgcatttgatagagatgagggccccaacgcagaaatctcctacagtattgtggatgggaatgatgacggaaagttctttattgaccctaaaactgggatggtttcttctagaaagcagtttacagcaggcagttatgacatcctaacggtaagatcttccaaactccagcagcacagcagatggggggaagtggttatgttcttattcaagtatactcctttgagcaataaatctttagagtaaaaagtgaagccacacagctgtggaagggttctttctgggaggcaagtgcaggtctgtcctttattattttaaac

SEQ ID NO: 468044 - DNA, 927 bp, Homo sapiens
ccaccatcacacaccaccatcacaccaccaccaccacatcacaccaccacatcacaccaccaccatcaccaccaccaccaccatcacaccaccaccatcacaccatcacaccaccaccaacaccactatcacaccaccaccatcaccaccaccatcacaccactatcacaccaccaccaccatcacaccaccatcacaccaccaccatcaccaccaccaccactaccaccatcaccaccaccaccatcaccaccaccaccaccaacaccatcaccaacaccatcacactaccatcatcaccaccaccatcacaccaccaccatcaccaccatcatcacaccaccaccatcaccactccttaaggtaatgacagggcttggtttcttacaacacctctctccttggcttgtacagacagctgtcttttccctctctcttcaaatggccttccctctgtacatatctgtgtccaaatttcctcttcttataaggacattagtcagccatattggattagggctcttcccagtgacctcattttcatttaatgacctctttaaagactcttctttccaaatccagtcacattctgagttactggaggttaggattttaacacatggattttggtggtgggaggtggtgcacaattcagcccataatacgtgctttgcagttactcctctgctgagtccaagctggtacccaccatgtggacacagcatcctctcagatgggcttggtcttggagctcagggcacagcccagcagcagagtgagccttgtccagagctgggtggatggggcaggccagagtatcgggctctgaggattagctgagggggtggtggatggacaaccagagtatgagagaaaacctgctcttcagatgcatagagactgatccttgaggctgggttaacttga

SEQ ID NO: 468045 - DNA, 997 bp, Homo sapiens
gggaacgctgttcacatgttttcacttgccctgataggaagaactactactgcagctgacacagtgtatggagaggtgggggacaaaatattacccaatctccacatcacttcctagtcatcgatgggaccccttttgcagttggtgcctcacctgcatttcctttgcccccggaggggctttgccaggccgtgttcttcaccaagggttagatctccaggagactcacaacttcctgggctccacaagttccctgtgcttgccaaaatcagagtgggttgtggggtatgtttgtgagtgttccggtggtgcagtagttcaagagcagaggatccccaggaaggagagttgcaccacggttacccaactggtatggagaagttctctgattgctactgatagtgctaccatggattgcaagggcagaggggcacccaacagtttagtagtcagcagcttggcagagggttccgggaggggagaagcactcccacctaccctttctgctgggctttgagtgtattaggggtcagtctagacttttgctgcttttttttctataccccagcttctttccatgggtgctctgatggatcctggctctcttctctccatcttctgtttaaaacttggccatgcactggtatctttgatctaatttctgaggagaaccagtatgtatgtccctagtctgctatgccatgttaaaaaaaaaaaagatataaccactttggaaaacattttggcagtatttaaaaaaatacacttcagcaatcatactccttggaattcatccaaataaattgaaaacgtatgtccacagaaaacatgcattagaatgtttctagaagctttattcataattgctaaagtgtcctttagttggtgagtggataaataaattgtagtacattcagacaatggaatattatttagcagtagcaagaaagctatcaagccaagaaaagaactggaggaaacttgatggcttatcact

SEQ ID NO: 468046 - DNA, 742 bp, Homo sapiens
atattctttgactacaccaacatgcaggtttgttatgatgtggagacaacatttaataaacaggatccgtgcaattggctggagctaacatatactgtcaatttctatagtgaagaagaaccggacaagactttggctttgttttggttgtcttctaccgtggtcaaggagtccaaggaaccacaaggttacgggtactcagtgtgcatgcctgcctttctagactatgctctgatcacccaggtctggaattctgccacgtgctccaaatacacttccaagtctcccgactgggagcggcaatggtcacctcactggatcaggagcacagcggacaccctgctggatccagagggatggaagtcagcagcgggcctgcaatggcagcaaatagcagtggtggatggcgagcaaaagctcagcttgagccgtaacaaacacggaccagaagagtgtgcagttgcaagatttaatagagtgaaaacagagctcccatacaaagggaggggacccaaaggaggtttgtcctctgctactgtttatggggagctgcctgttcctttggcagaacctcctgatgtctttcggccactatacctgtactgagcaggtatacctgtactgagcaggagatttctaagacaaaactcagatgtcatgtaattttacccataaatagttcaggaagtatttagaaaacattatgtaaagtaaaatttggaaaaaagtataaaccattatg

SEQ ID NO: 468047 - DNA, 789 bp, Homo sapiens
ctgactggtacagtgagggctactatggtgggaaaggccaattggaagccatcagaactgcctctacctagaaaaatggcccaccagaagctctttgccatcagctggcaaggccagcaatatgccattacagtcctccctcaggggtatatcaactctccagctttgcatcatagtttatttggaaagaccctgatcgctttttgcttctgtgagggatcagttgctgcatttggcctctcctacaaccaagaaagaggcacaacccctggtgggcctatttggatttttgaggcaacacattcctcatttgggtgtgataatatggcccgcttaatgaacaactactgtctttttgagaggcagctcttggcttgttattgggcttcggtggaaactgaatgtctgactatgggtcatcaagtcaccatgagacctgaactgcctgtcatgaactgggtgctttctgaccaatccagccataaagttgggagtgctctggagcattccatcatcaaatggaagtggtatatacatgactgggcttgagcaggtcctgaaggcacaaaaagtacaggtatgcagataaattaaaaacaattaaggtaaataaaagcaaactaaaccaaattataagacctattcgcagctgccaaagttaaattatctcttaatgttttggtttctgattaaatttacaaacttatgtatatatgcacacagataatgttacatatataagtatatgtaatgtatgtcatatattacatatttgtgcacatatgtgtg

SEQ ID NO: 468048 - DNA, 522 bp, Homo sapiens
acctgggaagtggaggttgcaatgagccgagatggtgccattgcaccacagtctgggcaacaaatattatattcttttgatgttattgcaaatggaattgctttcataattttgttttcatattgttcattgttaatatgtagaaacacaattttttattataatactttaagttctagggtacatgtgcacaatgtgcaggtttgttacatagatatagtattcctcattgataatttttttcttaccacttgcgatatatcatttcactaccttcggacctccaaggtttttgatggaaaatctgctcatgatggtattgagaattcttttcatgtgaagtcacttctgtcttgctgctttcaagattttgtgtttgcttttgtcattgaaaaactttattattttttaaataataataatagctacgattaaggctttacaaaatatcacaaattttttcatactctctccatatattacctcatctaatactataattctcttagaaagaaattatgt

SEQ ID NO: 468049 - DNA, 783 bp, Homo sapiens
tctggaactgcagctggctggcttcagctgtacccgggagcatggggctcccatcccaccaactcaggacatggtacaaaccgctggtggatttactattctgggatctggaggatggtggccctgatctcaatgctccactagaccgtgccccagtggggactctgtggggctccaaccccacatttctactctgcactgccctagtagatgttctcaatgtgggctccactcctgcagcagagttttgcttagacatccagggatttcctgcatcctctgaattgagagagaaggagtgccaccaggggaaatgccagatacttataaaaccatcagaattcatgagaactaatttactatcagagaaccgcatgggggaaaatgcccccatgattcaattacctccacctggtccttcccttgacacaaggaaattcttacaattcaagcattcttctgtgtccaaactgctgttaaatgtacacattatgatattaatttcagataaatcggaagattttaataactctaatttagcagaagctgaattaaaatagcattaaattggaaacgtataattctcctctgacataaggacattttaagcactgattagattttgccaacaggataatattttcaatgctacttcctttcacatggaaatatgcaaatatttcagcccaaatgttttcatggatactgaattttgccttcatgtaaaattccttttacatagattttcataagacaaaactcatcaaataagtactatttatg

SEQ ID NO: 468050 - DNA, 534 bp, Homo sapiens
cgaattaatgagagcagcaaaccaacatggcacggctggcccgggaagagtgtgacctatctcccaaccaagtcctgtgctcaaaggggccctgcagccaggaacacatgaaaaagaaatacagtcatagcgccagtgatcagagaagctctcccaaggcccaggagcaaactagtggaagacaatctcttaactcacacccgcagattacagctgtgaatgtgtggaagtacaaaatgattgagtacagcatggtcgagtacaaacctatgtgtcagcgattactcttaagcactgtccactggattgccaagtcagaatctggatggcaagaaagctcattgattccaaaaaatgttgaaacccagtccaagatatccaaggaattcagtaaaatgatccaagagctgaaagatgaaatgcacattttaagaaagagtcaaactaaacttctggaactgaaaaattcactgcaataattttataatacaattgaaagtattaacagcagaatagataagctaaggaaaaaaa

SEQ ID NO: 468051 - DNA, 1454 bp, Homo sapiens
tatacacatgccatggtggcttgctgcatccaccaacccatcatctatattagaaaaagcacatggagtactgggctgtcccttgtgtgctgtgatagtcagtgtaggactttcactcttgcagccgccgccaaattcctggatggccactcttcgtcctgctctgtttcaatcaccttgcaactggttgttaaaatgccctgctcactctgcttgagctctgaactccactgtcgacgactggcattgaagatgttcttttctgaggcagccttttcaccacattcaggcctttactttgaataccaggctgacacagttgccatcgcttcctcaaacagggtccatcttcactttaatacagctccaaacctcacccaacctgctgccttccctcctccatatggagagccaccatactcgacacccctaaggaataccttttagactgactttttcaggaaaagaggaaagaattaaggaaaaaaagaagatagcaaggtacagaaggaaggagggataggggaagaagatagtatgtttattttaaaaacattagcctagtcagttgctttaaacactcatgtaaacatttaagtcatattgaccaaagagctctgaagctaaaaataactacaatactctctcaagtacactgagtgtttattccatccattttccaaagaggtcctgaagtagtctctttgaatatttattctacatctccaataacacattaagatctgtaaaaaaatcttctttgtatccgtacaacctaacagagatacatcaaatacatgaagaagaagaaaaggagtacacagtattgttaagtagaaagaacactcaaacaatattatataaagttatttattgtgtcattgaacaagaaaatgtgaaaccacaaaaccactggaagggcagggatgtggtcacattctgacactatccataagcaaggattcaactgttgctgcatattttacctccattttcatatttccagctctcttcattttggcattaaatttttcttactaaagacaggttctttttcacatctcagaaaacctatattcctgaattattttttccatccaagaacccaaaccacaaagaagagaactcttaaactcattttctaatttgaaaaattaaaaggctaattgctccagctagattcaggtaattatttctgaccactgtggcctaggttttacaaacagattggcctctaaattaataagataaacaaagaaaacagaagttcccagaagaatacataggggtggatgcagaacaatcatttaaacctaaaagaccccaggacagaaagggatatctcatttccaaatgaggggcaaaaaataaagctctatgtaaacgtagaaggtgaagccaaacattaggttggaccactggacagaatcaatattttagctattattttctgc

SEQ ID NO: 468052 - DNA, 873 bp, Homo sapiens
ttatatcccgcgcctggctcggagggtcctacgcccacggagcctcactcactgccagcacagcagtctgagattgaactgcaaggtggcagtgaggctgggggaggagtgcctgccattgctgagccttgaataggtaaacaaagcggctgggaagctcgaactgggtggagcccagtgcagctcaaggaggcctgcctgtgtctgtagactccacctctgggggcaggacatagctgaaaaaaaggttgcagaaacttctgcagacttaaacgtccctgtctgacagctttgaagagagtactggttctcccagcagggagtttgagatctgagaacggacagactgcctcctcaagtgggtccccccaagtagcctaactgggaggcacctcccagtaggcgccaactgacacctcatatggccggatgcccctctgagacaaagcttccagaggaagaatcaggcagcaacatgtgccattctgcaatattcactgttctgcagcctccactggtggtgatacctaggcaaacagggtctcaagtggacctccagcaaactccaacagacctgcagttgagggtcctaactgttagaaggaaaactaaaaaacagaaaggacatccacaccaaaaccccatcttaataacaaacttctccaagctaaaggaggatgttcgaacccatcgcaaagaagctaaaaaccttgaaaaaagattagacgaatggctaactagaataaacagcatagagaagaccttaaacgacctgatggagctgaaaaccatggcacaagaactacgtgacacatgcacaagcttcagcagctgatttcatcaagtggaagaaagggtatcagtgattgaaga

SEQ ID NO: 468053 - DNA, 571 bp, Homo sapiens
ttccctatttaataaatgaagggtgcatctcacagatggagcaatggcaagagcacacctgaacaaagaaggagaagggggtcttatccctgatgcagcgcgagacaacgaacctcagttatttccccagacagacaacaccacttcattgtggggactcgcccaggatcagaatcagaacagaaggtatattcatcagaggggacctagccgtcgcgtggggctagaaaaggtcctgaagcaactgaagatttctcgccaggactacaccctggtgttatctgaaggcttctggactgaccccacctccaactgcccggctgggtgtccgcaacaggatctacagctgtcctatcgcaaaatttcctcatttcctatccgcaaaggccatctcatggttctgcaggcttggaagttcaaggacatggccaccctggcttctggtgagggtgtcataacatggcagacaaggtcaaaagagaagagaacaggtacaaagagagaaaacctgaagagcatctgggctttataacaacccactcttatgggaactaatccattcctgtgttgc

SEQ ID NO: 468054 - DNA, 650 bp, Homo sapiens
cagccagaggctctgatataataaagatgagctctgaagaggggctctctctccctcttgtattcagaagaactgaaagttttcataagtctctagagaagccaagaggctgtgctagccaaggggagaggcagggagggtcggcgctgaggtggtctccaggggcgtgcctgacggaggaggacctggcaacaagctcgggcatttcatttctgtgcatctccatatgccaacttgtctgccaggggcccgaattctgctggcagattgagtgcacgtgtttggcagcgactctgagctctaggaaagatttatgtcttcgtcctctggcactgcctagcgttagctcacttaaaacaactgaatatatgagttcactttatcctgtcaaagtagaacctagggcggcatggtacccagctggggtccacggggaccctgaggcaatgctcatgtctcagtcacttatgctgagctcagccatttttatgtctgtctgagatcattaaaatgaggagggaagggagcagaaagccctgtggaatgaatggtgtgatggaaacaccactagaatctagagggctccgccaaaaacatggatttaggggttcactttaaacgctgcatgtctcccatcgtcacccctccca

SEQ ID NO: 468055 - DNA, 544 bp, Homo sapiens
ctgccggggttgtgaatattaaataaaccctgactcatggagacatataccttgctttgctttgctgataggtggggtaacagacagcgttacgttactttagaagtgacagctctaacattctgcagacttctcaaaactgctctggctttttctgaacaaagaacaatccacaaaaacgcccatggtttgcaatgcataggagtctgtttacaggatcacagactcaggccctctcaaaagggaccgggtgagatcatccatttaatcaccttccacctccagagaattatttgctcatttggtaaacattacctcatccgcttcttcaccttcttcatcataaacatcatcatcaacttcaatagcttctccagtaaacaccggtaaacatactagatctaatcattacttggaactgttctacttctgaaatggtaaactctggttattaccaaagacttcttggttctttcttactcaatcctgtaacaacagctctttaatgtcatacatatctccttttctttaatttgtaattttt

SEQ ID NO: 468056 - DNA, 1320 bp, Homo sapiens
ctggctaggtcaaaaaggtttccttattagacaaacagtgcgggctgggggtggggggtgcattggtgtctaagcttagaaccgatagcttccagaaaaagaggcagagccagaggaaatacttcctgtggactttgattttcatggcagtatcaaaatgcgtgttttatatgtacatcagcaactagggatctatactcttcatatgtggtccacttcctggcccctttgtcaaggccaacgagagagtagagtttctgagcgttggactgttatcgaggcgctgaaccttgcactggctgttgtccggtttctctccaaaacctggttgagaccaccggtatttgaaaaagttggggcctgccctgatgtgcttactcacatgcactgtgacggttgtttttgtttgtttgttgccccagtgtatgcagctgtgctggtaattaagaacattctgtggttacgatggaggacaatcccatgtgacgcctttagcacagagaccagcatggagtcaaccctccatgcatactattactgcactggatctcccaacagtttaatgagccaggtggaagtgaggaaccaagacctgagtgtttatcctttggtagattgaaattttcaagcacatagtttaaagacaccaagagttctgcaagacttgataagaaacgcaacagccccctccatcactccccctctccccaccaattcttgctcctcaggactcccgcccccactcagctggccatttcccgagtataattagatcgtaattttcattagatcaacattcaatatttactttatcatgaatacataaacgctacccacagccaagtctgccaattttgcccctctcctttctagaagaatcttatatcgctcattcctgagtctttgaggcttctgagatataatgtaggatgttcctgtctgagttaggattgaactttctcaggcctgcttagacaggtccaacttattaatatggtacttgtcaaatgtgcttcctagcctccagaattgtgttgctcttatctcctttcccgtagtttttgaaacaggagtgtggagaccagtgaggcggctgacacggtcctctatgcaacatgtgacggtggcttccactaagctgtcactccccattcccactcccagccgtagacaactgctaatctattttctggaaatagaaggattctcatttccctatagatttgcctattttagatgtttcatacaaacagaatgatagagtatgtgctcctttgccactggcttctttgagttagtgtcatgtgtccaaggttcctt

SEQ ID NO: 468057 - DNA, 590 bp, Homo sapiens
aaatgcacatgtcttcccccagtctgtctctcctgtgccccacaatgcagtgcttgaatttcctcccactcagactcccagaaagtccactctatcctatgcaagctccacacccctccctccttatacatccaaggatgtcgggatggtgtggggggcagtcctgctcattcaaaactgggactcagctgcctgtccccagaggcagagaccgccacaaccgtcaccaaaggctgtttacttacctcagggacattctagccctgagcaaaatctgcatgtgtctgaactggaggtgggttggcaagtgcgtggaggtggtttggaacttctgtgggagcccagaaagtagctgccactgtcttctccattccccttccctgcctggtggtcgggtgtgcatcatttgctagaagcccacccagtggcctggaagcctggggacttggcctgcttgctggggagaatcttgctccactaagctgtatcttccacagtcctcagccctagtggaagtgtcttcagatttatatggtgctatttactggcgctctgccaattagtgacactttgaaattcccttatatgac

SEQ ID NO: 468058 - DNA, 682 bp, Homo sapiens
acacagacagctcacgtcttgatgtgtccagaggccctgggcctctctcagcctccagagctggtgggcccagctcctcctgggcagaggcctgagactctcaacgtgtccccaagcacaagcatgggaaaggccctgtgtcctaggcaaggtacttcagatttctgggcctctcctccaaaccatgatcatccaccatccttcagcccatggtcctcatcggaatcaaagggtgaccccagtggggccagcaaatgtcagtggagtttccccagcacagggctctgtgctgggcactgcggagacctgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagacaacaaatctgcgttgatcttggacttcccggcctccagaacagtgagaaataaatgtctgtggtttataagccgcccagtttatatatcttgttatagcagcccagctgggctaagacagatgcccagttaaatttgagtttcagaaaaataataactttttaatgctccaccatctccaaggtgcctggctcaggggccagggagggctgaaat

SEQ ID NO: 468059 - DNA, 2298 bp, Homo sapiens
gaggtctggggcagcccccctcacccacagcagcctgcatcttctactctgcccccagctggccccgcctgggcaaacacatggtgacagggcagtcgctggcccagagctgcttcattcctacttctcccttccttcaaggctggttctgggtcccggaaccatcctttcctggttcaggctgggtgcaggccgtccagcaccacctctctgactcaaggctggaattagtggggagagagggaagctgcctctctatcctgtccttggtggggataaaatggaaaaggatccctcctcgggccctgggacccacctggggcatgttcaggcctgaaactgttttggggcgggccccgggcctgagggatgcgggtggcgtgggacggggagaagcgggaactcccagtggctttcccttgtttgcagagtgcagtgtgacccatcagcttgacttccgggccctctgtaccctggcccaagcctctcttgccctctgagccccagagatcctctacatgaacctccctctctgcgccctacctccagcaccctctgacctccctgcctgaccccaggtggttctgctttctccccaaagcctccctcgactgtctgtgttcctcatcatcctttctcagtatctgcactgctactaccccagcgctccagcccctagctgtttgcatctgcatagcccaggcaacagacatgtgaccccagcccctcctatgtctgattgcagagatccagaaccattcagctaagccaggctcagtttcttgacctgcagaaactgtgagagctaagaaatgattcctgtaattttaagccactgagcttggaggtgatttgttatgcagaaattgacaaccagacagattttgcagaactagccagtcaactttcaaaggtactttgtgctcggaacattgagaggcactgtgctgtttgcaaaatgctttctatacacgttcatctttctctttaccagaaccctgaacactgctgctaaaatcctacccattctaccaagggagagttcggtagttactgaagtcttgttactgaagtcttgtgaagtcatcccagattttctgagttgaaatgaacacttcctcagtattgtgcttatatattcgagggcttcttttatcctgcctgggatggtagtgagttgtttatgtcttctccctcctttggcagtaaactccttgagggcacagagggcattttgctatttctgcatcttcccattgggtctgatacaatgcttttgcacatcgtaagcatttaataaagatgtgaaggataaacgagtgaatgtattaatgggaagcttctacccactgactgcactatgatttcaatgtaaatgcttctgggaagccgacctctagttccccaggtccagatccttgaacctgtctttattattagatgctgttgggttgtcggattcaacccccacccacattgtgagctccctgaaggcaggtccatgtctggggtgggccaggtgaggggtggaaaacatcgataccagtgacttacatgcacccaggtgccaagtcaataaataagtgggaaataaagtatttgcaagaaaatagaatgcagtcgaaagatgcccctaggggatccaggcagggacgaatgggtttcatttgttgagggggaggggttctgattatgcagcactaggcaagtctccagtgtggtataaaaaacatttgggtagccctagctttacaactagttagctgggtggccatggggaaggaacccaacccttctgagccatagtttcctaaaaacaaagaggtggtttgctgtggactgaatgtttgtgatggcctccggctgcagttaatatattgcaactctaacctccattgtgatgatgtgggaggctccagacacagtctggagaaataaatgcttgttgtttaagccacccagtctatagtatttgttatagcagcctgagctaagacattggtctggattatcttaaattttaaactttaaacttttggggacttactgaatgactcctttgagaatgtgaaaccactccccagaaatgtgcacatatattctgaatattgcgtccaagctttgtagggataaaaggccccacaccaaaaaccttggcatcatctgtgacccctctctttctctcatagtaactgtccactatctctgctgctgctattccagcctgagtccctcatctcttctctgtattactgcaagagcctcttaacagaggctcttgtcttcccttgtcctctt

SEQ ID NO: 468060 - DNA, 862 bp, Homo sapiens
ctcgccaagggccttatgagccatgcgatgtggtttgagccaccctttcggtactgtggcgcctctgtggattccagctgtggtgtgttgatcagcaacgtttggggatcacgtggaggatggcagagagctctgtcccagctccttcttgcaatgcagcagagcccccaagacacgaaagctcacagacaggcagccagacacaggcagatggcccttcatcaaggaattggccctcgtcatcctggagcaggagtcaatgcagctgactcacaaaggtttcaggacaaggacacaccggtgtctctagaagtatttgctgagcctggagagacagcggtgtgtgtggctgtgaacgtgggtgtgcgaatcgacaccctgcttttaatgtttctggatgtctactcagaagtggaactgctgcatcagatgtggctatcgtaatgggtgtgaggtgatacctcactatcatttcgatttgcaaatctctgatgattagtgatgtttaacatctttccatatgcttcttggccatttgtaaatcatctttggagaaatgtctattcaagtccttttcccattttttttaaatctggttatttgattttttattgctgtatttatgtatttctcttcagtactataataaacattctttaaattaccaaacaaacaagaaaactagagtagcaacatcaatcttcaatgcatcctttctcttcctctacccaaagtaactaagcactttctcgaatcttatgttcatcattgacttgctttcccttttttcaaacaaagttttactactgctacatatattttttttaaaaaaagaagaattttcagtttggatttattttaa

SEQ ID NO: 468061 - DNA, 513 bp, Homo sapiens
cagcgcccctctagttcacagccgtctccacagctcttacccaggaccccccccccccatatgaccacatttaaccttaatcgcctcctaaaagccctagctccaaatacagtcacattggagatgtctgtggcaaaaactgacacttgcacggagcatgatttgatagcaatatctgcgaagtgtcagaaaggggaggggatcaatacccttaatttacttggaataattcattgcctaactggagttttcagaacaatcaagtctttggtgatgattcactcagtcctgggagaacacaagaaaatcactactcagggcttctctggaaaccagcatagggtatgtgcttatggagccagtttaaaaatttggaatgattctcatcatgtggaagggtttaacgcaagtctggagcaaaagcctcggtggccatgtcagtctgattcctggcataaaataaggtgtgctcagatgagattctgaataacatttcataaggtgactctttat

SEQ ID NO: 468062 - DNA, 617 bp, Homo sapiens
acccccttaatgttagctctttggggtgccacacgggggaaaaactgtgctgtattttccatttataatcaaatgcactcaattagtccctcttcttcccacctgcatgcccaggcagtaatggcaaagaggcaagctgaagaaatggaaatcagcctgccctggcatctgtcccccagtttatatcatccgctccatcatttcagttatcatctgtgtgctgagatatccccagtctacatctccagaccaaacttgtcttcaatgttccagactcaaatatccacaggcacatcaaattcaacatgttctcagctgtaccgatcagcaagcctgaaagaacaaaaagaagagaggaaagcaagaaggaaagaaagaactcgctttttcatccctcaccttagatcaggtccctgtaggtgaaagtttaccacacaaattcccctctgacttatttctggtcagcagggagctaggagagatgagcgattgtttagaagaggttaatgagcccatgggctggctgtttcagaccattgtttctcaccctttctttgtgcctctcatccttctgcctgggaacacttctcatgtaaatctttctagtccatgaaatg

SEQ ID NO: 468063 - DNA, 637 bp, Homo sapiens
aggacaaagctttgcagtatggacatatgaggaagtggtccttgaaagatgcggcctcagttgcatgctcaccacaaattcaaaataattttggaattaggctggaatactttaggcccaagcatataattcaccctgggtttggcagtgctggtaacccagaattttttggaaagttgtcagagaagatttgggtttggtgtgacagacacaacaagctgaagagggcagccagaaggggaggagctgcagagatgcaaccatccaccctgtggtttcccattctcgtgctctgtttcttgccagccttggacttctaccatagcactcagactgagcttagtgtctgtgatgaggtcaggaaggaatgcaaggtcagcagaggcgccatctactcctggaagacttccctggccttcctttctggaacaagtgctccaagtcccggagaatctgagcacactgtattgtaacctcttgctgacatgtctgtctctctggtcagaacgtgagttactcaaacagcaggtcttgtcattctgcttaagtttctctgtgcctagcggagagcatcaaagctaaaatgaagtcttcctctaagacctagtactgaaccttgagttcttgaaacgtcagg

SEQ ID NO: 468064 - DNA, 602 bp, Homo sapiens
acatctttgatactttctttaagtactcctccccatgtggccacataagttgaaaactacttttctccttgataacaccacttccttcctatatatcctttccaataacatgaagaagaagaggaagaaggaggagaggaagaagaagaagaagaagaagaagaagaagaagaagaagaagaagaagaagaagaagaagaagaagaagaagaagaagaagaaaaagaaaaagaagaagaagaaggggaggaggaggaagaggaagaaaaaggagaaaaaggagaagaaggaggaggagggggaggagggggaggagggggaagaagagaaggaggaggagggggaagaggagggggagggggaaggagaaagagaaggagaaatagaagaagaagaaatagaagaagcagcagaagcagcagcaagctatttttcactgagtacataacatatggtgggttttatgctactctcttttaataattattttaatcaatcatcacagcaatcccatgagacatctgctactacttgaatcccataccataatgtcctcaccgtcaacctagctccaggacattcacagcttctcccttgacatc

SEQ ID NO: 468065 - DNA, 834 bp, Homo sapiens
gcgtagtatctttaggttcatccaggaggcaccgactcccttcgtggagcactacttacagctgattccatgactgctggccacaccagggaagccaacacctcttccttccctgataattccagtcagtgctgcagtttggacttgactgttcataagaaacccaaacagaagtggctcctctgtggtcccctaccagcttggtatctcatgatagacactgcctatatctttgtgccttttctaatcttcattccctgggatttgaagagcttgggaatccaaggacactgctcaccagagtttccaagagcagcagcttctgtgggctccaggcctccggccttgggaatgagtgaacacggagccatggaggcaccaagctgtgctctcaggcagcttcctttcctcgccacagctgcctttgaaaggtgccaccttgcagaagaatctgacaagcccttgcacacagtgtggccttgtgtccccccagccagccatgctcccttccatcttcaagggttgtcttcttatgtgtgtggaaaccaagactcttctgcccagaagtcagctgacaccaaagctgcaaagaaaggggagccgctgcgcaggagaatagaatgtggagctgccgagggcatccatgagggaagagaggaaggaggaaagacagggaggttgaggaagggcaggagggcccatcctccagcgtttaacacacagacacgtcctccagatcttgagtaaattctactagcatccacggtgtgggtaatttcttatggaaacttgtaaagaagccaaactttgtacccagcagataagaggcaaaat

SEQ ID NO: 468066 - DNA, 577 bp, Homo sapiens
gaaaatgtgctaatgaaggaagccagacgcgaaaggtcacatattatacgattccgcttatctgaaatggtcagaacagagtggagcttccctgcagagtcaggcaggatgggaacggcagatgtcagccaaatggggctctgtttgagtcacatcctggtaaatgcgtgtcagaagcaggtgagcgatgttaaatttcacacaaacaacaatccagatgaaagggactgtgctgcacactggtggtacacatgccttgcgcacttccgctttagtggaataactaatgctgtcattcatgttgatgacctggctgaaaccctgacaccgaattcctgcaggaggtatacgattgcaatttgtccctttactaataaggttgacttcgatcactaggttgagatggtgtctctcagaggggaaaagttacttttcccttctttgtaattaatgaatattttatggaaagttactttgaggtattgtaagtatcctgttcatcatcaagctttccatttatttccctatttatttatatcagtatggattcatgggttcctgttttattcaacaagtt

SEQ ID NO: 468067 - DNA, 622 bp, Homo sapiens
gacccagagatggtcaccttgcccctccaacctagcaggaccatggggcaggtgggacggcagctcgccatcaccaggacgacatcaaccggcactatgacttcggagttccagaccatgctgcagcacctgcagcccacggcagagaacgcctacgagtacttcaccaagatcgcctccagcctgtttgagagtggcatcaaccggggccgtgtggtggctctcctgggcttcagctaccgtctggtcctacatgtctaccagcacggcttgactggcttcctgggcctggtgacccgcttcgtggtcttcatgctgcaacacggcatcgcccggtggatctcgcagaggggcggctgggtggcagccctggacttgggcaatagtcccatcctgaacgtgctggtggttgtgggtgtggttctgctgggccagtttgtggtgaaggccctcacccccatccctgggggccttgggccactccctatcctctgagtgtttggaaataaactgtgcaatcccatcaaaaaaaaaggagaaaaaaatgtaaaaaacattcttagctgtaagctacttatagggggataaagacaggactgttaatggacacaaacatacagtt

SEQ ID NO: 468068 - DNA, 1061 bp, Homo sapiens
ttaatcttccctgacggcttgatgagattcttagggagggggctgaagacaaaatgtcctctaactcctgtgaggcctacagatggaggctcaccctgctttactactcaccctacattatgaagggccacacaacccaaagtgttgacacctggtctgactatctgaaatccatccccaagccccacaaacagccatccctgggctatgccttagaaggcattcagcaacaaataaagtttcactggcttataaaaatcaggaattccactactactaccactactacaactaccagtactactactaccaatgatgtgaccacatatttagcacttacagaattccagagcccattgagtgtggatgatgggttaggagtgggggtacgagatggcagcgtggatgcttgtttatcaaggaggagttgtccgttgttcctggagctggtgaaaggaaagacgccagaatctgatggctggggtagcattgatgtgaggtaatggggtgtcctcgtaggtattaatatttttttcacaagtagaactgaagagtggagaaataaatatcaggtcatgcccatatccctaatgaccaacttttttttccacttgagaaaggttttttggcgggtcactttcagtttgtctcccaaacttgtcatattgtacacaaatcaccttgtatgggatggctataggtgaacactacatgttaactaacccatccattctcaatagggggtcgacttttccctctacgggacatttggcaatgtctggagatgtttttggttgtcacaaattgggcaagttgggggaaatgcagaggatggtattggtatttagtggtagaagctagggctgctgctagtcaatgtgcaagacagcccctcaaataattatttagctcaaaataccagtagtgccaaaggacacttgccattggatttagggcccaccaagataatctaggatgatctcatctcaagatccttaatttaattacatctgtaaatgcctttaactaaataaagtaacataggttcaacagatttgatg

SEQ ID NO: 468069 - DNA, 721 bp, Homo sapiens
ttcatgacttgccatggcatttgtaaactgcattggcgctgttgggagtgtagcagtgaggatgaccagaaagagagagagagagagagagagagagagagaagccagaaatctgactggtaagaaatgcttaccctttggccggcatgccaggcttctgaatggccctagtgatccgatgggccctgtcatctttaatccaacctctgacttggagtttcgacacgacacgtggtctctgggcaagatggctgccctgagtaatagaaaagataagaaagggaaaggagagagagaaaagcattgcctgtggcagtgtggggaaggcgaaatgctcagggggtatagtcgcttccttggtcgccagaaagacgttacaggaccccgacacttacccaaaggagagttcatggattttaacaactacaaagatgatcaacttgacatctctgaattctcagtgtcatttgctgtgacagagttactggaattggaaagatagagtggggtgcatacttgatttgtctacttgtattattttttgtgcaatctaatataatttatctggggagagaactaatgaggaggaggaaatgttgtatgaaaaggtgaaattcatgcaacctctctggaacagaggcctgatttgaatgttattaacatagctggacttccaggccttctgaaatggtctttcatttccatatgaatatcggaaaac

SEQ ID NO: 468070 - DNA, 627 bp, Homo sapiens
gcctcttcagagcctctttcagtgatatgaagttaaagccagccctattctcatcactgtggtgagtgcggccatgtcatgttatatgaacatgacttcccggcaggggacagaggaggagacactgccaaagacagggagatggtggtcgggtgtgcagagtcggggaatgaagtggttaactgtgtcaggtcagcatctttctaaaaagatgcctcctgcaaccaaaataaataaacccataagaagagcggaaagcagaccagagcctctgggagttggccctcacctgcagaagaaagcacagagattcttcctggggactgatggtcctcctgcacaaggtctaacactctgcatagccatcttgaaattcttaataatttttgaacaagatatcccacattctcagtttgcatcgggcccagcaaattatgcagccagtcctggtttagaaagacaaagagctgtcactttatacagtcccagacaccaggtctttgctgtgtcagaattgtatgaggagttaagaatataatttacattgtataaaccttcaaactgcacagatacatctgtttttgtttatttgttttgtttgcattttcatttcatgtcttgttcctg

SEQ ID NO: 468071 - DNA, 742 bp, Homo sapiens
cggcccagaactggtgggccccagagggtgtcaggaggagaggaaacgggtctagttatctatgtgcaacaagaaaatccccatagtcatagcaggagagaggcaagtgttaacagaaaaaatgaactccttgcatccaaggaacatctgctcagagaagccagtcaatattgtggaaaagttcaaagaatgtagatcattactagtgtcagctttacaaacaggagaagtcaagaacatttttacagaggaggctagcaaggagaaagttcagcgaaagacatttctggaagaagcagcagcacagaaaaacagagatgtgacaaatttgctcttctttcccagacctggatctcaggagttctcaaagctacaggctacccaagggccacgtttttcttcactctttgctggttccagtcctcatctccgggctttgcaaaacccagccctgctgatgaataaacatcgttgtgtctgtggcgccccatacactttggagacaatgttcagcttcaaagttttcagaattgcccagtccggttttgttaacgacattagtgggaccgcattgtcggggtgaggggtgagacaatggtgcatctcttacatcatcaaacacaaggagctctgtctccagctgtacaaacaacacaggaaatggattttttcttcgtgttattttttgtctattaaaattatgcaaacccagcaaatacaacaattgctttgttaagtctcc

SEQ ID NO: 468072 - DNA, 617 bp, Homo sapiens
ttcaagtgactgaggggctggggtggaaaaaggtctggcagagatggacagaagaatggaggagcttgataaatgttggagtttccctttcaaacatttggactctcggcaactggctgcttttgggtcccttttaccacttttatgcaatttgctgttaagagagagcaatgaaggggagaaaatcttgagtgcaggggaggaagcagtcaggattccagtgtggacaaagacactattatcggctaagagccttctaaaacctccatttaaatttaaaactagcgggcaaactcaactgttgaagtggaagaggaaagattgggtgggaggaaggcagattggtctaagcacagtgaaactcagacctgtgtttgaaggatgcgtaaagcatcctcttttccaggatgtgaaggagaaagcccagtcttctgctgtcagctatcttaagactatgcctgaagcccacctaatgataagttcacccacactgaagagcagggtggagaggtgtgtggagaaaagaggtgaagcctaaaccatctcatggcttatcaagtatgaaagccaacacattttctgcatatttaagctactttgaaatggattttctctta

SEQ ID NO: 468073 - DNA, 915 bp, Homo sapiens
gggcgcacacaaagtttcttttctgcttttgtctagacaatctctcccggaatggtggtggtagcacgtagcgtgtttataataattgctgctagcacagtcatatttgagaccccctcacacttggactgaaggtgccccatgaaatgtggagctgagaggggagctgaggagtgtctgaatgtgtcacctagataaggaagagggccagaagttggtgcctggaactgggaaaggaatccagggaatcccagagctaggaaaagcagcacaagaggaatggctgtcctttgaggagtcagcagcattcagacatgtgctacataatgtgaaggatgttgcatggcctgaaaagttaagtggcataagtcagaaaagggaggaacctggaggccaaatgctggcgaaggcttggagaaggaggaagagccacagatgggtgctgaataagggacaagtgaaaagcataagccccactttgtcaaagagctttcacatcacaagaaatctatgcaaacttggaactccatcaggaaatcagtctcccaaggcaatactgaatttcatcaatgtcatcagcatacagccagacatgagcctttctttgccaaacatgatttggtcatgctgatgctgcagcccaaacgggagggtctggaatgtcactgacaaacatgtgggttttcctcttggaggcgatgctcataccaccatagggtaacctcctgaaattgccatggcatttgtaaactgtcatggcactggtggcagtgtcttttagcatgctaattagcatataatgagcagtgaggacaaccagaggtcacttttatcgccatctttgttttggtgcgttttggctggcttctttacttcatcctgttatatcagcaaggtctttatgagctgtatccc

SEQ ID NO: 468074 - DNA, 667 bp, Homo sapiens
ggagatcttttcgaactttaaggtttaatgactgccttattggatgtcagacctacatgggacctattatatcattgagacaaatgcaaattatgagagctcagatcctggagcacaagacaaggtgatagacagctggaagaacaggcagctggatactaggagacccagggtaactaaaggagtagaatacggtgagctcttgaagaaaacagatgcaaggccccaggagggagaatgtaagcacctatgttggccagggagcctcttatggagtccctgctgggtcttaaaggtagatgaagtggactccaacctgggcaatggagcaagaccctgtctcaaggaggaggaggaggaaggaggaggaggaggagggagaagaagaaggagaaggagaaagaaaaaggaggaaggaggagaaagaaaaagaaagaagaaggaggaggaggaggaagaggaagaagaagaagaagaaagaggaggaggaggggagggggagggaggaagagggaggaggaggaggaggaaaggaggaggagaagaggaggaggaagaggaagaggaagaaggaggaagagaagaggaagaagaattggagaaataaatgaataccattgggaaagttgttgatgtgtcgtatgctgaaaatatcaaactctttttc

SEQ ID NO: 468075 - DNA, 817 bp, Homo sapiens
tcccttgcacttcccggccactgtgagggctggtagaggggcggtggttctcaggccaatggggttatgtttcagaggggattatggctgcctcttctgtgtcatatagttcaccagggaagtgggggatagctggtagtgaaaggtctcacccaacacccacgcagttggtgaggctggtcttgctcctgcagtgccccctgttcagatcttgcccaggtcataaagttcccactgagaaagaaaacatggctttcaggccttgccccctccctgtctgcccacattgtggtcagcagctcctgtgctcatatctgcagcagttcctggccaccccccagattttactcaagaaaatttgtgtccagttgaaattattacagatttcatttggaagcttggttcaccttgtgacccctccccagttctactcattgccttctttaaggatgcctataattataataagggatggcttccctggatttcagctggagattgggagtgcctagaaggctcttcctgctgctgcttctattttttattttgtgcagctccctaaatttgtttcagctctagatatgaaagtatagttggaaaataagcaaatatgtaaaagattattaatattatactgttaaattagcagctaacagtattgtgcttgtctaagagacacctgttgtatcttagagatcttaacagtccatggagaagcatcagtgagcctgtaaactgcctgaaattgcatgtaaattttgtgtgtgtatgcattttactggggaaagggtctatttttgcatcatattcccaaaga

SEQ ID NO: 468076 - DNA, 785 bp, Homo sapiens
tgcagctattctagggctgggagggaagaagctgtggtacccggcagtaagatgtgcgggaagtatgatagggggcgctgttacttagagggctgctctcacctgagtgctcaggtaaaaacccagctcattttgactgaagcaggcagaaaactagctgagagaatgctgccaatcaccagcatcctggatccagttgtagtcgcctatttgggagctgctgctggaagtaatgaagagctgagagaaattgctccttcactgaatgttagaaccaagcctctcatttcattatctccatggactgaaaatggctgtatttgtacattacacggaaggaaagagaagggactgtttttatgccaaaagtgctctgccgagccacagcgagggctgagggactcatactacagtgacacctgtaactcaggccctggcaggccagctgagaagcaccagggtgggttcttggtcttgctgacttcaagaatgaagctgcggaccttcgcggtgagtgtaacagctcttaaaggtgacatggacccaaagagtgagcagcagcaagatttattgtgaagagcgaaagaacaaagcttccacagcatggaaggggagctgagtgggttgctgctgctggctggggtggccagcttttatttccttatttgtccccacccacgtcctgctgattagttcattttacagattgctcattggttcattttacagagtgctgatggttgtgtttacaatcctttagctagacacggagcactgattgggac

SEQ ID NO: 468077 - DNA, 778 bp, Homo sapiens
aatagtattggtagttgaggtacatgcgtaggatggttacacgggtatgttggaccgaggtaatgagcatagtacccaattacacgggtatgttggaccgagctaccgcaagtgctcacacgggaagagcacaatctccaggagcttctgcagcaacttcgcattcttcagtaaggtgttctcctacagcacatgctgccttcagaatttcaagtaaacataccttgtatgatgggccgacatgcaatgcctcatttctgggaaagcagaaagcacctagagccttcctccattgtgatatcagtggaggtcaacagaacacagatcagagactaaatacaggaataattacaactttccttcattgccaaaagaaattggtaatatgcttgtttgactatagccctgggctcaacacagaggctcaagaactggatagtattctcatcaccttagagtttacaaagggagtttgcatcctcaatgtctttgttctcccattgagaaaatggagggagagctcccaggtaaaacagaagccctcctatacctttttgtatgtcttcccataggtactgagaggtaatgaacactaagccacatttttcatctcccatcttttacttgacactgtgtatccagttcctgttctagatgcaaagtctcactgaagtagcatgatgactacttgtattttctttctttccatccattcgctagatttgcaacctaaacccatataatctctgctgtgctctgaatgtttttgtccctccct

SEQ ID NO: 468078 - DNA, 1075 bp, Homo sapiens
tctttttggcttagcagctgaagactgacgctgcctgattgcctcggaagccccgtagaccatcatggacgctgagctttaggtaactctcacagttgaggcataattcttataaaaacacacgtgctctccctgccaatcgtgtctgactaatctctcaaaccccaaccccttccacaaaacaacaactcctttccttcctgggcatggttggatactttcacatttggatacctggttttgccatcctaacaaaaccattatataaactcacaaaaggaaacctagctgaccccatagatcctaaatcctttccccactcttttttccattccttgaagacagctttagagactgcccccaccccagctctccctgacttatcccaacccttttcattacacacagctgaagtgcagggctgtgctgtcggaattcttacacaagaaccgggattgtgtcctgtagcctttttgtccaaacaacttgaccttactgttttaggctggccatcatgtctccatgcagaggctgctgccgccctaatacttttagaggcccttaaaatcacaaactatgctcaactcactctctacagctctcataatttccaaaatctgttttcttcctcacacctgacgcatatactttctgctccccggctccttcagctgtactcactcttcgttgagtctcccacaattaccattgttcctggcccggacttcaatccggcctcccacattattcctgataccacacctgaccctcatgactgcatctctctgatccacctgacattcaccccatttccccacattcccttcttccctgtttctcactctgatcacacttggtttattgatggcagttccaccaggcctaatcgccacacaccagcaaagaaaggctatgctatagtacaagccactagcccgacctcttagaacctctcatttcctttccatcatggaaatctattctcaaggaaataacttctcagtgttccatctgctattctatgactcctcagggattattcaggccccctcccttccctacacatcaagctcac

SEQ ID NO: 468079 - DNA, 548 bp, Homo sapiens
cgccattctaactggtgcctcacactggtctatccctgtgaaggaatgcatcaccagactgctccatctggaccgtccaactggcaaacatgcctggctgtgtggacagactctccagtggacaatgtaacgtgtgagagcagctctctggggcttctgacccaatgggctgagcaggtgtgttcctcgtggaattttgaggtgaaatcagcctatagagctctgcactttggaggcaaacaaattgacccacagagaacaaagaaaggcagggagtgggggtggggcaacagcccatccagaagcaatacggagccaaaggaaccttccccccacagccaagggaagcgcccatgccaccagggctttgggtccaatacacaaagctatatggagtttcagcagagcagctgctcactaactccagtcccaggatctggcaaagtggaaaattcatctgtacatattcctaggaagagggctgaatccagggagccgaacagcacccctctgcaggccccacttccatggcacctcacaacttaata

SEQ ID NO: 468080 - DNA, 617 bp, Homo sapiens
tgttgtaaaaccatggcagacaattccatgggcacccaagggaatgacagactcagcaagccataatgagggctgtgactggaactggaaattcaagagccaaggatgttctctctatcactcaagagccccagaatctctttctttgctcctgattcctttctatttcaagagaaatcatgtcctgtctgaagctgtctctgagtccagggatccacggatatggagcactggacacgtgagcctgtggctcagcctgctcctgacttgcctcagggcctatcaggttacactctcatcctactcctgcatgtctgccttgcccaccacattctccaaagactgtgagctctgtaaagattatatgagccccatattaagtcctggaatttctgcagacccctggaaaagtccatctgctctactgcctgcctctactattaactctccctcgttgatgcgtatggccgtcacctctctgtgccccatgcagtgtgggatgaaaagcactagcgatgctggtggtccccacggttagttaacaataggtctgaaacttcaattcatttctttttaattaaagcccagactccttcccttcccttctttcctgcccc

SEQ ID NO: 468081 - DNA, 680 bp, Homo sapiens
ccagactacacctacaccttcccagaccagcaccagctaatagtcttctccagttccttgtacacgtgatgagaaatggctcttgccaagagatctcagtttatatctcaaagagaatagattattctgagttggaatatcttagtctctattccaaacacaaggaagtgcagcagcctgttgaaagttcatatgattatctgaaggagaaggaagcagaagcagagataatgatacacattaccccagcaattgtgatttctactcacagtcaggaattccctatctatgaatatatttatgcaaacacagggtcatgtggtgtcatcaaagctctcacttctggggtccacacggggtcctccagcggattccgtcagcgtttgcttgtagtcttcatgcatgatgacctcagagtccagtgctttatgtttgcactgcatctctacccaggcaagctcattaccattcaaaatccctttgtgttacttcgggaaaaacagattagaattcaaaagtctctggttgttcattgactgttaacatacataaccatatagatataataatacttcagagagtgctgaaagtataatttggaataagtaaataaaacaaacaaaaagactttagacttgagcgaaatgcttgcttgcatgtagaaagggttatttattaaa

SEQ ID NO: 468082 - DNA, 992 bp, Homo sapiens
cgttcagatgtccctgacaccccatccttacccaacagtcgttgagacaccttatctctttccaccagatcctgaagcctgtgtgtttagttcccttctcatgtctctcaaattccggatcaacctgagtaaggccagttctttagcttttcattgctttgccaattactactttagtgcttaccaggtattcagaatcaagaatggggaaaactgtctccacctcctaatgcgaggagctgaaagaagtggccattctaaaccacaggggaatggcagagggaacattccaaacttagtgattagcaggaacaatgggtggtgcaatatttgtgaaactgcaagtaaatgtacgtggatgaatatagaatgcatcatatcctctggggagcagctctggacaatgggagatgtattggaaagcctccccctgcccatagatgttgtcataaactgtatgcaatggatcaacagcagctgtgaggaagattgagtcccttgtcagctgttggcagggagatctatgtctacttttcaagcctttaattttactcattgaaaaaaaatgtgctctggagagtgacagtcatgaacatagatggaacagaatattaaattacagaataaaatattgaaataagacaattattggataattagggcaaaaactcaatgtatttataactttcaggtaatcagagctaaaaaagcataatacaatcaaatcagtttttaacatatagatagtacctcttatttttgttatagtttccaataaaatctcccagtagcacaaattattgatagtaaaatcattgattagtgacagtagataaataactcgtaattttcatctgacagctatttgatacaaccatgcaggaatatcattttatcataagaatatcaaattatttgacatattaatagtaatataacatagtcatataataatataataggattaatttatcacaatacacttatgtctt

SEQ ID NO: 468083 - DNA, 849 bp, Homo sapiens
gcgcctgcctgtctgaatggtccccctcctgtggagctgcctgccagtcccgcgccatgcgctctcactcttcagcccttgggtggtggatgggactgggcgcgtggagcacggggcggcgctcattggagaggctccggccgcacaggagcccacggagtcgggggagtctcaggcatggtgggctgcaggtcccgagacctgccccgtgggaaggcagctaaggcccggcgagaacttgagcacagcagctgctggcccaggtgctaagcccggccggccggctgctccgagcgcggggtccgcccagcccacgcccacccggaactcacgctggcccgcaagcaccgcgcgcagccccggttcccgcctgcgcctctccctccacacctccccgcaagctgagggagccggctccggcctttgccagcccagaaaggggctcccagagtgcagcggcgggctgaagggctcctcaagtgccgccaaagtgggagcccaggcagaggaggcgcggagagccagcgagagctggcagcagagttgtcccggacagagaagcccaaaggtccagagtgccctgaacattctgcacagctacctctctgggctcggaccaactggcttctttcggtggctgtctggagatgtgctccttggagaccaaaactttgggatccgatacctaccctgattatatttccatgcacatatttgggggaaattaagttttcattagcaaagtcatttgaatgacctctgacatgctcagcatcctaatcatggtggagaatagtattactagattttgttctaggacttttatagttttgggttgtaaatttaaga

SEQ ID NO: 468084 - DNA, 658 bp, Homo sapiens
caccatccaactcaaactagaaacatttcaaaatctttcctcgcctgcaacccaagctgaagtcattctccccagaaataacaaaagttggaagagaagccggagacaggataggtgcaggaagcccacactttgagggcagcactcagacaccctctcctgtgtgcaggacgtgccgaatgttcaggtgcaatgagaatgagccatgcttggcttacgagggcaatctggcccatcaagtggccttcgcctctgggagtaacaaaaatgcacttcaaaatagcttctgtaatcaagctgcatgggtggagtactccccagctgactccaggaagattcttaatgtaaaaacagttcagtatggaaagcgtacttatgacagagctgttgcagaatgtgaaatcacccatgtgcctaagtgtctccctactacctggaacactagaccacatgcagcaggcccgcctccacaggtgaaggcctctgttcaattgaagaggagctttgacaccttggaaacagaggtggagccaagaggctggaaaagcctacctgtcactactgaattttcagaacacaactgtaaataccctctgggtttatttgggagaagaatgtgtattataaagtatagtttgtaaatcaaagcaaagcacat

SEQ ID NO: 468085 - DNA, 602 bp, Homo sapiens
aggaacttgggtgtagtgtgtttgtctacaattagggagctggaggagctcatggaaaaaagaggaagggtgggctggagctccagggaggctttgtggagtggagagggagaagaggaaccgaacaaagaaaagcaacagtctacctggaacatcagcattccaccatcaaaagctgttcttgaagagcagccccagtcccccattgttcccaagtcaggaaaatcagtcaaaacatttatcagaaatcggtatgaaccagccaagcgctgtgaagagctaatctgtgcagagctaataagaatgaacaaagtcaccacagactccgccatgggcatcgctgataaggatttgtcagaagaattgcagtgccgatcctgttcttccatcatcctggttgtcatcttcttttccagagactctaagttaattgaggccaagaatgaggcttttgtctcatggggtcttataactttagcatctaacacaatgcctcatgcttctcggtgctcaagaaatgcttagcaaatgaaattaataatgattcaagtcttggcaatacagatgaagtggaatatttgtttgtcactgcaaaagggacc

SEQ ID NO: 468086 - DNA, 1338 bp, Homo sapiens
gcctccacagagatggtaacaccagtcacatggatggataatcctatagaagtatatgttaatgatagtgtacgggtacctggccccacagatgatcgctgccctatcaaacctgaggaagaagggataatgataaatatttccactgggtatcgttatcctatttgcctagggagagcaccaggatgtttaatacatgcagtccaaaattggttggtagaagtacctactgtcagtcctaacggtagattcacttatcacatggtaagcgggatgtcactcaggccacgagtaaattatttacaggacttttcttatcaaagatcattaaaatttagacctaaaggaaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattcgatcacaattgctcaggacaaactcagttgtgtccaagtgcacaagtgagtccagctgttgatagcgacttaacagaaagtctagacaaacataagcataaaaaattacagtctttgtacccttgggaatggggagaaaaaggaatctctaccccaagaccaaaaataataagtcctgtttctggtcctgaacatccagaattatggaggcttattgtggcctcacaccacattagaatttggtctggaaatcaaacttcagaaacaagagatcgtaagccattttatactatcgacctaaattccagtctaacggttcctttacagagttgcgtaaagcccccttatatgctagttgtaggaaatatagttattaaaccagactcccaaactataacctgtgaaaattgtagattgtttacttgcattgattcaacttttaattggcagcagcgtattctgctggtgagagcaagagaaggcgtgtggatccctgtgtccatggacagaccgtgggaggcctcgccatccatccatattttgactgaagtattaaaaggcattttaaatagatccaaaagattcatttttactttaattgcagtgattatgggattaattgcagtcacagctacggctgctgtggcaggagttgcattgcactcttctgttcagtcggtaaactttgttaatgattggcaaaagaattctacaagattgtggaattcacaatctagtattgatcaaaaattggcaaatcaaattaatcatcttagacaaactcatttggataggagacagactcatgagcttagaacgtcgtttccagttacagtgtgactgcaatac

SEQ ID NO: 468087 - DNA, 1144 bp, Homo sapiens
cccctagagaaaaaacccaaccctgataaggatggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagctcacagaagaggaggaggctgaggaccaggaagacagctcctctatggctctcccatcccctcacaaaagggcccccctccagagtcggaggcttcggcaagccagcagccaggcggggaggctctggtcccggccccctctcaattacttccacctaattgccctggcattaagaaacagttccccctgtggcctcaacgtgcaacagatctacagtttcactcggtatgtgccgggggccctgcgaggagggggaagtgggggccagggccccgggctgatgccttccaatccatcccaggccctgggttgctgacctggtttccctatctgggtctgagaggacaagtatgttcccagttcccttttcccaggtgcatttgtgcccacattgtgcccacattttatggctttagttttttttttctttttaacaagttttcagtgttctttgggtatagttctcctttaaaacatacattcacttgggtcaggtaacagtttccccaccatcctctgaagatcagccagtctaaagtcaggtttccccaacggttcccacctgcttctgctaggactggactgcctggcacagctccctgcacccccaggggtgcagagaacccagttgagaaggattttccatttagctcagatagtcctgctcacaggagggtgaggaagggagtttcttgggccctttcccagtgttaggagaagtgcctaatgtctcaggacaggaattttcaagtggtgtccgtcctcaaccaagattcctcttacaggagctgcttggcctgattctgctttgttcatgctgtggtccaagccctgggccctcagagggagggagggttcag

SEQ ID NO: 468088 - DNA, 893 bp, Homo sapiens
ttgagtctactttgaagagcagttcacagccatgttcatgtgcaaggccttcctgcactggtacgtaggttggggcatggatgagatggagttgactgaggctgagagcaacgtgaaggacctgatgtctgagtcccaacaatatcaggatgctatgggcaagcaggagggagagtttggggagtgggccgaggaggaggtggcctggagcattctgttactgagtgaagggtggaagagtgtgactgacagacctggtgatgaaaagggactttactgtgtagcatcagggagtggtgtaagagatgtggttctgctgaatggaggtggtcagaggttctgggaggcccacctttgccaagataaagagcttcctcacaggactaagagcctgactggattgatgggattgactggaaaggagagagacttcctggctctaattgaggcctgttaccaaaaatttgctgaagagatcagatatttcccatgataaggaaaagataaagtacaaacgcagttgcttcttagttattcagagaaacttacatgggggtatctattacctgtagcatagtcaagacccagaagcaggtcaccgcattctcttagcaacccgaagtttgcccagagttaatattagagttaatgttacattttgtttggcaagtttgattatctttcaattttgtctagtttttaatttgtgtttttagctcatggaacataagaaggtaaatacaatgcaagcactaactatttgtaagattggtaagaacaggtgatagctgatgtgaagtttagagaggtactaaaatgagcagacatagcaagtgtgaaagccagggctaagccactgagaatatcaggagagaaacctttacatccccttc

SEQ ID NO: 468089 - DNA, 1424 bp, Homo sapiens
tcgccacactgacttccatgatggttgaactagtttacagtcccaccaacagtgtaaaagtagagtttccactaagccaatgcctagcagagcctggggcagagccaccccagaaaccccagaccagtggagccactgacttgcaatttcagcccagtatcgttattgacaccagactccaatgcgtaagagacgtggcttacggtgtacccagcaaagccatgatgatggggcctcctaaagccttgggagcccaatttctgtcccactatgtctggaaagcaggctatcaagtcaaaaaatgttattctagagtgtggaaatttaatgttgcttgtcctaatggatgcttagaggatagagaggacatatgtggcctcctgggaggagaagtcagcatggagcacactcctccaagtcagttgaggagcaatgaaggttcgtgagctgattagcagtcatttcctcacgttttctttctgtgcacctcagaggctgtgcttgttaggagcatcttttccctacaggggggttatggcactgtgaaaaattcgcactttgcagataattaaaataatacatgtttttctagctcaagatcaatgcttcatctcattcccttgaatagttacctgcataccaggattgggaaggcctgaaagaaaaagatctagctatttaaatagagattctttacagatgcacatttgctcccacaaaggatggctttgcaggaccatttcaaactatgacaaagaaacatgttttggggtaaaatattttgattttcttctttgtcatgttatgttatgccagagtcagattggaaaataagtcataatataaagatttcaataaaacccatctgatgagaatttatgatccacacacataacaactgtttctaaatgctagaaggttgagacaatttgaagaagagggctaaagtctcagacctagcaacctgtatgtctatacaaatctgaggcctgcatttgttattcctctgggcaacaaaatacacgcatacatctctgtatagatactttctggtgaagagaatcttaagtattccctatacaactatgaataatggagactgaaaatgtttatgctttattaaaatgtattttcataggaaagatgtataatcttctcttacaggaaatcccaattgttacaaacaagatataataacaacagatcaaatgcgaacgagtaaataatttacatttctaagtagcagagcctggaaatattcaggtttacattagaaatccttcaagatctcacatacggaaactgcataaattaccagtggctttgtagaagcggatgcatgatgccatgacagcattaaagacaaaagaggagtaagttggcctctactgctgaggtctgggtagaacaggagtattctcctg

SEQ ID NO: 468090 - DNA, 522 bp, Homo sapiens
gcggtgatgcctcactcaaattcacacgggcaggaaatggaaaagtacggaatgcaattcaggtcccctgactcctgctctaatactctgctccctgtacaaggaatggggcttcctgagagccgaactgtagtgattgtttctgctcttctggatctagccacccagtggagctactgggctctgggctggtactggggagtgtcttcagagtcctgtgatgtgatctgtcttcaggtcttgcagccacggatagtagcacctgctccagcggagcttccatcaagagatggaagcttcctgggagatttcttgaagtttgtcttccaacactctattgattattatggaaatatgttttactttgttaattatgacaataataaatgtgaagatttacaatctgttacactacttataacacctagtgctacctggaagatgtctgtgaagatgtaaataaagacatagctaatctctgaacatggcctctgtaatgaccaattattttctccatcatga

SEQ ID NO: 468091 - DNA, 1646 bp, Homo sapiens
gcccacagtcaatggtgaccggtctatgaagtagttcacgcaaatgcagcaaatgagctcattctggaagactcgcagggcatcagaatccatgtttctgaaaattaaaaaaaaaaaaagccaaatggcatctcgtgtcctgtccctggatggcttaacccaggaaaactcctggatccaagaggagtcagacaaaggaatggtggccttgtgcgtgctgatattctcacagatgagtgagtccgtgctgctgcacatgccccagcctgtgaatccagagttccctacagggcccatcacaggaccggtggacaggctcaaccacttccgaggccattggtccaacaaagacatcttgaggttactggaatgcatggagaataatcgcccatctgatgacaacagcacgtttagctcaactcagtcatacatggactggggaaaagtagcttttaaaaacttttctggtgaaatgtgcagactcaaatggttagagatttcttgcaacttgagaaaattcggcactttgaaagaattagtcctggaagctaagaaatgtgttaaaaagatgaacaaaagccaaaaatacaggaactgtccagactttccaaaaaggccccttactgcttataatcgcttcttcaaggagagttggccccagtactcccaaatgtaccctgggatgagaagccaggaactgaccaaaatcctgtcaaagaaatacagggaactcccagagcagatgaaacagaaatatattcaggatttccagaaggaaaagcaagaatttgaggaaaaacttgctcgattcagggaagaacaccctgatttagtccagaaggccaagaaatctagtgtctccaagaggactcaaaacaaagtgcaaaagaagtttcagaaaaatattgaagaagtgaggtctcttccaaaaacggatcgatttttcaagaaggtaaaatttcatggagagcctcagaaaccccccatgaatggataccacaagtttcaccaagattcctggtcaagtaaagagctgcaacatttgtcagtgagggagcgcatggtagagattggcagacgctggcagcgcatcccgcagagccagaaggatcattttaagagccaggctgaggaactgcagaagcaatacaaggtgaaattggatctctggctcaagactttgtcacctgaaaattatgctgcatacaaagaatcgacctatgctaagggtaagaatatggccatgacaggaggcccggaccccaggttgaaacaagcagatccacagtcctcatcagcaaagggtctgcaagaagggtttggggaggggcaagggctccaggctgcaggaacagattcatcacagactatttgggtaaactgtcatgtctccatggaaccagaagagaacaggaagaaagatagagaaaaggaagaaagcagtaactcttcagactgcagcagtggagaagaaatagaagttgataattcatgcaccagtgtcacattgttttaattttttggtttactaatatgtttgaaaatctacctaaagttagtgccttctcagtatacctttattctattaaacatttctggctattttcatactttgttctcatgaatattagcatcacagaactagt

SEQ ID NO: 468092 - DNA, 2191 bp, Homo sapiens
tttttgtctgagttttctgctctctgaaatatttccaggatttctgcataccctcaaggggactgatttggcacagatgcaaaagccccagccagtgaacccagagctcacttcatggtgcataactggagtcctagacatgctcaacaacttcagagtggataatgctctgagtacggaaatgactccttgctatataagcctttctgaggatgtgagatatgtgatatttggagatgaccatctcagtgctcccacggatccccagggagtggacagctttgctgtgtggggagcacaagcattcacctccggcaagcattactgggaggtggatgtgaccctctcctccaactggattctgggagtctgtcgagattccagaacagcagataccaatatcgttattgattctgatgaaagattttttttaatttcctcaaagaggagcaatcactatagtctctccaccaactctccacctttaattcagtatgtgcaaaggcctctgggtcgggttggggtgtttctggattatgataatggatctgtgagtttttttgatgtttctaaaggttctcttatctatggttttcctccttcctccttctcgtcccctctgaggcctttcttttgctttggttgtacatgaaaagttggtttcatgatgatttattgtgacctcccatatataaggcaaatactgtcctaagacactatgtgtgagagcctgtgagcgcactgtaacttcatggaatgtaattactttatggttataaatgggataaccaccttgaatgtatacattcattaattaagttattttaattaataaattattgtggaatctttactagaacatcaataatggctttttttgtacaagttttttgagattcattcacttactgtgaaagtcatgttctaatgtatttaattcagagattgttagtatatcacacttgagcagccatcagagctctcttctgcctgggcacttttatcacttccagaagaatcccaataccccttaacatttattctgcattcaccctcccccattccttcagaacacttaatctactttttatgtttttgcattcgggtaaataaaatcatacaacataagttctttttttaatctgatttatttttcagagagtatgttttcagtttgtgcacactgtaaaccatttgtcttacttgtatatttgaaccaggctggggtagaaaaatgaagtggtggatatctcatcttacaaagaataaagaagtgtgcttattttctttctaagtctgaccaagttaagttgacctcacagactttattatttctcaacatcctagttattaatcgcatttcagctcatacaaaagtttttcagtgctgggttgctctgctattacatcttctcaagtatattatatcagattataacattcagaaaactcttatacttattactaccagattgaaaagtccaagggggcaatggcagtatttgtcttctttgctaatatattaccattatcgaatgcgatttttagaatagattatacaataaataagatgaataaatggattaagtagaggagttagtatgtataaatattattctaacattgagaaacttttccaaaatgtacgtaacaaaataggatagaacatactaatgaatatctatcaaaagataagacataaattgattttcagattgatatcaaagataatactattatgttagggtttaaaataattgtagcataatttttatagggttgatttcaattgtcttaggttttttaatataaacctttgaaagatgaaggttcctatataagatgatggggtagaggagcaggacttagaatagtggagactggccttaaactgacatataaatttaattacttgctaagcataaagtggtataaaccttcctatgcagtagaaagaacaaaattagtttacactttaaataagaatccagatgatagagaatggaaaattctataatagaatgtaatagctacatctcctagggcaccggcttacctgctctaacaaagaccacaaatttgaaatgattcagaagatgcatttctctcacatgtttgtaccaatataggagttggtcaagaagaaaactgacatcttcaaccagtgaattttacctctgtgtgcaggaaa

SEQ ID NO: 468093 - DNA, 816 bp, Homo sapiens
tctacaactcagtgtctgagaggttttgtctgatttgattgtggtgtgtcgtcagctggtgaaggacctcggatgatggcccccaagaacaaccagactggggcctcagggaaatccagcagacaggggaacactcagatcagattggcccattttcatgagcaagatcacacagtcaccaaagaccaaaaccaccaagaggggcatgggcaattgcagcttgctggaggtgtagataaagcactcaggatctttgctccttcctcagtccaaggacagaaacggcagttccactgcagaggcagcgtcagagggctttttgtcgcccctgggagcgctacttccaataaattaggagccactgctactgggcgtgttcagccaggggacagggcagctctactgctggctcaagctaggggttctgcttgttgggaagcaggggttaagggctcacagagaggagagactgggatcctgttggtaggtggctgtggcatgctgttcgcttggatgaagccctccggtgccttgtttctttcccaggctgagtgcatcaggggcagaaccactcctgtggcagtggctgaggggctgtttattgcctctgggagcctctctccagggaaactcagagcctctaccagttgttgtgttcatccgtgggtggggcagctgttctgtggtcctgagcttgttgccctgcctggtgacgagttggggggtgggggttccagggaagaggagttggattcctctccatttggtggctgctgcatgggggtgccaggatagtgactaggccttttgttcttt

SEQ ID NO: 468094 - DNA, 521 bp, Homo sapiens
ggagggtatcactccgttggggggcatgagaagttggatccgattaatgaagcattttgtcccttggtggagggggtatgttttgctggggggaaagccacttgtctgggatgccgggattcctcagaactaccaggatgagaggctaagtctgctgctttgcagactgtggccacctcttcccctaggggttcaggcccaggtatattcaaattctgtccctgagcctctggctggagttattggagagactgcaaggaagccccacacactgaggaaagatgtgtcagggtatgactacactaccagtagaaagacaagaaaaccaaacagacaaaaatctgacaatagcaaatattatcaagaatatggagtaattcagattatcatattttttggtgtgtaaaatactacaaccactttgaaaaattcttctgcaggttttttaaaattaggttcaggtatacacatacaggtttgttatgtagtttgattgattgcaactttctgagctcaagcaa

SEQ ID NO: 468095 - DNA, 521 bp, Homo sapiens
agagccaattttctgtgctagcatggtaactcctgtcatttctatcccttcaatcctatggggagctctagagctggaacagccctatagaattgttctctatcaaggcaaggacctgcacctttttactgccccatcaatcacttattgcatgatgatggctttcccagcaaaagattcaaaattaatgcatcagcaggcactgcccttgaaaggtgaaaaatggagtcactcagtcctgaagtggtatttgggtggctctcttcaacatccactaccaacagggcatatcagaaatcttcacaacagtccctcccatcacaagcatggaggcctagggggaaaaaattgtttcatgggccaggtccaagctcgtcctgctgtgtacaacctagggacttggtgccctgcattccagtcactccagccatgactaaaaggggccaagataataggaaaatgttatatgaaagtataataaagcacatattaaaaacttaaagtccattagcatgtgcttt

SEQ ID NO: 468096 - DNA, 1070 bp, Homo sapiens
gataagaaatcccctagtgtggtagtagagcagcagcatgaaaatggacgaatacagtaaattggtaacagtagagtggggtgctgctgaaaagttacctgaaaatgtggaagcaactttggaactgggtaacaggcagagattgaaacagtttggagggcgtagaagacaggaaatgtgggaaagtttgaaacttcctagagacttgctgaatggctttgaccaaaaacctgacaatgatatggacaataaaatccagctgaagtggtctcagatggagatgaactttttgggagctgaagcaaaggtacagcttcggctgttgcttcagagggtggaagcccccaggccttggcagcttccatgtggtgttgaccctgcaggtgcacagaagtcaagaattgaggtttgggcacctctgcctagtcttcagaagatgtatgggaacccctggatgcccaggcagaagtttgctgcaggagtgaggccctcatggagaccctctgctagggcagtgcagaaggaaaatgtggggacagagcccccacacagagtccctactggggtaccacctagtggagctatgagaagaggactactgtcctccagaccccagaaaggtagatccactgacagcttgcccttgcacctggaaaagccaccagcactcaatgccaacccatgaaagcagccaggagggaggctgtaccctgcaaagccacagtggtagagctgcccaagaccatgatactttgacatttctagcttcttctatttgatattcaactccacttacttttctttaagatgtttatcatgtgtttgatttaatatttcctggttattttgtctctctgtaaatttatttttaaaaaaaaaaacccataagtaatatcagatgacatagcatactcctttcagggtggtaaacaaatacttttgttctttgtcttggagatacatcaaaccaggcctctgtcctaaacatccattaattcagtaaatacttttaagaactatattcaagatgaggtcagagagatcagttatttataacataagttgaatta

SEQ ID NO: 468097 - DNA, 773 bp, Homo sapiens
cgttcctgcctgacgactctgaagagagcagcggatctcccagcacagcattcgagctctaataagggtcagactgcctcctcaagtaggtccctgacccccatgtattctgattgagagacacctcccagaaggcaccaacgaacacctcatgcagaagagctccggctggcatctggtgggtgccccactgggacaaagcttccagaagaaggaacaggcagcaatctttgctgttctgcaggctctgccagtgatatccaggcaaacagggtttggagtagacctcaagcaaactccagcagacctgcagcagaaggtcctgactattagaagaaaaactaaaaaacaggaacagtatcaacatcaacaaaaaggatgtccactcagagaccccactggaaggtcaccaacttcaaagaccaaagcaacacaacaaaactggatggagaatgagtttgacaaattgacagaagtaggattcagaaggtgggtaataaactcctcagagctaaaggagcatgttctaacccaatgcaaggaagctaagaaccttgaaaaaaggttagacaaatcagtaaccacaataaccaatttagagaaggacataaatgacctgatggagctgaaatacacagcatgggaacttcatgaagcatacacaagtacagatagctgaatcaatcaagtgagaaaaaggatatcagagattggagatcactcagtgaaataaagagagaagacaagattagagaaaaaagagtgaaaagaac

SEQ ID NO: 468098 - DNA, 456 bp, Homo sapiens
tatcataagttagttatatgaactgcttgcttgcttggtggttgggagaaatccccatatttggtcaccgaaatcttatgtttgttaaagatgtatacatgtgccatgttgttgttggcggaataggaacagctccagtctacagctcccagcgtgagcgacgcagaagacgggtgatttctgcatttccaactgagtcagagaaaggtgacagacggcacctggaaaatctggtcactcacactctaatactgagcttttccaatggtcttagcaaacagcacaccaggagatcatatcctgtgccttgctcagatgctcctacgcccacggagcctcgcacattgctagcacagcagtctgagatcaaactgcaaggcggcagcgaggctgggggaggggcacccgccattgcccaggcttgagtaggtactgactttgattttgcctgcatca

SEQ ID NO: 468099 - DNA, 510 bp, Homo sapiens
aatttcacgtctcaccataaaaaatgatggcaagagaaaatgaggaagaaacaaaagtagaaagctgcgataaacccatcggatctcatgagacttattcatatcacaagaatagcacaagaaagaccagcccccatgattcaattacctccttctgggtcccttccacaacagcaggaattctaggagatagaattcaagttgagatttggatggggacacagccaaatcatatcattccacccctggcctctccaaaactcaattcttcacttctgtgcaactgcaggctcaacaccacatggaagcttgccccactctactggtaccaatttactgtattagtccgttttcatgctgctgataaagatatacctgagactggaaaaaaaaagaggtttaattggacttacacttccatgtgactggggaggtctcagaatcatggcaagaggtggaaagcacttcttacatggcagcagcaagagaaaatgaggaggaagcaaaagc

SEQ ID NO: 468100 - DNA, 1577 bp, Homo sapiens
tcccagccagcagcaccatgccggaggcgtgggcgggggatcgcggcaccagccaaatggcatctcgtgtcctgtccctggatggcttaacccaggaaaactcctggatccaagaggagtcagacaaaggaatggtggccttgtgcgtgctgatattctcacagatgagtgagtccgtgctgctgcacatgctccagcctgtgaatccagagctccctacagggcccatcacaggaccggtggacaggctcaaccacttccgaggccattggtccaacaaagacatcttgaggttactggaatgcatggagaataatcgcccatctgatgacaacagcacgtttagctcaactcagtcacacatggactggggaaaagtagcttttaaaaacttttctggtgaaatgtgcagactcaaatggttagagatttcttgcaacttgagaaaattcggcactttgaaagaattagtcctggaagctaagaaatgtgttaaaaagatgaacaaaagccaaaaatacaggaacggtccagactttccaaagaggccccttactgcttacaatcgcttcttcaaggagagttggccccagtactcccaaatgtaccctgggatgagaagccaggaactgaccaaaatcctgtcaaagaaatacagggaactcccagagcagatgaaacagaaatatattcaggatttccggaaggaaaagcaagaatttgaggaaaaacttgctcgattcagggaagaacaccctgatttagtccagaaggccaagaaatctagtgtctccaagaggactcaaaacaaagtgcaaaagaagtttcagaaaaatattgaagaagtgaggtctcttccaaaaacggatcgatttttcaagaaggtaaaatttcatggagagcctcagaaaccccccatgaatggataccacaagtttcaccaagattcctggtcaagtaaagagatgcaacatttgtcagtgagggagcgcatggtagagattggcagacgctggcagcgcatcccgcagagccagaaggatcattttaagagccaggctgaggagctgcagaagcaatacaaggtgaaattggatctctggctcaagactttgtcacctgaaaattatgctgcatacaaagaatcgacctatgctaagggtaagaatatggccatgacaggaggcccggaccccaggttgaaacaagcagatccacagtcctcatcagcaaagggtctgcaagaagggtttggggaggggcaagggctccaggctgcaggaacagattcatcacagactatttgggtaaactgtcatgtctccatggaaccagaagagaacaggaagaaagatagagaaaaggaagaaagcagtaactcttcagactgcagcagtggagaagaaatagaagttgataattcatgcaccagtgtcacattgttttaattttttggtttactaatatgtttgaaaatctacctaaagttagtgccttctcagtatacctttattctattaaacatttctggctattttcatacttcgttctcatgaatattagcatcacagaactag

SEQ ID NO: 468101 - DNA, 1165 bp, Homo sapiens
ccaggatctcacatttgcttaagcagcccccacaattggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaacagagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccggaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcagggcaaaggtccctcctactttatccaccagccacaaaactttgtggaatggtcaaggagtgagtccgtgctgctgcacatgccccagcctctgaatccagagctcagtgcagggcccatcactggactgagggacaggctcaaccaattccgagaatggtgaattatttaatgttaaatacaaaattgtgcatttctttagtgtattcatttgaactgctaagaactgttctttaggggaatatagttttctggagattcttgggggttttgtatttttttaatgtgtatatattattcatatattgcaaacatttgaattaataggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaac

SEQ ID NO: 468102 - DNA, 587 bp, Homo sapiens
atccagaagagagagtagagaaacatggattcagacacactgcaaaccttccagagggagctctgttgctttatctgcaggaactacttaacggacacagtcaccattgactgtgggcatagcttttgcaggccctgcctttgtctacgctgggaggaaggccaagctccaaagggctgtcctgtgtgtgggaaaatcccccagaagactgacttcaacaccaatattgttctcaagaagttggcttctcttgcaaggcagcgcagacctcacaacatcaacagctcagagaagcagatctgtgtgctacatgaagaggaaaaggggctcttctgtgaggcagaggagagactcctctgtgggccctgctctgagtcacaagagcatgaggcttatggccacagcccaataggatgggctgctgaggagtgcagggtaagtgacacctccaatgcaaccgggaatccacatgatcctaaatgagagagaaaatgagagcttatgataataaaggtggagagaatggagatggtgaggttctgaattttcaatataaatctctagatataaatgtgtcctaggaacac

SEQ ID NO: 468103 - DNA, 513 bp, Homo sapiens
ctcctgctgtggtctcccagcaacatggaagagaagcccactttcctccctgacaccaccactgggcatgggattccacctgtctccatgagagaagatgggaaataccagtggggaagcagagaggctccccattctccagatttcagaccacaggcccctcaagggaagcatcctggacagcaaagccaggttccatcccaccccctggaagaggtggaagacacagaattgaagtttcgttatggtgatgtcactcaaggatttgaacactcgccaagcaatggtgattggatgctgccagtgctctcaacgagcactttccatggggagggcacgaagatgaaggacagaaccactgcagtcaaggtgctgcaagagtgtcaccattttaagtgtgcaattgagtgcgttgaggacttccacaacctgtaaccatcaccattatctactttcagtacctttccatcttcccaaactgagactgtctcaccatcaaacactaactcccca

SEQ ID NO: 468104 - DNA, 821 bp, Homo sapiens
aggaactgaggcctcctgcccatagacatggaaagttcaactggcttcccctttgaaatacacaaaggctgcacaggtaatgggcttgagccctggtgtttgaagtggcagtccttccagggaacatctggagggctgtgcccctgcacaacaaacgctcggagcacggctggccctcagaggctgcttgcgccaaacatcggggcaggttctgcttttttctttgattttgatgcgtcccaaattctaggatgctcacttgtgtctttctttggtgatggctgccagcccacgagcaagccggtcaaggcggtctctgatttcgacggccgaggaggggacctttcaggaaggggtggccgtaggcgagggttgatcgctgggcctggaatctgctcccacagggcctgtggggcctcacggggctgctgctggcttcagcctctgggtgctgggctggcagggaagattcacctttctcggaaggtgtgaacatgacaaggcgctcgcagttcgtttcttttggtggcagcttagatgtgtaagcagagatatgcgtcccttctaattttgtcatgagttgaacactatacacctttgcaagaaacaaatatgcaactatgccaaaagggaatgatgttatccccttatgccactgccatccccagagggaccccatgtgggctgcctggggacacacactaccctccactccatgttcattcagatgcacacatgctcatgtgtcgagtttttgtggctcctggtttttatatttatttgttctatgtatttatgtttttatttatttatttattttt

SEQ ID NO: 468105 - DNA, 965 bp, Homo sapiens
gatggtgtgacatggcggcctggggggctcaaccaaagggtagagtatgcctgagattttccaggacagaagaaggaaaaagtatgcaaggagagaccataaaaaggtagccatgcctatctctggaaggtgcggcattccacggggtgatggccctcgggccccaggagagggagaggaacctggaggaaaagtggacgcagacaagaccccagtggaacgggccggacagcaggcaccccaggacattgcctgcagcaaagggggtttaggtttcagagcgcacgcacatcagagggaccacatcaagcgcctgcagcttccaggtgtgaataaacctatggggagcgctggcgctgggcgtgggccctgggaacggtttagattccgagggctgcttgagattgggctccggctcacagatctgtggggtcctggaggccttgtaagaacactggcttttgctctgagcaagagggtcccagagtacaaaagcacaaaggcagctgcactgagcgggaaggggcgcaggcccgcctcacctccacctgtcctgaccaccacagagatcctgctgagcacagacccatggcaaacctgtggcaggaactggcgacctccagctaggaatggctgtggggggccctggatctggccacctggaccccctgaaccgaggggctgctgcctcaagggtgcccctccgtccttgggccacacgtccactgtggccagttggcctctggttacacccttgtctcctcacgaggccatggggacctcgatgactgccccccacctgggctgggtgctggcctggccctcagaggcgcttcactaagtgcttgctgggcagtgttaaaatgtgagaatcagcaagtactagcaggttgtgagggggacactggcatgagttgagagttttccattcccaatcagaaggatgaaggagaaggaaaagggaa

SEQ ID NO: 468106 - DNA, 1225 bp, Homo sapiens
gcagctgagggctctggcgaataagacacaggcaggtaccaggcaggccatgcacttggcctctcggagtctgctcatggtccccttacccactggtggatcctacagccaggcaggcttcgtgggcctctcacctgtaaaacggaacaacacctggctctccgccttgctgcagggataactgcaggccactccccggggtgaggccttgatacctccaagttgaggcgaacagactgaatgtgactcaactggaagtctctgtcttgactccccgccaccagatactggcgggtgacttcctcccctatgagccgcgggatactggcgggtgacttcctctcctatgagccgccactggatactggcgggtgacttcctctcctatgagccgccgctggatactggcaggtgacttcctctcctatgagctgccaccggatactggcgggtgacttcctctcctatgagctgccaccggatactggcaggacaccagggtcatgcccgcaaactgcgcacttgtatcctcacttccacagagctttgtctgaagaggagacatgtagggtcaatttccaccccaagacatgacgtccaggacagttctgggcacttggtgtcagccatcactaccaccaccaccatggccagaggatttcaagcactcagcaaatggtgctggccaggcctgtcctgggatttcctaaccatctcggacagaagaaagaaaaaagacattgtggaaaggtggctgagcttttggagagaaaagaccctccctttgggcatgaagtttgaagagccatccacttgtggagtctgggactcatccttctccacgaaaggtttatgaagcagacagaggccagggcttctgagaatttccaacctcgatattttcactttatggtttttcacgaagtcagcatgaacacggttaatgttttctcattaagctactttttgttttctttcagtagctgacattcaaagcctgggcgcattctttcacgacgttgctactctgacagctcaacacattcgcgatgggaactcatatctgttttgatgagggagaccagagggaaaagagcattcacgtacagaaataccctttgtggctacttctgtcagctcctgtcctcacagctctctcggtcccacgctaccctgcagttcttattttctgataaagacttttaccacacccagaagtttctcc

SEQ ID NO: 468107 - DNA, 3727 bp, Homo sapiens
cagcctgtaacttgggtgcaagggatcaggcacagttaatgtgataaccttgcaaacctctgctttgtaccccgcaaccctgatgcaccagatggacattgatggggagtgtctgcagatctaacgggagctcagcttcacgttcgacttgggtggcagctatgccatgtggaactgtaaagattctggccactcggtctgtgggccttgttatgacatcctgagcaggggactgcatcctgtgggccagtcattcccctcctacttgtgggggctggtaaacctgcaggttggagctgccctttggagagaggcgtcccctggggacagaggatgggatgctagcctgtccatagagagaaaccccggtgctcctggggttcccaccccgtcgcactgccagggctacgggaaggatgcttgcttgccccctcccatggcaggtactccatgcgcctttggtttgcagcagcagaaatcaggggtgaccaggggcaggcccgatgtcaccaccctcttcacatcatcactggcagggccaactgggcacagcctggacaggttctcagagcccctcagcttcttcctgcagggaccccctaggaaggagaagaccccttccacacttgatgccaggcttcttattacacagaccctactgcctcaaaggcctcaagtgaccccggactcactcacgccctgcaagcaggggaactgtcagcatctggctagggccatgtcagctgcgatgggctggggcgagctacagtccctggagctggcagagctggccttcaaggccaaaacctcatcctccctgtgcagcctcttggtgcagcctccaatcaggccctggggagggcaacagcttggagatgcggcctctgccttcagcggtttacacctggctggggagacaaagcaacgacacaggaaacaaagagttaaaagagggctggcccagaaaggggaccccagcagcaagaaggtggctccctggctgtcctcctgtcaccccgatgactggcctacgcacggccaatggggactgagcagggggcgtcggggaggttttggaggaagtcacttactgtgcatggaactgggccggaccggtggttctcacctggccacacagaagactcacctgggacagttttgcaagaagacgaaggccacccactgccactttggcggaatccatctgggaagcaacgcgtgcggcccgctaagcccccgtgggccctcggagcagacgtggcctcctctggccctctgcgtgcagcacagtccagctcaataggaagagagggttttcctggctatcttatttatttttccacatgaattttaccattgctttgtctggttagagaaaaagaagctatttgtattttcaatggggtcaagttgactttgaaaattaacagtgagaattggcttctagaatttgggttgtttttccaattgtttattttcctttgtgttcttcaatagttcttaagagttttaaaagatagagatcttaaaaattccttttatgcttattcctatcattttatcttttaaaaaaattaactgagaagcagattctggattgtgtgtggtgtgtgtgtgtgcacgtgtgtgtgtgtgaaagctactgattttttaatatagtctgctcccttagtgatgcatttgattgcttataatagcctttcaatgtattttggggggttttccaggaatataaggatatcacctgcaaatactaagactttttcttcttttccatttttatactttgaatttatttgccttttctggttgtatttgctagtaattctgcaacaattaaataacagtgttgataatgattgttgctgtcttagtggcaatacctttcatgtttcttgtattaagaggaagctggctgagatggaaatattttgttagattaaagatagttccatctattcttttttattgagtgtttaaccaggaatttttcaaatgtttttcaactatggaaacaatcatttgattacctcccctgaagtcaattaatacaatcaattttattaacatatttcccagtgtgaatgtagtcttcttttcatgtgcttctgaattctatttgtttatattttactttggattttccccttgatatttataagaaattttatccaaagctcccatcaagttttggtatcaatgttatacttgctttataaaaataattaaaaaaattttcttccttgttgtatgctcaagttttaaacagcattgggatgaaaggtttaggagctattccctgtgaacctcctgggcctggttcctttttggggttgaaggtcctaaaatttgccattaaaaacaatgccataatgaatatccttcctatctatgcttgtacacttacacgggtttttcagttaagctaattcatagatgcatagttgctatcaaagatcagccacaatttaaaatgtgatcaataggtccttatagtccctatccctcccatggaggctgaatcaatttgtgctctctccaatagtgacattgggtattttcaaccttttttgtcttcgccaatctgacagacaaagcaaaaacaaaactcaaaattattatattattggtttaaaaaatgcacagtttttaaaccagttatgaggttgggcgcttttttatatttttactggtaactgaatttccttctctttgaattgcctgctcatgtctttcccatagttttccaacaggtttctctccttttcttcattgcttttcaagagctttttatatagtagggatccacaaacattccactgggtccataatcctaggccagccatgcgttgtcctggtggatggactttattataaaaattatgtagctgctctacagtacctaagttcactctactgggcagaggccgaactgcagatgattcagccttgggtcatgcagagaacttgaactcgtcaatcgaagatccagaactgacttgaggaacttgactcaactatcctgtgtccagttccagcaagctctttataggactggaaaaagtgtccatggctagagaactcccacagatggggaaacataccacacatccacattcacggttttaagagcccattgtgacagcagccaggggggagaactgagggccacactatgtccttcataactcaccatctgggccccatttggaaaagcctaggcgaagtacagtcattggttcattgtcatggttcacatcccagcgaatcccagtggagtgggtgctgagtgtgtgatacttggaggaagagttgttgcaacggatgtcaacgtgcaggctgaacacggcgacatgggcccgatgttcagcaataacaaatgcaggctactggggagcttaggggcaggaatcctgcttctcttaacagagaatgtggccaagcctcttccatgtcagacttctcatctaacgacattgagcttttgatatatgaacattatttttaaggctaaaaccagatgtcacaatttttcagagtatttgctaggaatatcaccctgacttgttgcaagggaagtttcctcattgtgagactgagagattaaattctattttatgtgtctggaggaagccatctgccttcggcttttgttaagggcttctttctgcctcctttactttcagcatttcatgtttatgtgcatatgttaaaatttcaagatgac

SEQ ID NO: 468108 - DNA, 928 bp, Homo sapiens
accacaccttccatggatattagagggcttcctggaggaggtgtcagttgaggagaccctaggaaggtaggactcagtccagtgatgaagaggagccatgaaatccaagggggagaaattggcacccaaggctactggagatcttatgagaccatttctttcattgaaggtcctccaaaagaatgctgcagcttcagacacagcctatgctctgtccatgcaatacaaccaaacttaccaggccctcaatggattggatggtgcccactcacactgcgtgacggtcaatcttctttacacaatccactgattccaacgccaatgtcttctggaaacaccttcacagacacacccaggaataatgctttactactgtctgagtatcccttaacctggtcaagaacttgtagcaataacagcgaggcattctgccctgtctctgactctagtggaaatgtgtttagtggtcggtcactgagtacaaaggtggttgctagtttcaaatggatattttcatcatggcaaggaagtatcctgctggtcttcacttactaagaatttccttttcttttcaaatcagaaataaatattgaattttataaaatgtctctttggaaattattcaaatgatagcagggatttttcctccttttggcccattaatgagaggaattattagtagattgtctaatactgagccctgctccctttctttgaataaaacctgactgtttatgctctatgccttcaaatattctgttggactttgcattattttatttgaaatcttatgttgtgaatttatgaatctatgtttacaaattaggtatgtctgcagttttctgtggtgtgaatagtgaaactcttcatcctgtttttcagtaagagtggtctacatcgtatagggatgactgataacttgagggct

SEQ ID NO: 468109 - DNA, 2043 bp, Homo sapiens
ccgctgcccagttagactccttcccattgccttctgccaaggaaattcagagacagaccccgcaggcatgtatggaacgagcacagaacaactggcagccctgaaggaggatctggggacagggaaggggctcgaacggtcctctgctcccatttttcagcccttcctcggacccagaacagcagaccagaatcacctttcacccatggaaaggggctggcactccagggatctgtcctgcttgctttgggcggtcactagatccctctgccacatttagggtcactcctcagagcacatgacccctctggaatcctgaagctgcccaggtgaggtggtagcaacacagcagtgcatagaggttgcgcccctgggagggccctgggcagggaaacgggagcctgggctctaggtcccgctcctccacttgcagtcccatcacattgggctcctcatctagaactgcgggatgaccctcactttcctgcttcccgactatggagaggcacaggaagcaaatcctaggcctgaaacacccgataccccaaatcctaggcctgaaacacccgataccccaaatcctaggcctgaaatccctgatgccccaaatcctaggtctgaaacccctgataccccgaatcctaggcctgaaatccctgatgccccaaatcctaggcctgaaacacccgataccccaaatcctaggtctgaaatccccgataccccaaatcctaggcctgaaatccccaatgccccaaatcctaggcctgaaatccctgatgccccaaatcctaggcctgaaacacccgataccccaaatcctaggcctgaaacccccgataccccaaatcctaggcctgaaatccccgatgccccaaatcctaggcctgaaatccccgatgccccaaatcctaggcctgaaatccccgatgccccaaatcctaggcctgaaatccccgatgccctaaatcctaggcctgaaacccacgatgccccaaatcctaggcctgacacaccccataccccaaatcctaggcctgaaacccctgatgccgcagtcctaactccgggaagcaaataaagacttcctgccagaggacttagaaagtgggagcgtttactgatgctctttctgctcattggtcattattgtgcttctcaacagtatcaaacagtgaaacttaagagtttgagcggccttgcctcctggatcttgtctttgcctttagaattgtaattataggatgtgtgtgatttttttcccacttaacatgtcgtgaatattttccatgtctatgtaatcctttaaaagctatttacaatgattacataatgtttgggacgtgtcatgatttgctttccattttacctcctgttagatgccaaggtcatagggtggagtctcagacccaccccagcctggtttatcatttcattgccctcagcaggagccacgccgaagtgtcagatgtacctcacctgcctcttcctcctgaaggatcttaggctttcagcacaggaggggggttagggatcttctgttcccatccttttattttctcagctgagaaaactcaagaccttgtccaagatcacagggcaatttatttacatatatgtatgcatcatatacctgtgtttgttgatgttgctgttgtaagtggcatctttttaagacttgtgtttgctagttgttgctgctttatagaaatgcaattgaggtttatatgctggttttgtacccacccactttatttaaatgtcttattgataattttccataggttcttttcaggtttctatgtagacagtattttcatttgtaactaagaagagttttctgtgtctttcttcctttatattttcttttcatgtcttactgcacagcagaatgtaatgcccctttttatgctggagcttttctttgctccaaagttgactttgtctgaaattaatgtagctactcaacacacagcgagtttttaattttagtaattacatttttcatttctagaaattctgccttttttcaaaacttgttgg

SEQ ID NO: 468110 - DNA, 800 bp, Homo sapiens
atacaaggcccaagggaatgctgccagctaagagtgggtgccgggctgcaaacatcacagttgcccctttcttcctgcccactgctgctcccggtgacgctcagcgatgtccgtcagcatgactgagacctacgtccagaaccccgcatcgcccccgcttcagcctcgctctgtggtgctgctggcctctccgtggctgctcttcctcctccccgcttgcccctcacctggctctccccatcttggccagggcaggcctggcacagactctgtccaggccacttctcttttaaggctcccccaagcccacagttcaactcccacgtccttagcatgctcgggaaagatgccctgctctgggacttggcagtggccgccctgcctgcttctcctcctccttcagtccctgcccagccaccactctgcctccttgctaggccttgggaaatcgggcacacttctcattcaagcccatggcactgactgctttctgtacccggagcagtcctcccctggggagtcccactacctccctgcagttgtaagctcctcacagcggccttcctgggctgccctgcagacaacggtgtccccatcaccctggagcctttgcccctgcttcattctctccatagagctgtgctccaccgggcgttctgttacctgcggactatggctttcaaatccatctcccttaccggaaatgcaaggtacgtgatggcagagactagaacagtgcctgctcctgcaacatgcttgtgctgggctggaaggtgaccccacagagtccatggcctttt

SEQ ID NO: 468111 - DNA, 734 bp, Homo sapiens
tcttaaaaagatgccacttacaacagcaacatcaacaaacacaggatttggggcatcagggatttcaggcctaggattcggggtatcaggggtttcagacctaggatttggggcatcagggatttcaggcctaggatttggggtatcgggtgtttcaggcctaggatttggggtatcgggtgtttcaggcctaggatttgcttcctgtcaaggaagaggccagccaggtcccagccatgtctccggccttgaccttgggctagtcctctgtatgccaggtccagaccctctgcttaagtccaagagaacgcaccaagtcattcatgaaggattcgcctccatgacccaaacaactcccaccaggaccctcctccaagcttgggggtctaattccaacatgggatttggagaagacatgggaactgtacccaaaacatggcagctggatgcttctgaacacactgacggtggctgctaccaagagggagagcgaagtcacaacaataccggcctgcaggttcacctccccataccaggcactttacagcaccatttccaattcccgggaaacagggccacaaacataggaggcaagactccattccagtatgaggatgctttttgatctaccggttacatgataagaataaagactttcctaaagcgactttatgtggtgccgttaaaagaacacaaacctaggctcacacataatgccacatctgggaaatgac

SEQ ID NO: 468112 - DNA, 745 bp, Homo sapiens
tccccggttgccagatcagtgctgtagccagaactactcgttcctctgccccctggtctgaagccatccctgacaatggtgtgggggcaaggagggagccaagctcttgttcttccagggcctgccccctgggcacagcacttactctcacagatgttctgcgggctttacacaaatcatggagctggcatcttcttggcttctggggagacctagggaagcttacgatcatggcagaagatctcacaagaactcactatcacaaagacagcaccaagccatgagggatctgcctccaggaccccgacacctcccagcaggcctgacctccagcattgaggattacagttcaacacgagatgtgggcaaggacaaatatctgaactatgtcaccacagaactcaggaagttcagccagggcctcgttgctgtttctcaggaacgccaagcaaaagtgcacccaggatgcctgcacctgcagatcctgctgcgggaactcgctgtccccgactcccctcagcctctgtgcggcatcaccttgctggggggagagcccatgcaggccacgccttgttccctgtcacacccgtgcctggaacagtgcctggcacaggcaaggcacactggggtgctgagctgagtgattgaatgaacaaataaatagatgtttccactcgcctttcctgagccctactgtgtgcatgactctgcactccaggctatggggcagccaggcaggggtgcc

SEQ ID NO: 468113 - DNA, 1044 bp, Homo sapiens
cagtctgagtaatgcgccttcaatgcttctcaggagccgctggctcggccgggataaagcagcccccacgctttctcaggccccggcccgggatgaaagctgcccgcgccgccgggcagccaccgcgccacctggtccacgggccggggccagttcggccggcagggctggtggccggccccttccctgctctcacccccaatcgtaggcccgggaggacctctgcggctgtcactcactgtgcccagaggaagaacaaggccagtcttccagatagctgggccctggagggacccaagaagagcctgtctccaagggcctgtgctgctccggcatccttttcctggggaaatcaagacgccacctcagggcctcttggccagtgtggagcctctgcctgggcaccaggacccaatattctcacaggccttcatgcctgcccccataagcctgagtatagacaaactggcaagatgggctctgaggctgtgtgccagctggagatgcaagattgggtcacccgaatcaagggtgatgataaaacctgtccctccaaattaggccagagcccccggagccccgctgattacagcctgtgcaccgaggacaaagggtccctctagggtcattaatatggattgaggcccattgttttctcaaattaggccacagggagcgcttcttggggaagcacatagcgggtcatgccgctgctccatagaaaacagaccgggggtgaggcaggatattgctgggggaccccttagtggatagaatgatcagaaaaatggaggctcccagaggacgagggtaccgagagggatcggagtccccacccctggggaggacttgcacccccgcctccacccctgtgctgagcccaagcctctgcaagtccctggggacctgcctcctgcaccctgaccgcctgctcctgtctttcctcactcacacctctgctcagggctgggctggcgtcttctctccccagatggatgtgttttaatatttcacaaaggaatatgttcctaaaaaatagcaatt

SEQ ID NO: 468114 - DNA, 2198 bp, Homo sapiens
atcccagatcacgtgtcccttccggggaagctgcctctgacttccctggctaaggccacccccatgtcccccaggggcctcttctataggagcagcaatgccacacagggctgtcttctaacatctgactgaggatttttaaaggctgcttgcaattccgtcatgcagaggtttgatgatttcaccagtatcaacagacatgcagaccattgccagttttctggtattacagcccctgacacccctggatgtatcatctttgcaccgggttggaacattccttcccatggacaaggagtacagccaccaagccttgagatgctgtgctgcaaatgcccggaaatgtgcatcagcctggctggggcaggcctgacggctcctaaccgcagctggcagcaggccctcactggcagcactggggcccctggaagcagcaagcccagtggaaaaaacctggactttgacaccagacagcctggattcaaatcttggcctttgcctctggtagctgtggacttctggcctagtcacttaacccctctgtccctcagtttcctcgtctatacatatgggggcaagaatagcacctacttaatgagggcataatgaatattacaggaaagacgtctgccttcagcgacatggaagtacagattagctctatgcctttcctctatgcaacgttcagaaatgttgtatacattttaactaacatccttttcagtgcatagctaaggggcacgagaaaacaagggaaatctctgcggtgtggaaataaagacagaattaaagcgaagggtgggaagtttgtggggtgaggccgcagaagacctgggagggatcgctggttgtggttccccggaggctgcagccgtgctcaacagccaggaaggggccagggatgaggctcctgtcccatgtggggcagagtcagagctgagcaccccatggggagccagtgttcacaaagtgcctccctctcaggacacgggtaaaggaggtaagtctgcccactggctcagggaaatgaaatgaagttgacaggggaagaaaaacctctctactaggaacccatcatcattggtctgtcttcagactgcattcagattgaaatgcctctatttaccttatggcctggtaactctcaagtcaagaaattaccatagagagtgagcctgaaccagtgacccatggggcatctagaagaatcaaacccaaaacctcaccagagagacttcaggaccatctgggatttctataaataaagtccatcggaagatgagctcacaataataaattacaaacacaaaggaactgatcaccaggagtagaatcagcatgcatgggtttaaaacctcaaaggcactgatgtttgcaggtgaagacgatagaataatacatttttaatgttcaaggaactacaaggaggagttgaaaacacggaaatggcaagtcatcatgaagatgaaatagacatgtttcaaaatgaaccaaatagaatttctaaaaattaaaagttaaattaaagctccatgtcttgagacttctttgtttgggccatggtcgtgaaaagggttgggttaattcacccattgaaacaactagaaaatgagataaaatggacgaaataacgatttttttaaacacaatgccaacaggtagagcaggactggggcccccgggagagggaaacacacaaagtgggtatgacaaccactctggcttccacctagtggcaagtttctggagaaagaaagaaggaggggcacaggagcaaagcatggtggccccagtgttgaggactcataaattcatctgatagaaaagtaaagcagatgacatgccaaggagcccaattaggctgacagtaaaaatagaaaccagaaaacaacagaaatgatacaaaggttgagaaaaaatgatgatcaaatggtgcttatatagctgatacactatccttcaagagcaagggtgacataaagacatgtttggacccaaaatattaatagaatttaccacttactttgacagatgagtgggtttttaaaaatgtggtgtatatatacgacatttattatatataatgtattatatatgtacaatatatgatatatactatattataatgatatgtactatattacatataatatataataaatacataatatattctaaatgcaatatacaatataaat

SEQ ID NO: 468115 - DNA, 1388 bp, Homo sapiens
tgctgacagctttaagtttacatagaattccggacggtatgtccagcaaaggctctatagttctggcctgcagtggcagcctggacaccttctgcatcctcgtgtggctgaaggaacaaggctatgacgtcattgcctacctggccagcattggccagaaggaagacttccaggaagccaggaagaaggcactgaagcctggggccaaaaagatgttaattgaggatgtcaacagggagtttgtggaggagttcatctggccggccatgcagtccagcacactgtatgaggaccgctacctcctgggaacctctctcgccaggccctgcatcacccacaaacaagtggaagtcgcccagcgggagggggccaaatatgtgtcccacggcaccacgggaaaggggaatgatcagggccacagtgacctgacggaatatgcaaagcaacgcgggattcccaccccggtcactcccaagaacccgtggagcatggacgagaacctcatgcacatcagctgcgaggctggaatcctggagaatcccgagaaccaagcgcctccagctctctacacgaagacccaggacccggccaaaacccccaacacccctgacattctcgagatcgagttcaaaaaaggggtccccgtgaaggtgaccaacgtcaaggatagtgccacccaccagacctccttggagctcttcatgtacctgaacgaagtcgcgggcaagcacagcgtgggcaatattgccatcgtggagaaccgtttcattggaacgaagtcccgaggtatctaccgggccccagcaggcaccatcctttgctacgctcatttagacatcgaggccttcaccatgtaccgggaagtgcacaaaatcaaacaatgccggggcttgaaatttgctgagctggtagcaaggtcactgcaaaatagacccccgtacaaggaggagctggggcctcctcaatttgcagatcgcccaagtaaaggcgctaattgttgtgataatttgtacttgtgactagttctccccggctggcagcatagtggggctgccaggccccagctttgttccctggtccccttgaagcctgcaaacgtcgtcatcgaagggaaggatggggggcagctgcggtggagagctgtaaaatgacaaaagatacactagtcaaaaaaatgaaattataccgtacatatcaacttattaactaagttaataataacccaatcatgtatttttatattgatgaatacatacataaacatgtctgcttcctcattttttatttttttacttacattaatgattttgttgtgtgaatactaccacagtttattgaaccaatcttctctcattggagagttaaattgtttttaagctttgactatt

SEQ ID NO: 468116 - DNA, 881 bp, Homo sapiens
ttaagtcaataggctaagaaggcagttacagtgttggctggggtgactgacccagactatcaagatgcaatcagtctactactccacaacggaggtcaatgggaaactacaacagcccaacagccttgccaatccaggcaggactacaaatgacccagacccctcaggaatgaaggtttgtgccactccaccaggaaaaaaaccacaacctgctgaggtgcttgctgaagataaaaggaatacagaatgggtagtagaagctccttccccaactaaccacgaccctcgcaacactcacctcacttcccccttaaatgttggccctactaagcaggaggcagttcctcgcgcagaaagatacaacttcctcttcaagggagatcagttggagacccaagtgtgtgttttggaagtgagaggaaggtgcctgcggagggagaggctaaagggagaagaaaggaggatgtgggtggaaaaaagattagaaggaggaacctcagtcaactggcctgttgtgcagaaagttctcaagcctggtgccaagagtactgggaaccacgaattcccttctcgcccctgcgtctttgaagctgacccctggaagagcagaaatccttggctcgggttctggagtggatgggagacagtttactgataaacttattaaaaattttgaagagggttgaagaatttggaaatttgtagagaaatctgttggttgctataatgtttgggaatacattggcatttagtaggcaaaagatgataaatattctataattctgggacaatttcccacaataaaaatggtctcatacctcacacaacttcaaatgacctgcaacactgtttagtaaaattccttgaaatgtgagataatc

SEQ ID NO: 468117 - DNA, 668 bp, Homo sapiens
ctgcagctggaatatatgctaatcaccttggaatcaattgcaatttctgccaaaagaatcattggcctcctacccaaggaggtacttttgaacaaactgaaggacctgaggcagttggaagagaaagtttcagttagacgaacagccaaagggcacccatatcaaagtccaggggctgagctgacttcagttgagaattctacccacagggacagaagtcctgggaagtttccacgtatactcaagaggcccaggctaatggtatgtgaacttcccacaaagactcctaggtctgagaaatgttatcttgcagtgcttgtttctggaatgcagctttacccatcatctacaaaagcagctctttacagagtcctcttaatcatcagtggggttgttagatttgttcctcttcatggaatgaaaaacgtgtaacagtttaccatagcagtgttgattctgaggcaggggtgggggtcagggagacaaagataatgagagaatagtggagaattacgtgagaaattttaaagaacacatgtgaaggggtaggctccaagctcttaaaaggatgctgcatcatgcttatatgtctttgtgcttttatcaaagttgaataaagctttaaaatgttttcagtgaattgctaatttatgatttctgaaatcatt

SEQ ID NO: 468118 - DNA, 1853 bp, Homo sapiens
acagatgtggagccagaaagggtatggagtgggaaggtggtcttcccctggaaatgggccgcccagtggctggcctctcctctgactgcccctggctgaccaaccctcagcgtctgcattgttccaccgtcgctggtcagccagcacctgctggtgtctgccgttttccacattattctatttattgcaaacagcctggtcagaggtgtttgggttgtggggtggattcctcatggcttggtgctatccttgcaatagtgagcaaaggcaataaagttgggtatacaaagcatcatcctgtcatcaaatggaaacgatatatacaatatctggcttcagcaggtcctcaaggtacacataagttgcatgagcaagtgactccaattcatatgtacactttttctgcaatatccctgcctctgtctcagtccacatctgtggtctcctgaggccttcagtggcttagataatgaccaccacactggggagggtaacctactttacttatttcaccaattcaaatgctaatcttatctgaaaatatcctcaagcagacatccagaaacaatgcctaatctgagacccctattactagttaacacataaaattaagcaacacaggacatcatagccaaaattttaatacattcagtttttactccaaatagtgttgactgttatctaacactgtataaaatcaatttcctcatttcagaaggatttatgatacactgtttgaactattatgtgttacattgacattttctaaccaaatttgtaatttgtattttaagcatgataataaagcatattattattagttatcacatcttttacttggtcttatcaattctgaaatgtcattactgtattcatccattcacagaagataaacactttcttccctttatgcttcttagttatttcacaatacttctagcctcattgtacataatgacttcgttaggaaactttgtgtgaaactttcctgctgttctgtagcctaaatcagaaaggtacaaaagcactgatcagagctgtaaatagaaattgcttgttgattacacattatgaaaaagcttagttatggtgtatttttacaatattattatatctgacttttatcactttaaaatgtttctggaactatttctatgtagctatataatcattaatttctcatatattgcatttaaattgcagaattcatgaggagctattctttccataataagataatggtgtttatgcattatatgccactctattatttttctctttcagtataatatgcatgaaaaacaatactaatattattaaaattttgacatttgaataaaacatgattttttgtgtgtttccaaacttatgaatgcatataacagagataattttatacacttttttaaatatgccacacgataatatatgtgagtgtgcatttactaccagtgtctctatatctctcattgtacagatgaagaaaatgagaccaggtatgtttgttgattgcttaatgtaccaatttggcctagaatcctcatatattggtaataaaactagtacgtcacagtcaatgaaatcaaaagtcaatttgtttaaatagggcaacacaaagacaaagatataaacctgttggctatcaattttaaaaataagtatgtggtagcttatttgtttacatatttcagtaaagaagaaatagtttactgtttctgaaacttctctataaaagacaaatggcagtttaggggaataatgtatttttaaaaatatatgtaaaaataaaatacggacaatagcaaaggggctgggagagagaacacagaagtacctgctctaatggtactggt

SEQ ID NO: 468119 - DNA, 1829 bp, Homo sapiens
ctgatgtggtttttattttctggagtaaccttaagtgaaacaccatgactaaatcagaggatcctcaccccgtgaccactgccacctcaggcctacaggaagcactgcaggctactgctgatgttcccttaaggctaagggttcctcactcagtttgtggtgaatacttcctggtttgggactcacccttcagggaaatggtctcccctctggcccggagcaggttcagaaatgacatccaagagccaagcacagaatcaagtgccccaaaagcccactttgttctccacacccctgtggctgagctgtttgcaggcaataaatcctgccaggactggttccttcccttcaaggcagctaatttctttatggcccagggagtgtctagaaatgttcaggaactagcagggtggaaagggggtctcatgactctgactggtgccttatactgctttggctgtgctggtatccaagatgcaagacaaagtcctcctcactcttccatctcctctcctcaagcagaagaaagaggtctcaaaaatgaaaagtgacagcatcataatttgtacccatgttgtacccatgaccacattccaaagaaaatgttattaagcaaatagccaaaatatcccctactgctcatatcatgttcaccaagttctagctatgtgcttattcctattctaaactaaaacaagtcaatttttcacattcagcagatgaccacattatttctccccttcctccctaatcccaatgcctcagttttcttcaattatctctcttatctccatattcagagtagaaattctgataagttcaatccaattaatgtacggcattttccagacaagtttttggtttaggtctcctgaactaaatggggtcaattgtgtcgaagggaaaaattttgttgctgttgtcttgtagtgttgcatatttaagagaatgctgtttagctatctctccagaagaacactatgcaaggaaatatgtcctccactagtcattttttttttaccgcaataggaaccaggtatagaagaacacagaaaactgtggaacaaagaaaaagaaagaactttgacctgatgacaatcctgaccctttaatcataacaaacctacagcctaccctaacactttttattgccattaatttttataaaccactttaagggttttctgccacctgcacctaaaagaatcctgatatcaagatttaacaacatgttaggttaatgtaaagatgccttctaattcctggtatgttttaactaccacttgttaatttgcactggcctctacatcccgatgttttttttttcttttcgtttcccatttgaacatgctaccttattgcactcccacatttctctatgtctgttatcatcagtctgcctggtgtctgttgtgcttcttgctgtgattctcactattaatctgtatccaaactcttgctcctcagggattctttgaactttactgatccttaagtttgattcagctatcctcaatctggctattgcgactcacaactcaacaggacacctctcataaaccttcctgctagccatcaaacatttcaaccattttaaagttaaataaaataaaaaaaaacaaaagcacatcatttctagatgatagaatggtaagctaactcagttgctattctttgatcattttagctatgctaagaacattttatgtttatggacctaaagtagaaatttggccagctggaagtacagacagtgcctccttataaatatttaaaattgcattatggattttaaaaatatatgtgtgataaacaatgctaataatgac

SEQ ID NO: 468120 - DNA, 532 bp, Homo sapiens
tcgaaaacttctcctgcaaacagaccttcaacttctccagtgggggggacttggaatggcagcttcattgtctgatgagggcacgcttacggggtttgtagatgatagtcttcttgtatcctcaaatggcagagaaaaaagagagagagaacaaatgctcatgtcttttaatagaggccgtctgcaagctgaggagcaaggaagccagtccaagtcccaaaacctcaaaagtagggaagctgacagtgcagccttcggtctgtggctgaaggcccgagaatccctggcaaaccactggtatgcccagactggtaccagtcacaagtctgggcttccagaacttctgaccacccagcttcaagttggggttcacatgacccccccacttcggacagaagctctatacccattaaacagtagttctccttcccactgtcctgctcacttccatttaccccagccccctggtcacctctttctgtctctgtgaatttgcctgttctaggtttttctttatgcagacatcaaaatg

SEQ ID NO: 468121 - DNA, 537 bp, Homo sapiens
taacgtaacaaggagcctaaaagtttgtcaaagatcagatggttgtggatgtgtggtgttatttctgaggcctcttcaggcccctctgctgcaggtctgctagagtttgctggaggtccactccagaccctgtttgcctgggtatcatcagcggaggctgcagaacagcaaagattgctgcctgctgggaggtgtctcccagtcaggaggcacggggagctggcaggcagggatggacgtttaagtctgctgaagctgctcccacagccgccccttcccccaggtgctctgtcccagggagatggaaattttatctataagcccctgccaggggctgctgtctttttttcagagatgccttgcccagagaggaggagtctagagaggcagtctggctacagcggctttgctgagctttggaggtctccactcagttggaacctccctgtgctttgtttaaactgcgaggggaaaactgcctactcaagcctcaataatggtggtcgtccctcccccgactaagctaaagtgtcccac

SEQ ID NO: 468122 - DNA, 752 bp, Homo sapiens
tgggtcatcaagtcaccatgcgacctgaactgcctatcataaactgggtgctttctggcccatctagccataaagtgggttatgcacagcagcattccatcatcaaatggaagtggtacatacatgatcagtttcgagcaggtcctgaaggcacaaccacccctgtcattgcccaatgggcccatgaacaaagtggccatggtggcaggcatggaggttatgcatggactcagcaacatggacttccactcaccaaggctgacctggctatggccactgctgagtgcccaatttgccagcagcagaaaccaacactgagccctcgatatggcaccattcctcagggtgatcagccagctacctggtggcaggttgattatattggacctcttgcatcacggaaagggcagaggatggtttcagagaataaaatcaaagaaaacagcgaccaaaatgctcagggcatgcttctcttgtcctgtgaggtggacccttcacttctgaaccttcacttcacctttcctgtggctgcctccgaccctggttcctctgtgcccctgtctacaactgtggactcgctcccacaatgtaccctgactcttcacatggggcaggtggttaacctgagatggttctaggttttctgatgtttttactggatgtgttttcttatcctctagacctgtttgctccagtgactaagtcaagctcacccctctcctttcctctgtcagtaaatagattttccagcc

SEQ ID NO: 468123 - DNA, 3508 bp, Homo sapiens
cgacgatctctctgagagacaagtctgtaagagagccgtacatcgtctgtgacattttccagagcgccatgcctcatacaccctacgctctcttcaccgcagaggatcctccgccagggcatgtgtcctgctgctcgcttgatagaaagccaatccctaagacaaggagtattgccaaggaagaaggctttaatcaggtgctgcagctgagtagacgggaaatcagtctcaaatccatctgcctaactgactataatgaaagagctaacattcatgttcttgacaccaacattgtcagctgccagggcattctgactgcctcggtgctgtgcctgctgctctgtgctccagtgagtgaaggcatttggcctgacctccacaggtgtatcactttcccttctacagggaaattctcagttaaagagaaatggcaggtaaatttagatttggatgttcagatttatggctcctccatgactatttctctgtcctgtaaaaatgagtgctttacattcaccggtaagccacacatggaggaaagttattcttatcctaagtgtagcaaacaaacatcaaaataacagtcaacttttcaaatattgctcattgctaatcagcaggaactgtgaattacaactcacagagtaaacagaatcttaattactcctttcatcttgcctgccaagtgatgtctctcatctagaaaatgtaaaaagaaatcatgaattgaaaataagaggactaatgaattgatcagattatatagatcagaaaacagaatatgtaattgtgtaaagagaacactcagatctcttccaggcccatttttaactcaatgtatgactttttaatcaattgggtattttcatatttgccaatttaaggtgaaataatgtctaaggaaggcttaattatgtctctttctttggaagaaaaaagagaagaaagtatttttggcattgttattttattagaggaaagtttttaaaataattgatttatattcatagaaataattatttgtctaactaattttccttacacctgcaaatgtaaaattatttcctgtaatgtgcacaaatataatttttctgggctaatattttaattttttcatgaaatgtattagaaatttgaagaaacatgaaatattttctctacttttcagagaatctattatatgaccaggtgcattaaaaacgcagttaatttttacaataaatatttaacaactgatacgttaaatgataaatcttttctacatctcaatacctgaattgtaatggtgcagaaacattcagtatagaaataatcacatagaccatatctaatattcttactaatttttctgtcaatgctgccagaaaatgctttctactccttttttctgaagtactgataatttcctgatgttacgttaaacaatggcttacaacgaaaattatttatttaggagtaattaaaaaaaatttctttataaagtgtatatattttttttcatttgaaaatgtataatcatggccaagggcatgtatcttttatatgcaactatatattttatgcctttatcaagtatataatttatgaaagcattttctaatgcttattaaaattaccttatacgttatcccagtgccaagaaaaataaaatgataatgggatcattgcggtgtaaatggagtagctgccatgccatctgctgcacatgtccagaatgagtataaaactggcctggtgccaccctcttgggtcccaaggctacgtccatttacttgccagaaaaaaagaattgatttatgttagatatggttttaattttgctgctattaggaacttgtattaaccattactatatttcattatctgaactatttcattttagtttgatttggggatgaaatgaaaataaatatttatatctcagttttaaggccacctttaaggcactaaacagaactgcatgtttgccttgaataaaaaaaacatttttggtcacactcttattatctacaaatattaaatttggtcatttcaactggcattttttcctatgtcctttgttgttgttgtcaccacttcttttccagttacaaacatggcccttgtttttagtactgatatgcttacgacctaacattagccttaaccagtatctttgcctaacaaactaagtctgcacttactccatactcacttcgtagaacaacactaatttctgacattttttttgttgtgcgtatctcaaactgaagatctgcagatacattctgcaggtctcataaaatattatgtacatgtgtgtataattttgcgattttattcaaatatattttttaaagtttgtttttaattggcatattacaattgtacatattaatcgcgtataatgtgatgtttccatacatttttacgttatgtaaaaaatcagattaaaaaaattacacaccttagttattagatttcagtggcagcatttgcctttgtgtatataattatataattccaacatcaacaaatgaaaccaaatgatgtttggcacaatgtatcaataaatgattcatattagtttgaatctagaaaaaaaagcggaaaacaaatataatgtggcacacggtaatatagttatgttgaattcaaaagaatgttctaagtatcagtgtttcagctgtgatccttcatgctagataaaaatctcaattcaaaaactaagaaaaccaaattaaaaaaacctataaaaaatgcaaattcttccttttaatacatccagtattggtgatataatttcagtaaaacaaacattatcatttgtcaaagtcgaatattttcaatttgtttttttctcactttttaatggtttattcattgagtaaaatgatatgttacaataaattatgcaacatcagccatcatgtttaacattcagctggttttaatagcttctctcaggagttattttatctgattatatttataaggtaaaatcttatcacatttctcatatatacacactgtgccagcggattcacactactgatatatgaataaaatcagcttgggatgtgcactggagacaaatcagtgaacacctgtcaaagattattttaataaaggatggtaaaagcatttgtaaaatgcatagaatctttttccataaatagattgatatctaaacatctgttgcataaattatgcttccaaagtttacagtggaacccatgttggcttatttactttattattgcagactgtcctttaacgtaaaatgcacaccattcatttcccttacaactggggttaggtggaagtctcacagagatggtgtgtgcactgtggttggcctgaaacagttaaatcagcttgtaaagacacttcagtgataacaaggttttaaaacatacttcatggaatcggcttcatgtatcatagcatctcatacctgtgatagaacaagcttttagtttttcctttgttttctttacattctttattctcagtgaaacaggttcac

SEQ ID NO: 468124 - DNA, 657 bp, Homo sapiens
gcttattaaactgctctatcctcatgtttggagtgtccttgtccttagtgtccttggctgctcaagactgcttgcttcaattttcatttattttccttatgctgttattcatagcagaagaaaaaaaatctcgtaagcaaagaccattaaataaaagtaacttcactgaaaaacctgtgcttaagaaaggattatctgatctacaatttgggattctgcatgcttttagaagaataagctccaaatctcaggaaagtgacattttactaaatgcaaatagtaatgtaaaggcattaaggaaaatagagaataccatcattggcaatattgaaggcagtagtacagtacagtttgcaacagtaacaggacaatcattgcataaggcagaagggcactacaatgtagtgaattctacattaaatccggtatatattaaaatgattttacactaacatatgttttggtcaaaaatagaatttcagattttaaatcttttccttcaaattttgaagaaactacacctgaaaattatattttcaatcttgctatgaaaataaagtcatctttattatgttattacatatagattatgtgtcccaatttgtccaagagtgtcctttaatgcctgtttttacagcataattattgctagtaccc

SEQ ID NO: 468125 - DNA, 1888 bp, Homo sapiens
tttaataagcaaaaggaatagagctctctggagcagaaaggggtcccagaaagatgggctgccattctacagtgaagtgcaagggtttttgtagacaagctggaggctgcaagctgacagtggagcctcagtggggacaggatccaagcaggtgtgagccaagcacagcctactgggccaagcaagcggagcgaggccagtgggcctccagtgcggcctggacagaggtagtggcagctgcagagatttctggctggcaaagcaacactggaggagtcctgactaaaccaaatgaaggctttgtgcgggcttttgtgatggatagcaaaccaatttcaaatataaaaatatgtagtgataaggacattaacctagccaagaatgatatcagaggaatcatacacattagtttaggcttgtcaaaaggggtctgtattatgaagcaatgcttgaataagagaagtgatttatccatagtctgagttctatgctatctgtgccagcttctgagtagaaaacctctgagagcagtactggttcatcaatgttaagggggggggggaggggagagagagacagcgagtgagcgagcgagcgagcaagcatgtacattatgtttaatgagacaatggttacccaggaaagaatttgtgccatcttctctgctcccagtaaaaataggggcacagtcagttcgggttttataaaagcgttactaactactaattgctatcactcagcatgtcaagtatataggcaatgatgtcaagtatttccatcctttaccaccttattttttccaaactctaagcaatgtccttcaaaattaaacactgaaaacaaaagaaatttctattcaataatattcaagtttaatttcagctttgttatttcaagaacaattgcatctataaatatcgcctaagtgttcactaaaagtcaagtactatctcatactttctttttcactcgtcttcctcactaaaagcagcctaagatgatatttcttctcaattaaaggcaaatccttcttaagagaagctctggttccaactactaaaataatttgttcacctcaatgcacaaataatcattttagatataaaaagagaaaaatttacactggcatgtgggtaagatttcatgaatatgaaaacagtgtttatcattattacttttaaggatatcaatacatttttgaggaaaatatataatttgaatatcttagtacatgtaaaaatgttaagaagcttggaaagttatatattattattgaaatctagtatgtataagtatagttattattaacggatttaaaaaattagaaaaagagaattaaagaactcataataaatggatttatatagttttagcccattttccatgtaggggttagattttgagtttctcattctgtcatctcactgatgttaatctagtacaaacatttttaactattggttctattactttgatactcaagtattctttttatttgtaaataacttttgattccacttactaattacctctatagctttgttcagaattctatttaatccctccaatgagtttttattttcagtgataacggtttgttgctttttaaaaaaatattttaaatctgaattagatttttaaaattatagttatattttaactattattttatttgttaatgttttcaacacagtattcatatcatcataaattatattcaatatcagtgtttaattctgctacttgttttaatgcaaagcctagctcacagtgttttggttttggtttatgtttagaaaattttgattggaaatgcatacaaataaagtaaaaatcaataataatgcatatttagaaataagacatttttcatttgcctgatgtattt

SEQ ID NO: 468126 - DNA, 827 bp, Homo sapiens
gtcccggactcaatcccaagcttcgggtcaaagccctaggaaagaaaactggatctgagggcttcagaggcagatgataacggaagttaaaaggcagcagcgcagattttctggtcagattaagccaagtaaaatgaacttaactcaaagccttgaagacagaaaaacttataaaagtacagcctgcagtattctcattcagaaagaacaacagggcaaaagacctgaagaaggagcatactgcggttttcagaataccatcgaggaggagagagaattcaatcccaggttgaattattctaccataaatgggctgtgttatgttctacaagtttgcctctgtggaaactgctcctgtaaaattgaaggcagagtcggaacagaatattcactacctgtggaaaattcagttcaggagacaggaaagcgaaaggttcctgtaagcatgcacactttttccttgcaaattgaccaaatgactgtcaccctggaaagaatggaacaatacaggattaaaaacaatggcaacaacactggaagaacagtaaatatgacatccccagtagaaatttcagatcaatctaccatcaatggatacaaaataaattagatagaaggaataaaatctagtatttcgtagcacaatgtgatgactgtatttaacaataatttaatgtgtattttaaaatagctaaaaaagtgaaattggaatgttcctaaacaaagaaatgataaatgctttaagtgatgaatatctcagactgatttgatcattacacattgtatgcttgtatcaaaatatcacatatacctctgcataagtacaa

SEQ ID NO: 468127 - DNA, 645 bp, Homo sapiens
cattacttatgcaaataagcaccctctcagacatgctagtggtggcagagattcgagttaccctgagttactggtggtggatccatacaggtctgcagcaacttcagttttgcctcttcagaagaaatgattatactgaggggcatatagcagaaaaagagaccaaggcaagttccaaggcaggagacaaagtttattttaaaaggcttttgaacaggaaagaaaggaaaatttgcttgcaagagacccaagtggacaaaaatgggcatttaaccttgatcctaggactttataggcttgccccttttccaggattcttcttttcagaaaggagatctaacaagagactgcatgaatgctgtagtttgtggaagtggagtctggggagcataaaacaaagaagaatgaaaaataacgcaagtgtcccagaatcttttgaaacaatgtggataacgtgtctcagtactttctacctgagtaaccgaagacgtgagcacacattcacctttttctctactgtggaatgactaacttatgatgtgttcacttctccatgcttctaggctgcacatacatgagtgccacgtgtgttcctagaagcatcctgcacagtggatcagagaagccctggtgtagaaaataggc

SEQ ID NO: 468128 - DNA, 1136 bp, Homo sapiens
tctgcagcttcagccttgaagccagcgagatcatgaatccccaggggaggaatgagcaactccaggcgcgccacgtgcagtgttgtgtcaaaaaaccagttgaagtaaatcccagtagcctcagtcagaagaatggcacctatggacctgcgtcaggcagtggaagcaacaacagtaagcaccacgttaatctcaatagcagagtgcccatagactctgacttctgcagtaactatagcagtaaaagctttgggcaatttgaggctgccaggcctgccttgcctaatgggactatagacttgtggctcctgcaaagcttcagcaatggtgattccaatagatacaacaccacagatactccagaagcctcactggcatatggatcattggctttgggcagtgttccctgttatttttcctggcgtgatgaaaggtggtgtttactatagtttctcctctcttggtaaccacactttttctttctcgcttttttttttttcagcttttattttgggtgcatgggtacatgtagaagcttgttatataggttatatagtgcacgccatgtgggtttggtatacagtttatttcgtcaaccaggtattaagcatagtactcaacaggtattttttctgacactctccaacctcccaccctccaccctcaagtacgccctggtgtctgttgttgctctttatgtcatgtgttctcactgtttaattcccactaataagtgaaaacatgaagtatttggttgttttctgttcctgcattactttccttaggataatgacctccggctccatctaagttactgcaaacgacatgatcccattgttttttatggctgcataatatttcatggtgtatatttgctcaaagttatgcaaagattatttcactttctgacatatattctgaattcacttcactgtacatgtacgaaatatagaagacaatgacctcactttatcggccacagaataaatgcctcaaagatgtattcttaagtgttttgttttgttttgttttgttttcatggctgttgtaaaagagattgctttcttgatttcactctcagtttgaatgtcatcattgtatagaaatagtattcacttctgtacattgatttgata

SEQ ID NO: 468129 - DNA, 2197 bp, Homo sapiens
tcaggaggacaggagccctcctcagtgtgagcccttccccagctccccctgcatcgggagccaggctgatggtggcatgcgaagcggagcagggcatgggtgagtcacctcctcaccagcatctgagccaatacctccttgtccatggctctgctgtggccctggtgtggcccagggactccaatgtccatttccttcagagaggcgagtggaaccttctggttggaggccttgtcagagcagccctgatagacttggggatcccagaggctaaagggagccctggcaaacaacagacccagcttggagtcatggagcctctccaaaggttctgctggatcttaggcatcttctggtcctcccttcctgctctaatgatgaggaacttgagtccagagaagggaagggatgttattcaagtccacacagggactcagaggcagagctggtgtcctgcaccttactccaaggctctcagcagctttgaagcagaggactatgggaggccttgaagactccattatgcgtgggtgcccaggcatttggtcagacattattctggatactgtattggttgaaggtgtgggccctggagccagagtgcctgggttgaagtctcacctctgcctttactgactgtattgaccctgagcaagttccggaatccagccccctcctgtatagagtggaaataatggtagtacccagccctaggtgattgtgtaaccagccatgcgaggtggttttattatccttgcatttcgatggaagcagcagaggttcagagggttaagtgacttactcagagtgacacagccagcagtggccagaaaagtgactacgatctcaggtctctgcccttgacaccacctcggggctgctgaatcctgcctcctggaatcttcctctttccctccacttcctcccgccgctggcacctgattgataaaggcaggaccgaagccttctgctcgccatcctctctcctgacaaggctgcctcttgtcaggtctgaaaggcaagtttacaaggtatatctaaaagcctcctggacaggggagctggtttacatgccttcagggccggttcagtgttctgcttctaatgaaaacagactcccggttcctgagtgagctcagaagagactgtgggctgagagcaggcagagacggttgctgcaaggaggcaccagcctgtccttaatcttgggtgcccacgactcccctgcaagagccccctcctctttatctgctgtctcacctttccagaaacgttacaacacagggtctcaaactggtaggctgtgagtagcccccggccagtagatgagtctgggatgacccaagtggtgacttttttcttttaaagaattgagctaatgtttaaaagtcagatatgtcttaaggaaaaaaattgacttttcagcttctctttaaaaatatttgaagaattgtcagcaactctaatactcatcctaccctgctccacggcaatagccccctctttggagttttctccagggacccacacctcccacctttcccaatgcctctcttttcttagttacatttcctgctggttccctgggggccatctgaatttgagagccccatgctgctgcaggaactggcagcatggacttagtccagtgtgctcattatacagatgagggtgcgtggagacccagagagggaaagtgacttgcccaaggtcacccagaaagttaactgcacataagggactagcaccaggatgtcaactctcagggaagcatctgctcctcaccaaggcctgaacactggggtttccgggtttcccttctttgtggtcccaaggcagccccagcctccttcccgcagccccagcctcctcccggcagcttcattcccacccccaagtcatttgccaaagagagccttgcaaatttacatctgatctcattatgtcactcacttcccagctttgagaggaaagaacattattcctagtctaagcataaagtcagcctccttaggatgacactctgggctggcgctatgtggtccccacctacctatcccacctcatcctgtccctctgtcctaccctgcctgccagcctgtcttgtccattctgtgggaccatttgctcttccccaaacacaaagctgtgcctgttcctctggctggcccatactgctaccttctgcaaatgaaat

SEQ ID NO: 468130 - DNA, 1060 bp, Homo sapiens
ctgcctgtcataaaaccatcagaccttgtgaaatttactcactgtcacgagaacagcacaggaaaacctgccccgtctttcaattacctcccactgggtccctcccatgagacgtggggattatgggagctacaattcaagatgagatttgggtggggggaacagccaaaccgtatcacctgtggagatttataaactacacgtgctgggtcccaatgcccagatctctcctgggatcacagcatctctgtctgcacaggacaggaatcactgtacaaggcactgaagaagcagaggcccagctgaaggccttactcgagtttacttggaaaatagaagcaattggaagagatcttccaccagctccccaggaaatgctactgacccaatcttcaaaatgcgcccaggattccaccaatcctcctcacctccgctgctgctacctggtccaagccagtatctcccatctgggttgctgcagttgcctcctcactggtctccataaggcagctaacattctctgttacatcaacctctctgctcaaaaccatccctccaatggctttcatcttggtcagaggaacagtgcccatgaggtcctctgtgatccaagtcccaccactgccttcctccctctcttccccatgctcagttctttccaggcatgctccttcctgtaggcttttatacttgctattttcctctccctgggacacttttcatgctgatacttatgtggctttttctgtggccaccttcatgtctttgctcaaatgtttactttcacagtgaggccttccctgaatgccccatttagaactgcagtgcttgcccccatagattctttcttccctcttttccccttctttggaacagcattctttaccatttcacatgctatatatttatttgttgtccattttcctccattacaaagtaggctggtgtccattttcctccattagaatgtagtgggttgaattggactctggcccaaaattatgtccaagtcctagcctctggtacctatgatttcgtcttatttggaaataagctcttt

SEQ ID NO: 468131 - DNA, 1208 bp, Homo sapiens
cactattataaggaattattattttttcaatttttcactattatgaggagtactgtactaagcatcatcgacgtgcttccccacctggacctcctcccacccgcttcaccgcccccgccggtgctcctgccttgtgaagacgaggctcctgctccaatgggggcctcacttattgcggacttagagcagctgcacctgcccccgtccccacccccaccacaggcccctgcggagagaccttcagtccagcctgggccggatcccctctggcccgtggaaaaagagctgccgcctcccccagcagagcctgttgagagagaggcgtccacagacatccgtgccttctgccataagactgtgtccccccaggagctggctgtggaggccatgaagaggcagtaccatgtccagttcttcacgtgccgtacctgccgccgccagctggctgggcagagcttctatcagaaggatatgcgacccctctgcgaaccctgctgccaggacacgctgcagaagtgcagcaagtgtggcgaggtggtccgggaccacatcatcagggccccgggccaggccttccaccccgcctgcttcacgtgtgtgacctgcgcccggtgcagcggggatgagagctttgccccgggcagccagaaggaggtgtactgcctggacgacttctacaggaaatttgcccccgtctgcagcatctgtgagaatcccatcattcctcgggatgggaaagatgccttcaaaatcgagtgcactggaagaaacttccatgaaaattgctacaggtatgaggactgcaggatcctcctgtctattgagcccacggaccaaggctgctacccgctcaacaaccatctcttctgcaaggcgtgccacctgaagcagagtgctgcggggtgctgctgagagtgcccgccgggtgtcaggcagtgagcggactactagtcccggctggggccctttcctgacttggtttcccttcctgacctgctcttgcacactttccttctgagcctccatggggaccagcctgcaagtcggcccagcctttccaggacacagtggggctgagcgccgtcagaacttccactcctcctttaccctctgggtctatccagaaggttcctggaccatgagcgtcgcccccagaattccttgctggccccaccccacttccaggggaaagctggggggagtctgcc

SEQ ID NO: 468132 - DNA, 1102 bp, Homo sapiens
ttccttttgtcccccggaggcgggagaaaccagggaacctaagaacgcgcctaagcacacccagcctggagcctttgttcccacatctgcaaaatgtggataacaccacacgtttttttttcccacttggtagggatgcctcttacaattgatggtgtctcccaacgatatctggcagtgtttttctctttcctattgttgaagaaaacagtgataggactgatccgggtcagactggcccagagggcaaaaaagcatttgcttcgaaagccccatcaagaggaaaatctttctactgccagaggggctcttctgggaagcctgagtggagaggtacaggattccaagtgggaactgcagactcagagaatgggcaaggggtcatcgatggaccggagatgggatggtagggacagaaactgcagggtccgcagaaggaactgctcaccgaaagccaacaagcttgccctgtggaatcccagaaaggcccaggaacttcgggacatcactgaaggcagagtgaagagaggaagagaagacagagaaatggaggggagaaaactattaaaataagtaataagaaaactttccccagaagtgcagaatctgaatttccagtataaaagggtccattgagcgccaagaacaatgaaggaaaaaaggtcccactcaggcctacgtatcattgtgaaatttcagaactagagggataaagaaaagatcctaaaagcttcccgagagataaaaaagaagatttttacaaaggatcagcaatcagaattgcctcagactgctcaataaaaacatcagaagctagaagaaaatagaatgaggcatcaaaatcctgagggaaatgattcccacctataatttcatattctgctcaattatcaattgagtattgaagggaaataaagacatttttagacatgcaatactcattcatttaattcttataatgactctgtgtgggaagtgttaggttctatggaaaacagatatttaggaagagatttgcatgcaggaagtggggatgctctcaggaacaaaatctgtggagggcaaaggacaccagattaggcagagggagctgaactgttcc

SEQ ID NO: 468133 - DNA, 794 bp, Homo sapiens
gtgttttgaattccttgtgacttttcagacacacacacacacagtgactaaaatagcatccggcacattgtaagccggcaacaaagattcatcaaagaacgaatgagcttatgttacataaatacctcaactcccaagactctgaaccctcatcggcttggctggcagcaggtctagtcttttacaaatttcccgcgctctcacactgccaaggttcctctagaagtttccgtaagtttgtccctgccattgctctgcactgctgccagcaggtggagggagacattcagtcatgtcccctgagaccagattccacatcccctggtctccctggcagcctccaaggagccattcctgccatgccacctgcacctgctggcatctgcagccacaagtgctgctgcctctttgagctatcatgttgttgctggtcatgccaggagcttagctcaccccttgcagaggcagtttcagtccacaagttgccttggtttcaacctctgcccgtttgtacaggcattttggggctgtcataaataaagctgctatgaatattcgtgtactcatgttttggtggacatgtttttttttttttttgctttgaataaatatctgaggcttgaattgccaattatatggaaagtgtacatatttaactttatagtaaccgacaaactgttttccaaagtggctttaccattttgcattcctgccagcaatgtatgagcatttgtttgctctacatcctcaccagtatttggtatggtcagctaaaacctgtttttatatacaga

SEQ ID NO: 468134 - DNA, 1660 bp, Homo sapiens
ttgtagttttcagctcctcccacgagagattttatggagtgcctaactgtgctacccgggtgctgctcctggttgctgggaagattaaacacaaggtgaagtaaataaagccccagggacataagcaaaaaataatggcttctcacagcaatgctccagaacatacaacaagggaatactgggcccagtcccaggactatccaagtgtgaagccaacaccttttcacatcaactccaagctggtcctgggcacagaggaggctgtgttccatgctgaagacaagaacatatggtggacgtaccatcctaactatctgggaagggagcttcgtggctacatgggagttatcatctgccagtgccggctgcatcctggctgtgcccacctctggactctgaatctctgcacctcagtacccccaaccccaacacgactctgccttcctctggctaactgggacctgcagctgcagctccaagacaatggggcatcccacctggctgcttcggtgcaggcccagtgtgcaaggaacctgggccccaaggaagaggagctaagggccctgtcctaacttgctacatggcctttggcagattgcctccactctctgaggcttcttctggggaaaaacaacagggtggaaattgcagtacatgatgctgttgttctccacttggttgccccagcaatggcccttcttcctcgtggcagaagctggctctagtttctagctcctttcaacgctcccagaaccagcctccctatgccaccttagagtgttcgtgtttagatttttcctctccctctaatacgttttattgaaagtaacttcttttattaaatgacacctctgaaatatgtagtgcagttcctgttctcctggctggaccctgactgatgccatggggaaagccctcgggctcgtggaccttaaattccagcctttgctccccctatttcccatgaccataacccaattctgtctttttcctattttgaactttccagactcagaaatttggctcttcatgttccctgcccttgaaccgtcccagccctctctccaaaacaggcttcatgctggctgcatgggagggaggggtagcaaagtggaaagtgttccagaattagtgctaattctggctttgtcacttactcattgtacttcacctctctgttcttaacttttctctcatacataaaccacacggggttcttgggaagattaaataagaaaacatggtgaaaatgtattgcacagtacttgactcatttaattggtgacagacagtgttttaggtaatggagatacagtggtgctcaaggcaggcaagattcctgctcccaaagaatttaatttccaggagacaagaagcaagctagcaaatgtataagataatagttagggaacagtactcagcaaaaataaaaaatgtatggagagggactgaggggagtgaggaactctttgaggaggtgccactctgagacccaaatgacaagaggaattaaccacatgacattctagaaagagggaaaagagttgctgttaagaagatgtgggtgtgttaaaaaaaaattgcaaagtcccttaggtacgattgagctgctaatgatcaatctgaggcttctgctctgtgtcttataggtaaacggggt

SEQ ID NO: 468135 - DNA, 1575 bp, Homo sapiens
agtgaaagaagcatctcagctgcctcaaatggctgccatggcaaacatagtgctgcgaggagcaggggtggcctgacttgggggtgggcttcaatgcagagctgctcctgctttcggggcaaaattgtgatggaggaaagctgagaggtgagtcatatatgcaggaatgaatgaatgaaggtgatggcagcagcagcccacatggagtggtcactgtgaagatgccagctgcagaaggggaggtgcagttggggctgtgtgctccatggagctactccagcttcctgctggtagcccctccccggaagctgaggaacgagtgggagaaggcctgtagcatcacactggggactaggatttcgacctatggatttgcgggggatgcagacattcagtccataacagggacccttggtgcctgctctagcaactccagcaacaaagaagattgctgttgctcatatcctgtgcaaagacccttgccattcacagcagttcccctggtgtccatgctgcttctgactgctcacttgttgcctctcaccaccctcatgcttgtcatgggcctgtggtcatgtctgtcttaatactttataggtctttgctatagatccagcttagaaattagtcccagtctttctgtagatggtttttgatggacaaggactacatctctcacttcaaagttcctggcacttagcactggctgagcacaaaaaacacactcaaaaccatgagtgttcttggcttcccttcttcactcagccccctttccttcccactcttggtcactgaagatctggccttgtctcctggagcatattctcaggaggcaggggaaagacacgtgaggaatgtgggccttggaatcagatctgggttcaaatcctgtctctactgcttcaggctctggaagcttgggcagctgacctaccatctgtgcccctggaagacagggatgatggaatcaaccttagagagccagtgccaggatgacagaagacaatagatgcagagaaggttgcaccctgcttggccaagtcggtggtgactgctgcagccttcatagttggttagagaagaaaaggcagatgaagtagggggagggtggaatctctgctgttcagtcctgtttccaggtgaacttcaattttatgcattccatttaaaatagaagggatttgtgaaatatataaccataggtgatttgaaatggataaatttgtgaggctttgcctataaatgtgttatacataagactaaaaagatcctcatatctcctctctctctttttttttttttttgcaagtagggttcctgtgttttccatgttatgcccagggtgctctgagccccaggactcagagacccccagatgccttgttgagtgcccctcctatgagcatccttatgcctctgcctccttggcccacaggaaagcaagcagcggcagcctggcatagcttccttccctgactggaagaaaaagcctgatgtattaatgaccacacttaacaggcctcaattttaatctctgctttaaatttggcacaattgtttttacaataaagcctg

SEQ ID NO: 468136 - DNA, 625 bp, Homo sapiens
aaggttaagtttgatggcacaatgaaccatgctcatgagcaaaggagatacatgccatatgtgtgtccgtcattcttgccatcccatttgcatacagaattttcagtgccccatgaacacaaaattctggtggacccacagtacaatacatgggaaaagatactgactatagttgaagaaacagctcctatagaaattaaggatgccaaagacagaataactgagctgggatgtgttaatgcagcaggcacatatacttgtaaacttactgtgatagatggtgaaatagttgaaatggttctgaatcaaggtgattctgatagtagagacgatgaagatgttgttaatgctgcagaaaaaatgcctatagatgacatggtgaaaatgtgtgatgggcttattgaaaaactagaacagcatacatttataacagaacaagaaatcatgtcagtttataaagtcaaaaggaatccctaagacaaaaaccattaataagacatgactccagaggaaacattttaaaagtatccagggaattacttctcattcttagaagactcatttcctagttgctcaactgcttctgatgtttctttttcatctacaaaaataaaatccagtttac

SEQ ID NO: 468137 - DNA, 523 bp, Homo sapiens
tggagatatatccatatccatatccatattcatatccatatccatgtccctttgtcttagaaggttgcagtggataaactctaagtgtcctgagaacactaccatcagccctccgtatctgtgggttccgcatttgtggattcagccactcacagattgggagaaatgggaaattacaaaacccaggttcctggaagagcctgaaagggaaggagaagaggtttatagttcacctgatacagaaaaagataccaccagcttcttgggcatccagcaagaagcagtaaagggaaactttgaccaagacatcttggtaggatttttaaaaaaaatgaataatagagtagaatctgttaccaattcatgtacctggagttgcacaccaaagtgtggtctagcaaaaagactctccaagcttgaaggctgtaggcctgagtgtcctggctcccttcctaaccagcagtttgcctttgggccagtcatttaaactgtctggccctggttgcctccctggggagcagta

SEQ ID NO: 468138 - DNA, 601 bp, Homo sapiens
acttcttttgtggatcttcagttacttcaggccatctggatgtatacgtgcaagtcacaggggatgcgatggcctggcctgggctcagaggcctgacagcacttgctctgtcctgcttcactgtgggcatgacactggacaagattacccttaacaaggcaactttggactccggggaccaaattgctgatcaggccatgagcctcaactccccttctgactgcgggtacaatctgcttctgtctttggaggtgctgtacccaaactacagaatccataacagttccttgctttcctggattccattccacctttcccctaacaagtcccaattccgatgcctcactgacagactgagcttaataaataattgcttaagtctccttttgtcttacctcttggaaaagggcactattccacggcttcaggacttggagatgctaaatcgtcaaccttccattgatcctggagcctctaaggaaccatgtttcacccgaaaagctgaggatgatcacaatggatgtcagctctgttccccggagacaaccagctggggttaaataacaaggcataataattgccttcaggaatgctttcttcc

SEQ ID NO: 468139 - DNA, 783 bp, Homo sapiens
cgagcacacaacctagatccctcacatgtgcagttcacaataaggtttgcactcctatgagaatctaatgccacagctgatctcataggaggcagagcttagacggtgatgcaagtgttagggaatggctgtaaatatagatgaaacttcgcttgctcacccactgttcacctcctgctgtgtggaccagtactggtccatggccctggggttggagacccctgctttagagcttcagaattaccctctgcatagaatgccagtgctgctgtgggatggtggaggggtggtgttgctcattcaagattggttttcctatgtttttagtacctcttttagtgatatgaagttaagaccaggtactatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtgggaagcctttacagagggtgtgacaaaactcaatttgacattttcaagctatgtacaatgatgtgcaccttgcagatgctcaataaagtaattactgacaactcgttagcagttctgtaaaatatctaaaaggggagaatcctaatagttgaaatgaggcttggggactgtgaattgttgccattttcttcttgatcc

SEQ ID NO: 468140 - DNA, 1919 bp, Homo sapiens
cacgagtcataccatcatgacgttttacccaaccatggaagaatttgcagatttcaacacatatgttgcttacatggagtcccaaggcgcacaccgagctggcctcgccaaggtaattccacccaaggaatggaaagccagacagatgtatgatgatattgaagacatcttaatagccactcccctccagcaggtgacctctgggcagggaggtgtgtttactcaataccataaaaagaagaaagccatgagggtggggcagtatcgccacttggcaaacagtaaaaaatatcagactccgccacaccagaattttgcagatttggagcaacgatactggaagagccaccccggtaatccaccaatttatggtgctgatatcagcggctccttatttgaagaaagcactaaacaatggaacctaggacacctgggaacaattctggacctgttggagcaggaatgtggggttgtcatcgagggtgtcaacacaccctacctgtactttggcatgtggaagaccacgtttgcttggcacacggaggacatggacctttacagcatcaactacctgcactttggggagcccaaaacttggtacgtggtgcccccagaacatggtcagcgcctggaatgcctggccagggagctcttcccaggcaattcccggggctgtgagggcttcctgcggcacaaggtggccctcatctcgcctacagttctcaaaaagaatgggatccccttcaatcgcatgactcaggaggctggggagttcatggtgacttttccctatggctaccatgctggcttcaatcacggcttcaactgcgcagaggccatcaactttgccactccacgatggattgattatggtaaagtggcttcacagtgtagctgtggcgaggcgagagtgaccttttccatggatgccttcgtgcgcatcctgcaacccgagagctatgagctctggaaacacaggcaagacttgactgttgtggattacatggagcccagggttgcagaaagccaagagccgagcaactggagggaggacatagcacttaggagagctgctctgggcctgaggcatctccggaaccacataaccagctgtcccacacggactgtggccccaaggctctgttacaacccaaagggcggtggtaccgatgctgtgcctggatctgcaatccaagccctggagacgtcagcctgggttcttcccccttccactggaaggtggggtccttgtcgtggctgtggtcgtggtcgaggtcgtggtcgaggccgtggtcgtcgtcctcgagaactggggactgaggagacaactgttcagtctgcagctaagaggcgcctctcagtggggacagggagcagagctccaggccgcaaacctcagctccagttcgccgatgaagctttgacagacaaacccgcacctttgagcggtggccttccgcattttgcaaaggcttctggctgctgttgtgcccctgatcttcaacccctggggcccccactggatcctgatgaacccatgcaccctggcccctgcctgctatccctcgacagcactgctagtagtcttcctcttgttgtccctatgactcctcccagtgtcactgtgcctttgattacattgtccagggacactggtggagactggaaatccccggtgaatctggccaaggttgtagcaatggaccattcttatgcctctagggtaattgttacaaagatttctgaaaatgtagaagtggctttggaattgggtaatcagcagacgttggaagagtgtggagggcccagaagactataggaggttgagggaaagtttggaacttcctagacacttgttacattgttgtgaccaaaatcatgatagtgatatggaaaatgaattccagtgatctgtggaa

SEQ ID NO: 468141 - DNA, 1982 bp, Homo sapiens
cacgagtcataccatcatgacgttttacccaaccatggaagaatttgcagatttcaacacatatgttgcttacatggagtcccaaggcgcacatcaagctggccttgccaaggtaattccacccaaggaatggaaagccagacagatgtatgatgatatcgaagacatcttaatagccactcccctccagcaggtgacctctgggcagggaggtgtgtttactcaataccataaaaagaagaaagccatgagggtggggcagtatcgccgcttggcaaacagtaaaaaatatcagactccgccacaccagaattttgcagatttggagcaacgatactggaagagccaccccggtaatccaccaatttatggtgctgatatcagcggctccttatttgaagaaagcactaaacaatggaacctaggacacctgggaacaattctggacctgttggagcaggaatgtggggttgtcatcgagggtgtcaacacaccctacctgtactttggcatgtggaagaccacgtttgcctggcacacagaggacatggacctttacagcatcaactacctgcactttggggagcccaaaacttggtacgtggtgcccccagaacatggtcagcacctggaacgcctggccagggagctcttcccagacatttctcggggctgtgaggccttcctgcggcacaaagtggccctcatctcgcctacagttctcaaggaaaatgggattcccttcaattgcatgactcaggaggctggggagttcatggtgacctttccctatggctaccatgctggcttcaatcacggcttcaactgcgcagaagccattaattttgccactccacgatggattgattatggcaaaatggcctctcagtgtagctgtggggagtcgacagtgaccttttccatggacccctttgtgcgcattgtgcaacccgagagttatgagctctggaaacacaggcaagacttggccattgtggaacacacagagcccagggttgcagaaagccaagagctgagcaactggagagatgatatagtacttagaagagctgctctgggcctgaggcttctcccaaacctcacagcccagtgtcccacacagcctgtgtcctcagggcactgttacaacccaaaaggctgtggcactgatgctgtgcctggatccgcattccaaagctctgcatatcatacccagacccagtcacttaccctggggatgtcagccagggttcttctcccttccactggaagctggggttctggtcgtggtcgtggtcgtggtcaaggtcaaggtcgaggttgcagtcgtggtcgtggtcatggttgttgtactcgagaactggggactgaggagccaactgttcagcctgcatccaagaggcgccttttaatgggtacaaggatggtggccttcagcatcttgccaaggcttctggctgctgctgtgtccctgatcttcaactcctggggcccccactggatcgtgatgaaaccatgcaccctggcctgtgcctgctatccctcaacagcactactaggacactggtggggactggaactgattaagttcaccagggacacttgcctggtgaacatgggcaaggctgtagcaatggaccacttttacggctctagggttctgactccaactaagttttccagaatctcctgggctcctgactcatctgctgggtctaaagacactgagtttagggatattttcctccaatacatgatcaatcctctggatccacggctatggaatatggtgacaaatgtcagtgtctctcttattccaaccccaggatcagagaagattctttacctgcagtggggcctggtgggagatgactggatcatgggggtggtttgtcatgaatgatttagcactatctccatagtgctattcttgtgatacagttctaggaggatctggttgtttaaaagtgtgtacgaccgtc

SEQ ID NO: 468142 - DNA, 570 bp, Homo sapiens
ccttctcctcttttccatggaatatctagggcagggaagacagcattgttatgggagatgacagctccatgcatggtactgcccctgaagaccttccaatgggacatgatgtggaggtggaagacagtgatattgacctgacgcctctctctgaggaagacatgacactggacgacccagatcccacatcaaggaaggacttgctgccgagtcatgaggaaagcgtcaggaggcagcatgtggctgtggctgtcagctccacatccagcgactggcaccaaagcctaatccagagcaatgctctaactttcttcaattctgtggaggctgaaagaggtgaagaagctgaaggagaaaaatttgaagcaagcagatgttggttcatgaagtttaaggaaagaagccaccttcctaacatgaaagtgcaaggcaaagcagcaagtgctgatgtagaagctgcagaagttatccgggatatctaagataactgatgaagtcatctacactaaacaacatattttcaatgtaaacaaaacagccttctataagaggaagatgccatctaggact

SEQ ID NO: 468143 - DNA, 737 bp, Homo sapiens
gagataggacattccatcctcatgcctgtcatgtatggtcaaagctttctgaaagatttggcatataagttaaataatactgtcacttatctcctcttccctatcctgtttcagaaggatgggttgagattcaagacttttgaacaaatctgttctaagacaaataaacaccatattgagacccgtgaacaccgtgataattgctccatgccctctcttctccacttgacactggctgttgctgctgctgcccctactcacaccagaacttggaggcttggcctttgcttacttgagagcctgactggtttcccagggtcctactctctcctggctgcagggatgagaatgctactctcctgtgcactctctgagtgggcccaggtcctcctgattgcgacacaagcctacacctgtcctaggttttgggattgggtgggctacgtgtgcgtagccttgagctggcctccaactgacaggggctatggcttcttaccctgaagtccattttgtttctactctcttaattcatttgctgacattgaaaaaagatagaaaaagaaaataaattacaaatagctttattaaatgcattataataaaaagagctaatatttattgagtgcttttcatgtgttagattataacattatgtcagtcatcttaaaacaatcctgtaagacaggtactattacttccctcatctttcagatggagaactgaagctaagacaagtt

SEQ ID NO: 468144 - DNA, 1039 bp, Homo sapiens
cagtctacaattacccaatccttttagaatctcataattatgggctacattttaacgcactgttctttgctctctgccctgacaaacacacaatattcaaataggaatgatggtgagaagaataagccagaggaacagagtagtttccagccttcctgcagcaccttcttgactgcatctctggagagcagactgggtttctccaaggttcctctgcaccgggaggccccaggagggagggttgggctgaagcacctccatacttgtgcttggtggaccacacactctcctccccagagacctcatcaagaagttacagaactactgcctcctgggaagaaatttttatattgtgagccacataagagaattaaggaagtactggaagaagaacgtcatattaagagagatgaatgccacattaaaaatccagctgcagtggccctggaagggatttggagcattaaaaggaatctgcctgtgggaggcttgaagccaggactgccgagcagaaacagtttattgccacaagccaagtactactccaggcacggaggactcagaagataagatgaattagattttccattaagaaggaacctctttctgctgatgtctgaagaacggagaagaaactcaagcttgtttcaggatttaagatgtgtgcaaaaaaatgatagcctgtaattactattattggtattaatacctatctataaattaatccaaagtaatgaaagactattggtaatgttcagtaagtacctgaaaacaataaaggaaaatatacttatttttagttgtcacagttataattcatttggcttctaattcaggttattttattaaatatgtgaaacaatgatgaagcaaaggcacgtttaccgagtatttacttcaaggcaaacattataaaccttaaccctttactacagcataatgtgttagcccatttttaaaaaacagaactaaatccagatacagataatggaaaaaaaattaaaacatacttagcaggccaatgttcagacacagaaat

SEQ ID NO: 468145 - DNA, 582 bp, Homo sapiens
ttatgctagcattcacttcaataaggctttattctattattcaaagactgaaaggcacatcaaggatgagtctatcacttttttttcaaccctgtgtggcttttggtggtaaagatcagcttaaatttttatccaaatccaacgaagggaagaaagaatggtaccagttcctccttgtacctctggtagaattcggctgtgaatccatctggtcctggactctggttggtaagctattgattattgccacaatttcagatcctgttattggtctattcagagattcaacttcttcctggtttagtcttgggagagtccgctactatgtgccaggaaatgttccatatactggggatacagcagtaaataagacaggtgaggttctcccctcatggagcctgctttctaagagtgagcttccaacaccagcctggaacaccaaaataatcttcatttctgggtcttccaacagacaaagcaacaggacattgggaagcaactaaggaagcagtcctttttgtggaggagttcagtaggggtggggtgggagaggaatggcaggggtgctcagtgctcctccat

SEQ ID NO: 468146 - DNA, 966 bp, Homo sapiens
ttgctagcacagcagtctgagatcaaactgcaaggtggcagtgaggctgggggaggggcgcccaccattgctaaggcttgagtaggtaaacaaagcggctgggaagctcgaactgggtggagcccaccgcagctcgaggaggcctgcctgcctctgtagactccacccctgggggcaaggcatagccgaacaaaaggcagcagaaacctctgcagacgtaaatgtccctgtctgacagctttgaagagagtagtggttctcccagcacagagtttgagatctgagaatggtcagactgcctcctcaagtgggtccctgacacccaagtagcctaactgggagtcaccctccagtaggggcagactgacacctcacacggccaggcacccctctgagatgaagcttccagaagaaggatcaggcagcaacatttgctgttcagaaatattcgctgttctgcagcctccgctgctgatatccaggcaaacagggtccagagtggacctccagcaaactccaacagacctgcagctgagggccctgactgttagaaggaaaactaacaaacagagagcaaatccacaccaaaaccccatctgtacatcaccatcatcaaagaccaaagcaacagaacaaagctggatggagaatgactttgacgagttgagagaagaaggcttcagacgatcagacttctccaagctaaaggaggatgttcgaacccatcgcaaagaagctaaaaaccttgaaaaaagattagatgaatggctaactagaataaccagtgtagagaagtccttaaatgacctgatagagctgaaaaccatggcacgagaactacataatgaatgcacaagcttcagtagccgattcgatcaactggaagaaagggtatcagtgattgaagatcaaatgaatgaaatgaagtgagaagagaagtttagagaaaaaagagtaaaaagaaac

SEQ ID NO: 468147 - DNA, 798 bp, Homo sapiens
atgtaaaaagttcttatcatcccgtaccgctgctcagaagggtccctgttgtcacagctgctgacctcatagatctgacccatgcctctcgagagagaagaaagaaatgaatacataaaaggtacagcttggaggaattcacagaattgctttccttcaaagttcacacaaaatattaataagtcagggcagatcaacatcagcccaagagttcgcaggtcatttttaaataaagatactgaatgttgctctgatgaatttattccccactcagaaaatttgtctttcttgttacatccgtcctccaaggaaatcagcccctgcttagaaggctttctactcttttggcctctgttgccaggctggtcctcaaggactttttctccttaccctgacctgccagccctggcccagcttctctctctgacttcatttccctgtactcacctcctagcttgctccagacaccctggccttttgcccttccacgaacacaccaacctcattcctgcctcagggtctttccatgtgttgtggaacatgaattgaagaactcccttcctcaattcacttttctgcatgtcatttcctcagagtggtcttccctaaccatccttctaaacttatctccatcttctgcccagaaactcactcactttaccctattttattcttcacagcacttatctccacctgaaactattttatttatgaagttattttttttaactttttcctactgcaatgtgagtttcatgaggataggaacactttggattcctctctgtacctgcatca

SEQ ID NO: 468148 - DNA, 1909 bp, Homo sapiens
gaccttactctctgcatccacatggcgttttctacaacaaagattcagaaggtaggagcagaaggaagacactgttactcattggggctgtggcccagttggcttgaggaagtacaggcagggtgggtccttactggggcagctggaggggcacagactgctctgccggaagaggtaggcatttatgattatcaccacctaacagataagaagctaagagtcatagaagagaaggaaattgcccaagctgcatacctaacaagtgatggagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaagggacacggaatgatgtggatcgagagtttgttataatgtttactcttgtggatgagaatcaaagctggtacctcaatgaaaatatcaaacatttctgcaccaaccctgattcagttgacaagaaagatgctgttttccagaggagtaacaaaatgcatgcccgtattaccaacatttctggtcccagtcgcctctgcaggggagtctcttccactagcgtgtttctgtttccagccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaagctggtatgctggggcaatacaatgttgataactgcaaaagtgatattttctaccccaagatgaagggtcaacagaggcgctactttatagcagctgaaaaaattctttgggattatgctcctcaaggctataacaaattcagtggtcttcctctaaacgcctctggcagtgactctgatctctacttcacacaaggggacaacagaataggaggaaaatactggaaggttcggtatactgaatttgttgatgcaacttttactaaaagaaagagactctctgctgaagaagcccatcttggaattcttggcccagtcatcaaggcagaggtgggtgataccctgttagtgacctttgccaacaaagccgacaaggtctatagcattttaccccatggtgtgatctatgacaaggcatctgatgcagccccaaacctagatggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacagctatgtctacatgatattaaacatattaatgaaaagagaaaaacagtcatttaagcatctattttaccaatcagaaatagcaaggacatttatttaaatggtatattttataatttttggcattgtgtggctccacttctggactcaaaggaatttccagatttaaaaaacacaaaatatcttgatcctatttggattttcctttctctacatgaaggaacaatcccggaaatgtctattgcatgtgttataagactgaatgtttatgctgtgcctcaacaagcacacaaggcaaagc

SEQ ID NO: 468149 - DNA, 561 bp, Homo sapiens
ctaacggatatgaagatgattatatggggagcactgagcagactatatgaaagggagtctataattaaagaactgaggggctttgcctccgttctggcttctctgaaatctccaggctcagtacactcaatcgatgaagagaggaagtttcacatgtgctctgacaatggctccaggtgcgtgggcatactgagcttggccttggctaccgcagtcatcattgccaacctcctgctatactttcccagtgggcaggtgctggagcctgccaagatcacagacttgatgaagtgtgtccctaaggacttgtccagtcacaaagcaataatttcatctgggggccaccttacctatgcccccagagcatggccggctgctcttcctctgtatccagtggtcacttacgaaaagacaatttatttgtgtgaaatcccagtgccaagcactgagtgctcagcaaatgggtgaataaatggatagggcataaggaattctctcaaaaacaaggtgaccacctcccctctgggtttttcttcaccctagtaggcacagtgatgttgc

SEQ ID NO: 468150 - DNA, 715 bp, Homo sapiens
gggtctttgtggaggtaattagttaaaatgagatcattctggattagggacggccccaagtctaatatgactggcatcgttataagaagaggaaaagaaatacacacaggcacaaaagaaggtcctgtgaaaacaaaggcagagattaaagtgctgctgccacaaccaaggaatgctaaagatttctggcataggtcaagcctggcacagtctggatctcagtccctgactcagaccctggatgctcgctgccttgtacagaaacaacctgctcaaccaaacagggtgaccctgctgaagccgcaaatgtccaacagtcctgccaaccgtggatgcttctgtagcttccctttagctctcactcctggcatgaaaccagacacagactacccagaagatgaactgagcactctgcaatgggcccagcacactgctgcatctgagaccatcttctcggccctaacaaccctggcgggctcttctctctggtggggaaattgggcttagggaaaggacatctttaggacagtcatcccaccaagtagaatgactctatgcagcctgaatactgtttccctgggaggaaaaaaatccaaagcataaacttttataagctgttttaattaaaacactctttgtaaagtgatggatttgaagcaagggaggagaaaggttttctggcaaaagtgtcttttgtggtgtttctttggtgagc

SEQ ID NO: 468151 - DNA, 711 bp, Homo sapiens
gcctaaggtttgcagggtttttttatgatacagcctagcaggctgtcctttggaatggaagacagggaatttcccataacggaggaatgggatcaaatggcttggaggtgtccccctaagaccagattatcagcaagtgcctggcacatgctggaaccttcttggaccaacgttggatttttgtactggagaaaccaagagaggctatgcaggtttctgttaaccaggctcgcaggatacttaccagtaggcaatatcagtgaccgatgtgcgtgcacagagaggcgactggaggctgaggaccttcctttgtccaactgctgtggcctgctctccagggtggaggactcatccagggacctgatggtaatgccaggccctgatgcccaactagctcacagtgccagataaatcaggaaaactgtctttctcatttttatgtttgactgagaaatctcttgctgaccatattctcagcacatgcatggtgggaaggagataagcaacatggaatagtccaagtaaaaaaaaaaaaaagacttgctcaagtttgcatggctttatttagctccagttcagaactattgacttcagtctgttctctttacctgacccacatttgcctcaccacctggcacctttgaaggtgtgggtttttgtagtgcttcgtgcagtgttttgtagtgccggatcagattaatatttggggag

SEQ ID NO: 468152 - DNA, 615 bp, Homo sapiens
tcaattatcaattgaccataaacataatggcttacttctggactcaattatattccattgatctttcactgatgtataatgcgagtgcgtttgacagtgaaggcttttccacattagctgcatatataagatttttctcctgtacgggagcactgatgtacaatgagattgctcttcacagtaaagccttttccacattcactgcatatatggggtctctctccagtatgagtttgctgatgtacaacaagaaaatgatgatatccaaggccagcaacctccttcttcttccgtcattgcttcacttgagttatcttgcttttgggagccaggacctgagggctgcacccgaatctctccagacactactggcagtgacaaaacatggcatccatgtccgaaaccgcttcctattcagatgcactcctgcgcggcctacgggacgctgagcggtgacgatgatggaatgtaattattactattactggctgcattgtcaagcaaagcaaacgacaagcaaagaaaatttttaagatgtgaaaatgtaaattaaagttatatatgaaatcaacaaacatattacatttgccatagtcttcttatgtgaattaatgc

SEQ ID NO: 468153 - DNA, 1401 bp, Homo sapiens
tgcctaacgtagatgacgcattgatgggtgcagcaaaccaccatggcacatgtatacctatatccaaccaagatattgccattcagttactcacgctcattcctgcatcatacattatcttttttagaggtgtttttaactgcaggaatggaaagaaattcatcggatgccaaaaataacacgaaagaaaaaatccctatgggcttgccccctgtgggctgcacccactgtccaaccagtcccaatgagatgaaccaggtacctcagttggaaatgcagaaatcacccatcttctatgtcaatctcactggcagctgtagaccagagctgttcctatttgatgatcttggaagtgactcctctggacttccagagctcagggcttttgcagcctccatacttgcattggccccctggatccactttctctctcaaactgtcttttctcattcctttgactccgctggacttcattgcccccatgacctggtgttgagtctgatcaccccaacaagtggtgtctttgctttaactattttttgcatactcacaaaccaatcagcatgcactccccattctgagtccataaaagatcctgcactcagatccctcaactgtgtaacttgcaccccttacttggggtatatgtgtgaaaaggcataccttcaagcttcaggacggctgggagcctgctggcttcgggttgatgtggagacagtttcacagcgtgtcatcgctagacctcggtgctggaaatctcagcatttcatgatccctccgccctgaattgaaaacgagcatggagagcagcagaaagcactccaggttagttacatatgtatacatgtgccatgtttgtgtgctgcacccattaacttttttatgatgacttaagtattaccaagtaagggtaaactttacaaacctaactggttgaaaagcttactggtttgctggcttacaacgtagtaatgcatgcaagttcatctctttcactgaaatgttgacgatattgaaaatgtagaatcaagtataattacttgcaaatactctcatatagattaactgtaaaattctgaactgttaattatatcaattgtgaatttaataaatacttattataaatcattctttaccaaatacaagcaagatatagactttttgtcttaaaaatgcaaagattccttatctatggaatacttttagaaagatgtacctgatctatctagttattttcatagtaaacaaatctggaatccatggatttcttgaatatggctttctgcaacatatcacatatgctgtgtaactctctgaacataaaatggaagggtttactgatcaaaacagatctcttttttgagagagaatgcatctccctactttttattacgctgtatt

SEQ ID NO: 468154 - DNA, 708 bp, Homo sapiens
ctgtgggcacagcttcagcaaatttaaatgtccctgcctgacagctgtgaagagagctgcggttctcccagtacagtgtttgagcactgatgaggtacagactgcctcctgaagtgggtccctgacccccggtgtatgcagactggaagacacctcccagcaggggccgacagaccaaagttagaaaaatccatgaagatggtgagaaaccagcacaaaaaagctgaaaattccaaaatacagaacgtctcttcttgtgcaaaggatcacaactcctcactagcaaaggaacaaaactggatggagaatgagcttgacgaattagcagaagtcggcttcagaaggtgcataacaacaaacttctccaagctaaaggatcaagttctaacccaatgcaaggaagctaagaacgtggaaaaaattttagatgaattgctaactagaataaccagcttagagaagaacatcagtgacctgatggagctaaaaacacagcatgagaacttcgtgaagcatacacaagtatcaatagctgaatcgatcgagcagaagaaaggatatcagggattgaagatcaactcaatgaaataaagacagaagacaagattaggaaaaaaagagttaaaagaaatgaacaaagcctccaagaaatatgggactatgagaaaagaccaaatctatgtttgattggtgtacctgaacgtgatc

SEQ ID NO: 468155 - DNA, 712 bp, Homo sapiens
gcataatacccctttggaattcgaagcattactttgtttggatgtgcatatttgaatacaaaaagagggttaccacctgtgagaagggtgaatatgaagaagcagatattccctttgtgaatcaaagaacaaggaggccaatctatccagggcaaagtgggccagatggagagtggcaggagataaattcagagaagtggtatctggtggtggaaatttctaaggagcaaaacattcaagagctgactttggtactgttaaaagcattcagttttatgtattcacaaatacatggtttggaactggaacttacacttaaaagggaaggagagcataaaagtttggaaaatctgcagcctgatgatgcaagagaaaaaccattttctgaggagaaattcaagcctgcttcagaaatttgtcagtgtgagaatggactagagcaatacctattttccactggcaaatttattgtggatatgaccaaaatctaaattctgtgctcatagtaaaatcaaaaagttccgtaagttgtaaacttaggttgtgatttgagaattttcttattttttaaggacaagcttaatttcaaagtattaaataaaacttttcttgcagcattatgcacatagtcttttgtacataaattacttgaatacaagttatgttttccttattggactatatattccctgaaagtgagggaagtacaagg

SEQ ID NO: 468156 - DNA, 1555 bp, Homo sapiens
aagatatgaatgtcccaatttccacatacatgacttgctcctccttgccttctgccatgagtgtgaggcttccccagccatgtggaactatctcagaggatgtatggaaatgcctggttgttgaggcaaaagtttgctgcagatacttgttgaatggttgtgaccaaaatgctgatagtgatatggacaatgaagtccaagttgaggtggtcacagagggaaatgagaaacttactgagaactggagtaaaaatcactcttgctatgctttagcaagggaactggtttcaaaggatgtgtggaaattccttaatgtccagacagaagtctgctgcaggggcagagcattcatggagatcctcaaccacagcagtgcagagaggaaatgtggggttggagccccagacagagtccccactggaggactgcctaatgtaactgtgagaagcgggccactgtccttcagaccccagaatggagcccagttcttgcagcagcatgaccaggatgtgagacttggagtcaaaggagattattttaaagctttgagctgtgatgattatgctgcagggtttcagacttgcatgaggccttgaaggtgattttctctggtggtatgttttaattttttgctttttttgtatgtgtatctgttacaatttttatgatttgaggttatgaggcttgcaaataacatcttataatccacaattttaaactgatgacaagttaacatggattgcaaatataaactctcaaataagcaaataaaaatgaataaaaactatgttttaacttcattctacccacttttaaactttttgttgtttctatttataacttattatactgtctaaatcctgaaaagttttagttcttagttttgacagtttcatctttgagtctttcttctcaggatatgattagtttacaaaacacaattatagagttacaatattatgtatttttctgtgtagttactattaccagtaagttttgtcccttcaggtgagttattattgattgtcaccatccttttatttcaggttaaataagtcccttcagcattttttgtaggacaagactggtgttgatgacataccctcagcttttgtttgcctgagaaagtctttacttcatttaatgtgtgaagaatatttttactagatatactattctaggataaaggttttttttttttttcagcactttaaatatgtcttaccactctctcctggcttgtaaggttttcgctgagaagtctgctgccagacatattggagctgctttgtattttatttgtttcttttctcttgctgcctttagaataggctttttatccttgacctttggaaatttgattattaaatgtcttgaggttgtcttactttagttaagattgcttggtgttctatgaccttcttgtactttaatattgatatctttctctaggtatagagaaaataacattctctgttattttccctttgaataaactttctttgtctatctctctctacttcatttttaatgccagtaactcttagatttatcc

SEQ ID NO: 468157 - DNA, 2747 bp, Homo sapiens
ttcttaccctgtggaaaataagtgttgcttcgtgggtaaccactgttacccagtggacaataagtgttgcctcgtgggtaaccactgttacatgatggatagtaagtattgcctcgtgggtaaccattgttacccggtggacactaagtattgccttgtgggtaaccactgttacctggtggataataagtgttgcctcttgggtaaccactgttacctggtaaataataagtatttccttgtggataaccactgttacctggtggatgataaatatttcctcatgggtaaccaccattacccaccggatactaagtattgccttgtgggtaaccgctgttacccggtggataataaatattgcctcgtgggtaaccacagttacctggtggagaataaggtaaccactgttacccagtggataataagcattgcctcacagcccgttgatactaagtattgcctcgtgggtaaccactgttatccggtggataataagtgttgcctcttgggtaaccactgttacctggtggataatatgtatttcctcgtgggaaaccactgttacctggtggatgataaatattgcctcatgggtgaacaccattaccggctggatactaagttttgcctggtgggtaaccactgttacccggtagataataagtattgcctcgtgggtaaccacagttacccagtggataataagtcatgcctcgtggataataagtactgcctcgtgggtaaccactgttacccaatggataataagtactgcctcatggataaccacggttaccctgtggaaaataagtgttgcctcgtgggtaagcactgttacctggtggataataagtgttgccttgtgggtaaccactcttacccggtggataccaagtattgcctcgtgggtaaccactgttacccaatggataagtactgcctcgtgggtaaccactgttaccctgtggaaaataagtgttgcctcgtgggtaaccactgttgccaggtggataataagtgttgccttgtgggtaaccactcttacctggtggatactaagtattgcctcgtgggtaaccactgttatccggtggataataagtgttgcctcatgggtagctactgttacccggtggataataagtattgcctcgtgggtaaccactgttacctggtggatgataaatattgcctcatgggtagccaccattacccaccagatactgagttttgcttcgtgggtaaccactcttacccagtgggtaaccattgttacctggtggataataagtactgcttcgtgggtaaccactgttacccaatggataatgagtattgcctcctgggtaaccactgttaccatgtggataataagtgttgcctcgtgggtaggcatgcttacccgatggataataagtgtggcctcgtgggtaacgactattacccagtggataataagtatttcctcatgggtaaccactgttacccggtggataataagtattgcctcatggataaccactgttacccggtggacaataagtattgcctcgcgggtaaccacagttacctgatggataataagcattgcctggtggattaccatggtaacccgatggataataactattgcctcgcgggtaaccactgttacctggtggatagtaagtactgcctcgtgggtaaccacagttacccgatggacaataagtattgcctcatgtctaaccactgttacccggtggataataagtgttgcctcgtgggtcaccactgctacctgatggataagtgttgcctcatgggaaaccactgttacctgctggataataagtgtttcctcgggggtaaccactgttaccctgtgtctaataagtgttgcctcatgggtaaccactgttacccaatggataataagtattgcctcacgggtaaccagagttaccctgtggataataagtattgcctcgtgggtaaccacggttacccagtggataatacgtgttgtctcatgggtaacaactgttgccctgtgtataatgtgttgcctcgtggggtaaccactgttacctggtggataatacttgttgcctcgagggtaaccactgttacccggtggataataagcattgcctcacagggtaaccactgttatccattggataataagtattgcctcacgggtaaccgctgttactcagtggataataagtactgcctcatgggtaaccactgttacccaatggataataagtattgcatcctgggtaaccactgttaccctgtggataataagagatgcctcgtgtgtaagcactgtgacctggtcaataataagtgttgcctcgtgggtaaccactgttacctggtggataatatgtatcgacttatgggtaaccactgttacccattggataataagtattctctcgtggaaaagcactgtgacccagtggataataagtattgcctcgtgggtaaccactcttacccggtggataataagtattgcctcatggtggataataagaacgacctctggggtaaccactgttatccagtggataagaagtattgcctcgtgggtaaccactgttacccggtggataataagtgttgcttcatgggtaaccactgttacctggtggataatgagtgttgtcttgtgggtaaccagtgttaccctctggataataggttttatgtcgtgggtaaccactgttacccattgtaaaataagtatt

SEQ ID NO: 468158 - DNA, 577 bp, Homo sapiens
ctcttaatggtcataaaaggcatggccctatatgtttcattaaaaagcagaattacatttcctaacctgcccatttatactttggtcagtgtccacttacactttggtcagtgtcattcagaaggcaatgccttctcagggcctgaagcagctaaagtgaaggggctcagcttccctgagagagcaggacaaatagactttctccttgatctaactgcaggcacactcgctgggagctctggccccaggagggctacgtccagtacctctgagcagagagaagtaggggagctagatctcatcaccccaggctacaaggcagaagcttctgaggaagacagtgtccacgtctgctaccttcccaaagatggcttcttcatgatttctgagagtgaggatgggaagggaggaagagaaggtgggccttagactaagatctggcccttgaataaagtaagttcattcattcatttattcattcaatcagtcagtcaacagaatacatattgagcacctactgtgaggctaaagctacattgaccttgaacagataactaccagaatcgtaatgattacc

SEQ ID NO: 468159 - DNA, 547 bp, Homo sapiens
cactaagtccatggtcatttgcttgtgcttctgctactcattttgctacttcatcacattctgcctcatgtggttctgcagactgagcccttgtctcctcaactggcctggatgccccaggagtccagggaacacaacttgcaaagtgttagcacatcatcaaggcttagcacagcacgtaagaagcattcggcagatacctggagacgggacccgatcaaatgggaagaagtgccagggcttccgtggtccaggcacagtgccaggtcttaggtatatgatggaaagctggacaggtggtgcccctcttacaggaagcagacaggctagtgggaaagacaaagagacaatattaatgaactgtgctgtggtgagctatggaagcacctggaagaggcaactaaattggtctatggggtcatggagggctcctcggaggcagtgacttttacaaagagatcagaagaatagataagagttagatctctggaatttggatgcctccagcagtattagacagtaaagcccatgcagcaaattgccggct

SEQ ID NO: 468160 - DNA, 628 bp, Homo sapiens
ttaatccatgatttcctctactcctcagattgttattctgaaacctaggctttgagggagtgtggccctgacccccagagccccagcagggcacctcgctgccggcctctctccccagggtgcagccataagcccaggagcttggctatttatagtcaggctctgacatctccgatgatttacctttcagatctcaagtcaacaccactatctcattttttgcaaagatcagaagcagcacaatgtgattgggaagctgacagccctgcagaagggccaccatctctattaagccctggaaaaggtgattctctcaagggtaccaaaacctaccagaccagaattttgaatattggtccccactctcttctggctcgtagagtttctggcgagagatcagctgttagtctgatgggcttccctttgtggacaggaccctcagctgcaggtctgttggagtttgctagaggtccactccagaccctgtttgcctgggtaccagcagcggtggctgcagaacagcggatattggtgaactgcaaatgctgctgcctgatcgttcctctgaaagttttgtctcagaggagtacccggcagtgtgaggtgtcagtctgcccctactgagggg

SEQ ID NO: 468161 - DNA, 643 bp, Homo sapiens
cagtcactgacaagcagggccatggtcagaggagccaagtggagcctcaggctggacatgggcctgggaccattgcagacactgctggaggaagggcacacgcctgtggcccaaaggagcagccgaacatcatctctggggagacggcccccagagaaaatcctgttcatattcccagcaagaaggaccaccagtatctctccagttagaggcatgggtttcttcctaaagatatggatgaggatacttgcattcccaatttcatatttgttttggagacactggcccactggtccccggaaactgccatgtgctgcctctcgtgtccctctgactttgttcttccctttgcctggaatgcctggctttgggaaagatgcctctgcaggctctggttcaggtccattgtctgtgaagctttgcctgaccttctttagggtgagctctttatcaccccttcttgtgtttccatagtacattgtgtggatttctgcatcacgaatcatcatattaaattagaacttttcttgcctgtcacttccttcgattgtcatctccttgagggcagggaccttctatttttacaccactggttccttgtaaagtgcctagcaatctttgccaataagaaatgctttcttct

SEQ ID NO: 468162 - DNA, 510 bp, Homo sapiens
cccgtgggcacacagggcagaaggaggcctggatgccttctatgtacaggcaaggaaatgaagccagccaggaatctgtgggtccatcattaaaaagaggactaggaaaagaaagaggagaagatgtcaagaataaacttaacattcgaaaccgtgatctctgggcttcagaatgctcgcagcttagatcgttcaaagaaaaagcaagtgcagaaaatcttcacgaagacagccccatgtctggctttgattctactcctgtggaaaaagggaagagcggattttggtggactaccagcatcctctactgttggtgttttaagagccaagtggagacacagcaagcagtgggacgaggaagcagagcagagagaggaggtgaagaacggcagccactgttagcagctttcaaccagggtgacctgtttgatgcatcagatgatggtccccaaagcatggatggatgatgtggttgtgggctgaacacttctgttcatactgctgatgtgc

SEQ ID NO: 468163 - DNA, 815 bp, Homo sapiens
gcagctgcaaaatggtctttctggcctcttaagaggagcttatgctgaaacccctggtttctgtctttcatgctcgaggaaatgaaaatggaccccttgattacttgtgtccccaagttgttgctcatgtgtccattgagaggcatgttaattgctcatacaggccctttgcatgtccagaggtgtcatctgagagccagagactagagtcaaaaaccttggaactctacctgatgttctattgcatatcagctgagctggcactcaaactacaagatgcatcccttcccactctttctatcttttttcaaaggcagaggagcctcatcctgtggccatggccaacaaaggctcatagaaagtactgccaaactaccactgatgttcccttacatgggctcttcagtcagcttgtggtggatgttgcctggcctgggactcactgttcaggacagtgggctcccctctggcccagggcaagtccagaaatactgaccaagagccaaaccctggaactggggaccctaagaggccacttggtgctctatcccccagtggctgagctggtacctaaggtgaaagacaaatgtaaggataatgacatgaaatagaaattgtcttttaatagacagatgaaggtaattatagtgattataatagatgctggcaaatattgcaataaatggactaatttagttcacattacaggaactgttaaaactaaagcattaaattatgtgtgcaatatttattaaaaatcacagagcacaaattcctttgaattggtaattttatagaaaccacctctcatcttt

SEQ ID NO: 468164 - DNA, 1058 bp, Homo sapiens
tccccagcacctagcacagctcctggcacactgtcagcacccgatgggtattgaagattctggcaacagaaatcctgaaaatcgagtggaaattcctggggatgaggtgctggctggcaaagcagagatgtcctttgcaggctcccagccgcatcgcaaagcagagtatagcaggttggatggggagctggaagacaatagcttaattaccaatgctgcctttgaaagtgggaagctcttatctttcagagttcgtaaggacgcagcaacaaagcgctgtgattcaagcagacagcagccctcaccaaacaccaaacttgctggtgccttgattttgaactttccagcctccaaaactgtaagaaacaaatttctgttctttatgcatcacccagcttcagaacctgaaagcacaatgtctttctgctctggctcggtccatattccacttggcaagctgcagtgggccctgcccctaggttgaagtgctggtgaagaagccttgacagagccttgctaactcctgcttgaaggggatgggtggagggtttaccacaatgcctggtgggctgaggtgaggacagctgagaaaggatgactttttcaaaagaaacttttgtggtgcttgtgttgcaagagggatctaagatgaaatttatcatgtgactaatgggcctctgccccagacattgggcctttattatgcattgtgaatttctaggaggctttactagatttaacatcttgctaatagatttgaccacaggcttatattcgtgaaatatttcatggggataattttctgctgaacacaaccagggaaatattctagaagatttcaagggcaacagtttacactgtcacctctactttaaaaaagttctgcattagaattcttaaagttctttagaatgtgtcatcttaataataatgtctgacatttattgaattcttattatagaccaggcaatgctaaatatttcacatgcattatgttatataacctccaaaacagccctcgaggtgctattactacctgcatttcatagatgaggaat

SEQ ID NO: 468165 - DNA, 1495 bp, Homo sapiens
ctgaataggaagagctccagtctacagctcccagcatcagcgacgcagaagacgggtgatttctgcatttccatctgaggtaccgggttcatctcactagggagtgacagacagtgggtgcaggacagtgggtgcagcacaccatgtgccagccgaagcagggcgaggcattgcctcactcgggaagcacaagggatcagggagttccctttcctagtcaaagaaaggggtgacagacggtacctggaaaatcaggtcactcccaccctaatactgcgcttttccaacaggcttaaaaaatggcacaccaggagattatatcccgcacctggcttggagggtcctacgtccatggagtctcattgattgctagtacagcagtctgaaatcaaactgcaaggcggcagcgaggctggtggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacataaatgtccctgtctgacagctttgaacagagcagtggttctcccagcatgcagctggagatctgagaatgggcagactgcctcctcaagtgggtccctgacccctgacccccaagcagcctaactgggaggcaccccccattaggagcagactgacacctcacacggccaggtactcctctgagacaaaacttccagaggaacgatcagacagcagcattcgcagttcacaaaaatccgctattctgcagccactgctgctggtacccaggcaaacagggtctggagtggacctctaacaaactccaacagacttgcagctgaggctcctgtctgttggaaggaaaactaacaaatagaaaggacatccacaccaaaaacccatctgtacatcaccatcatcaaagaccaaaagtagataaaaccacaaagatggggaaaaaacagagcagaaaaactggaaactctagaaagcagagcacctctcctcctccaaaggaatgcagctcctcaccagcaatggaacaaagctggatggagaatgactttgacaaagaaaaaagaataaaaagaaatgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagaaactccaagacacataattgtcagattcaccaaagttgaaatgaaggaaaaatgttaagggcagccagagagaaaggtcgggttacccacaaagggaagcccatcagactaacagtggatctctc

SEQ ID NO: 468166 - DNA, 1221 bp, Homo sapiens
tatagctgaatctgaattatctgaattctcaaggggatgcaaaatggtacagccactttggagggcagtttggcagtttcttataaaagtaaacatactcttaccatacaatccagaaattgtgctccttggtatttacccaaaagaagtgaaggcttatgtctatgcaaaagcctgcacacaaatgtttatagcagctttatttataattgctaaaacttggaagaaactgagatgtccttcagcaggtgaatggataaactgtggtacatccagacaatggaatattattcagtgctataaaggaagacacaaaaggctccagttcacaattgcaaatgacaatctcattctgtcagtcagaggtagttgccaggtgcccaagaccatggaagcccaccccttgcatcatcgtgccctggatactcataggcagaaggaacttgccttgtctgaaatgagactttggacttggacttttgtgttaatgctggaatgagtcgagactttggggagctgttgggaaggcatgattgcattttgaaataaaggaatggaatctgagctaacctaccatgtttgtactggaagtcctgccaacagcatttaaggaggcctgcctctcctgcagtcaggtgtgaccaaaggagtatgagtgaaagtaatgtgtgcctctacaaaacctgacgcatatgaagaaacaaaccatccatccacacctgatccttgtcttctccatctgccagctgaatggagagaaacaaagaactcctgctgacccacactggactatgacatgagcaagaagcacacttttattatgttaagccactaatattttgggattatttgttagagcaatggaatctatcatgatgaatacattttttaacattctcatatcttttctttttttttggctaaaattgatccatattctgcgtacttgcttttgtcactgaacatcatgtaaatttttccaaatctattagtatagaggctactcattctttttaataggggtgtaataatcctatatgtattgcagtatatatttaatatgttattatattcaataattatgacagatgagtatttctttgtttttagattcttacttctataaatgatgctgcaataaatattcttatacatccccatgtgtgttattaacacaactattctcttgataactttcaaaattataaaatttgccaaaga

SEQ ID NO: 468167 - DNA, 700 bp, Homo sapiens
catttcctttattcaatggtttccagggacgagcagggaaagccggcagtgacagttatcacccagctcccacgcagccagcaaggatagtactactttagcccaccatgctccccaacagcaccgagtttatattgaggcagccggccctgctcctcccagccatggtttctgtggtcctttgtgcgccaaccccggattctgccctggaaaattcacactcagtcgaaatcactgcaaagttcagctggaagtttccttctccctgtggtctattcccaaatcagctggcagcccaccccaaggacccctgtgagataaagtcagaaatgggttccctgggggctgggagtgccttcagggctcttcccgctgcttcttctacttttatatttgcttcgctctctaaattcacctcagctttaggcaaggttaaaaccttctccgatgatctggattttcagtcttcctgtggggctgccacactcaaagcttttgctgtggaaattcctgagagccagactagtgattattactgttcttctgggactagccaaccagtggggctgccacactcaaggctggtgctggggaatgtctgcaagggatctggtgttgtaattcatcttcaagtctcccagcagtgggtaccagcccgtgtatctttacatttctgaatgcaaaataaggtagttcaaac

SEQ ID NO: 468168 - DNA, 546 bp, Homo sapiens
agtatctctctccatgttgtgctgcccggagttggaggagaagcaatgtgggcaaggaaaaggctacatggaactaggcatgttcaaaatggcggctccatcttcctttctctttgccagccatgtgtatagtaaggagcaggcaatatggcaccgaccaggcgatcctttccctgaggtttgggaaactcttcagaggagcccatggaggaagcagtacagtgttaagttagtgaggaacaacctggcccaggaaatgggcctgtttggcaagtgtttgactgaatcagaggagcagccctgtgggcaggagatgaaatcagagggagttgaagctgtcttctgcactgagtcagttcctgggtgggaacaagacgaccagatgagacagtttatcatctgggtggtgccagctgacccatctagtgcaggatctgcaaaatatgtcaagccctgatcttaagttgtacaatagtggtgctatccccaggagccatttggggagggtttgttttgggagaccgctgttgtcatctttgtttcaaa

SEQ ID NO: 468169 - DNA, 778 bp, Homo sapiens
gaggagccgaatgttaatccccaagacaatgaggaaaatgtctccaggtcatgtcagaggtcttcatggcagcccctcccatcagaggcctggaggcctaggaggaaaaagtggttttgtgggccaggcccagggtccctgtgttgtgtgcagcctagggacttggtgccctatgtcccagccactcaagccagggctgaaagaggccaaaatagagcttgggctgtggcttcagatggtgcaagcctcaagccttagcagcttccacttggtgttgggcctggcagtgcagaaaggaaatgtggggttgcagcctccagatagagtccctactgaagcaccacctagtggagctcaaataagtctcttgagacctgatgattttaaaaagaggagttcccctgaacaagttctctctctctctttgcctgctgccatccatgtaagatgtgacttgttcatctttgccttctgccatgattgtgaggcttccccagccacatggaacttggtgctcgtgcttggtccaaacctcaaggagtgagtacttagagtaaaggctttgccgccttctttgtggcttcacctgtgactccccttctagactcaggaacatattggtatcaaaaccctttgcaagaaacttccattaggtcaaacattcagtgctagaaaaatgaaaatcttgctgtatcagggtatgatgccttatgtaactattttaaaaggtttatttggcacattaaggaaatgtaaaatgtttcattttcccctcatt

SEQ ID NO: 468170 - DNA, 547 bp, Homo sapiens
gagcgagtgctgaaaccagtctagcaggttcaggaaatggaattctgctgtggagcctgtagagtggcacaatgctggcgcttagagttacctaacagagctcagtgtgaaggaaatattttttactggccttttgctgaacaaggaaaatatccactaatcatgcaggtggaagctcagatgattgattttacatctttcttttctaatacatgcatacaacgctataactctccctctgagcactgctttcgctgtacttcacaaattttgatacagagaaagatggtggaaaaggattttccagcaattatccccctgcagaaatttcaattggaacaactatccaagcataaaaatgccttcacaagagagaaaaaacaaacaaagaaatgggagatgacagaacctggttgtagcaaaataataagaaaagatgtattgaagaaggcaaatgggacacttacacattatctccatcacccccgcctaaccccaggcaatacagcatagagagagagaaagagagagacactgtccactgggt

SEQ ID NO: 468171 - DNA, 509 bp, Homo sapiens
gacttcagacatgccacctttaagagctgtaacactcactgcgaaggatggaaaacgcaggcacaaaaactaaacaaccagaatgggagaggtactttcagtggtacctggagagtaaaaggggagaagatctcctcatctccctacagaaggccaacaatcaatttagaaaagataatcaagaactctctaattttttctctctcttaaagaaaccctgggaatcccttacttcccccttggcacctctcccacctccaccaacaccccaactctaccctgatctctctgaatttccccaaccagatctgtaccctccttctcctgcatgttcaaatctaccatcttctcctccttgtctaccactggctcaaacgaagacagtagagagtctaacttcaaagaccctacctcctgctgattctctggtagccccagtggcagcctctcattggaagatgtggaggagagggaccttgcagggacatttctcatgatcaccctatttc

SEQ ID NO: 468172 - DNA, 638 bp, Homo sapiens
tgtctgaattctaactctggctcagttactcacttcagcagtgtgactttggcttcagggctaagcgggatggaatcccttcaagggcatcctcccctaagctacagagctactcaagaggtcatatctccctctgaggaaagcacaggaggaattaggacttctctggggccatcccaggtcctcacctgccccctgcccctgtgcttccttctacctcctcctggaatcaccctctttcctacagggagtacctcccttccctcctctcctcctgtctccctcccccagcctgagacattcaggccagaagaacatcctggcatctgctgggggtcggaaggctttggggacagacgtgagctgagggtggagaaggggagcgaggtgggcactgagaacttcagctcaggtcggggctggccagctctgaacctcacaggaacaatagttctcttgccttggacctgcctgtctgtgtacagtgggggcccaggccctgtcattcttgctaccccatctctcattgtggcttctgtttcctaggtcctcgaggatttttctcatttcccagtctgactttgtagccttttcctacctttctctgcagcgatagttttgtattttctgcttaagtt

SEQ ID NO: 468173 - DNA, 554 bp, Homo sapiens
taccctgcaaggccacagaaactaggatgaataattgctgtctgcagctccacagctgcccctccctgctccttagcatgaagagctgtcctgctgttctttacagtttggtcaaaagccgatttttctcatcaccctgctttacagaggctcagcacacttcaatagaatctgaaggtagtacctttatgaaagaggccccagagagctccttcacgtctttcaccttggaagaacaagagagggtaccatctatgaacaagaaaatgggccctcaccagacgtccaatctgcaggcaccttcatcttggacttcccaggctccagaactggtaccaccttctatgaatggaacactggagagtggtcattgtgccttgataactagcactgctgggattgatgccaccttcgcacctatgaccaccgatggagggggagactttggccaaatttctgcattaaacattatatgcctagattagcacctagaaggcagtgcctctcggcagtaaccagttagttggcatgctaagattgcacatgaaagtctt

SEQ ID NO: 468174 - DNA, 556 bp, Homo sapiens
gggtggtgcaagatgtgctttgttaaacatatgcttgaaggcagcatgctcattaagaatcatcaccactccctaatctcaagtacccagggacacaaacactgcggaaggctgcagggtcctctgcctaggaaggccagagacctttgttcactttctgattttgagcttttcatctggggctacagtatcagcttctacatcattggcaagtgttccaagaccttccacattgtgcttttctggcatcatcacaagctgctggcctttacaaacagaccgcctgattccagctttcccaggacaacagtgcccatatccttgtacttacccaaaattggcagcctgattggtacagcaactgatctattgaagtctgacaaattacctagatatgaaccatctcctggctctgcttcacttatttcttctacgtgcttccctaatcttctcgtcttatgaggagaccagtcattttggattaggactcacactagtaacttcattttaacttgattacctctctaaagaccctatcaccaaataagatcacact

SEQ ID NO: 468175 - DNA, 925 bp, Homo sapiens
tgttcttcagtaagcactgacagcgggtccttgtcaggcagatcccacccagagaatccactcggctctgggatggtactgggtgttgtctgcacagagtcctgtgatgtgaacacgcacaggtctctcagtcacggctaccagcacctgttccagtggaggtggcagagggtgcaatggactctagaagaacaatttgcgaatctgacagccccgagaaccagacaggttcagagtgactccaggtcagctatgtggtcgtataacatcgctggacaaaaaggaaagcgacacagaaactttaagacaagaacccagaactcgcagaactgtgacagtaaaagaactgtagtgctcctgctcactgagctgctggcagcaggagtaaaagagctatttccagtttttccagcaccatctactgaagagactgccctttctccagtgtatgttcttggcacctttgtcaaaaacgagttcactaatcactaactaagttccaacggaacaaggatatatttaatttggagccccacagattagtcttcattgcagtatatttgcagagataattattttaagagtaatatgccctttaaaaagcacactggttatgtcttcagttcttaagaagaaagttaagtttgaacataaatgagttcaggaatcaagtctcagtgcccttatatactgggctagttacatgaaacttgtaaggcaggaacttccattagctattaaatatttggggtctttctgacacaatgcagtatcccaagtacacataagagaattttgttgtaggtttgtcaaggcccaaagggtaaggatctgtaatggacaccagtataccaatatcttcattagtggaaataattcaaagaacaggaattgccataacctttcctgaagaattacctctttc

SEQ ID NO: 468176 - DNA, 789 bp, Homo sapiens
cacagtgtgtttacaatattgggagtaatatcatatctacctttcgaaattatgaacaatatcacaggaaagtgtaaagcaccggcgatgaacaatgtcacaggagaagtgtacgccccctgctatattgggagcaatatcattctctcccccctggatactaaaaacaatacaacagtggggtgtacaccccgtgcgatactgggagtaatatcatcttctcccttacttgatattagaaacaatatcacagaagggatgtacaccctctgcattaatgggagtaatatacttgcccccttggatattagagacaatatcacagtggggatgtaccttaactgtgatgttaaaagtaatatcatcctccttcctttggatgttaggaacaatatcactgggagggtgtacaccccctgcgatattgggagtaatatcagcctctcccctccatggatattagaaacaataccacaggagtggtgtacacttcctgcgaaattaggagaaatatcatcctctccacctttagatattacggaaaatatcacaggggaggcctacacctgctgtgatattgggagtaatatcatcctctccccacctggatattaggaacaatatcacaggtgggtggaaacccactgtggtattaggagtaatattattattaattattaagcatttatttttatcatctatattaaaaatattaatgttaatattaattattaacattattttactgttatcaatattactatttataatagctaatattattatgtt

SEQ ID NO: 468177 - DNA, 823 bp, Homo sapiens
agcaaggctccgtgggcataggaccatccgagccaggcacaggatataatctcctggtgtgccacttgctaagaccattgggaaatgcagtattggggtgggagtgacccgattttccaggtgccatctgtcacccctttctttgactaggaaagggaattccctgaccccttgcacttcccagggctgctgcagtttgctgagggttcacttcaggccctatttatctgatttgctaccgagcgaggagatgtcactcaaagaggctagagaacagcaaagattggtgcctgctccttctgggacctctgacctcaaggggcaacaacctgatgccagtaggatcactcctaactgccaggagaagaggccaagtccgctggtccagagagactgctgcgacacctcccccaattccaattctgtccctgagcctctggctggagttattggagatcctgcagggaagccccgcccaatgaggaaggctgggtcaggtttaggcctgaagaggcactctggccacagaaactgccacagccagtgtgcctcggtggcatgggttcgcgagtgggatcttccgatccgtgggttgcacagttctgtggaaaaagcacagtttccctggctgggtagcacactcactcgccacctcccttggctagggggaggaggttccccttccccgtgtggctctcaagtgggccgcgcaccacactgttctttctctccgtgagtcactccagctttctagtcaactttgatgagagaacctggatactttggttgccggtgaaggattcacacgctaattttttttttc

SEQ ID NO: 468178 - DNA, 797 bp, Homo sapiens
aaccactgctgtaggccagttgcacgaatgtatctggagggcaggaagatgtatgggtctaaagctcaaaagagagaactgggaggcagaaaaggttttggagatgtcagtgtatatacaaccacctaccagaaaaacacggagtgtgccaaaatgaataagattcagtccctacccccaaggagcatgcagtcacatggggagaaaaataggcaaacagtcacagcagagggaatggtggctgtacccaggaagaacgtgatcaggagcggaattggagagagagaaggggccagaggggagtttctcaatgccacccttcagtcttcgctagcctcatctgcagcaaggtgggtctggctgccccaggaagatcactgctgctgctgctgctgctgccaatggtgcactttgccaccacctttggcaaagaggcctttgtccagactcctggcctcttccttctccctgaagtgctttctatttcctcctcctgtctggaaggatcccccaaatagcacatcttcctttcacaatgaacttcttggttctgggtagtgtgtctccttccctgcaatgtcatcttcatggttcagccttaatggtggaatactgcagaaggaaagaggtagagtgcctggtactccataaatgtagctaaataaataaatgaagatgtgaaatgattacatttgtctttgagagtggctaattaatgtttgtttttaaaaggttgagcttggagatgtggagacaagagcctggactaaggttgtaaactaaggtggtaatgataa

SEQ ID NO: 468179 - DNA, 1162 bp, Homo sapiens
ctccagacctggggtcgtgttctcagaggactgctttgccttttgaactgataattgcaaaattccatacggaatggcccttgtggataagcacaaagtcaagagacagcgattggacagaatttgtgaaggcatcatgaatggacccctgcactcccacccccgatggtgctgctggactgccgagattgcaccgtggagatgcccatcctgaagaacctggccaccatggccttctgtgacgcacagtcctcgcaggagatccaccagacggttttaaatgaagccgtgggcgccacgatgtaccacaccatcaccctcaccagggaggacctggaaaagttcaaggccctgagagtgatcgtgtggatagacagtggcaacgacaacgtggacatcaaggctgccgcgagctcggaattgttgtgtgcaacatcccagcatggagcaaatcctcgaggtggccttgggagtggtccgcatccgtgggtagacgctgtgggtctcatgagctttggtcgcacgaggcaggcagttgcatttcaagccaaggcctttggattcagcgtcatattttatgacccctacttgcaggatgggatagaacggtccctgggcattcaatgggtctacaccctgcaggatttgctgtatcagagttactgcgtctcctcgcactgcagtctcaatgaacataaccaccacctcatcaatgactttactataaagcagatgaggcagggagcattccttctgaacgcagcccctggtggcctggtgggcgagaaagccttagcacaggccctcaaggagggcaggattacgagggacagctttgctcagggtccattgaaagatgccccaaatctcatctgcattcctcacactacctggtatagcgagcaggtgtcgctggagatgagggaggcagctgccaccgagttccgccgagccatcaaaggtcgcatcccagaaagcttaagaaactgtgtgaacaaggaattctttgtcacatcagcgccttggtcagtagaccagcaaacaattcatcctgagctcaatagtgccacatacagatatccaccaggcaccgtgggtgtggctccaggcgacttcctgcagccgtggaagggatcatccctggaggcatcccagtgactca

SEQ ID NO: 468180 - DNA, 599 bp, Homo sapiens
agaaagatttcttaacgggttgagggtatccagtggtggtgaagagaggaaaggtgcatggaagatgagggacaaaaacagcagatgtccaattcatggacaagtctgtgctagtcagctgttgctacaacaattactgaatgagtgtgacagtcgccacacccccacccatgggacttgggcagacaagctgatcctgaaccatgtcttcagtgataaccacttcaggcctgagaaaggtctcttttcaaagtgcttctgttcacagtcccaggaaggaggtaaggaggtgtggcttacatcatctggggtcctttgtccactgcttcgtgtctacataacaacaaaagctgtcaatgatggcacaaagatggaacgcagaagacactgtgactgtctcatggggagagtctgtgtaagaaagaaggcaagtggtggtgagaaacacacccaaggcgtccatctcattctgcccccagagcagtctggcttatggttcagcttcaccagggaaatgtctttgactctagtttaggaaggaagcgctgagacaaaaggtttgagggtggtgaggtggggtggaggtgagcgtatgcagg

SEQ ID NO: 468181 - DNA, 608 bp, Homo sapiens
ccttgctctggaataggctttggcttaagagcccaatcgccaactgactgctccccaccacgggttacagcaatgcctgcatctccatctcccttgattcccactgtcaccaaagatgctgtttacagctggagaaattatattgagactacattactgcacacacacacaatcaaagtgaagtgccctaatcaaccaactgcatatattcaacttgaggaaaaagtttttccctacaacatcgaattcataaattggaagaagcaactgttacaacaggtgcacagatatcaatgtaaggacaagaaaacacgaaaaatcaaatttgtcatctccagaacacaaaattcttcagaaatagatcccaatcagaaagaaatttataaaatcctagaaaaaataattcaaaatattgactttaaagatcagagtaaacccccatatgttaatagtaaccttaaatataatgaattaaactttccacttaaaagatataaataggccaaatggataaaactacataattcaactatatgctgcctacagtaaactcatctcacctgtaaggacaaataaaggctgaaagtgaaagaaagaaaagcaatagt

SEQ ID NO: 468182 - DNA, 577 bp, Homo sapiens
tatatatatatatatatatatatatatatatatatatatatatatatatatatatatataaaggactgaacatagaatttcttcaaaaccccttcagagaccttccctgtttgaacagctttattctactctcctatttcattggcagtatggctggcacaggattccaagttcaaaagcatttcctcccaatatttgaaagcattgttccattgtcttctggtttcccacatagcttgctcccgccatctctaggagagtatcacatacctgcacctgtgctgtgtgacttgcagtgcttttctatgcaaagcatgttgtcctctaccccatttgtggcagacatggccatgggactggctttaatggaatgtgggaatgtggctgttgctacaatacaccacccagatttccctccaggaatgaaggataaaatacccccagctgctgggagagctgccagaaaacctccctcagctgttagccctcttcagggattgcctgcgctgaagaaaattgccctacccaagatcatgtttccttccagaagcagcctacctcccaatgactgatcagc

SEQ ID NO: 468183 - DNA, 898 bp, Homo sapiens
tctgctgagagctgaacactcaatgggacgacccatctacagagaggggcaacccactgtgggtctcttccgagctgttctaacactccaaataaagcttctcttcatcgtgttcacccttcacttgtctgcatacctcattcttcctgcacacaagacaagaacttgggcaaaggtgccaccagccacagaggtttccagccagagaagagacaccccaaatatcccccgggagcttcggcaagactcacgtctccaacaaccgagctccctgggtgagcaattcctgtcccttttaagggctcacaactttaagggggtccgctttacaccaaaccagaatcaaaaccaaaatcagagtatcaagaaatccaagccaggtcgaaaccaaaacgaaagtatcaagcaatccaagtcaagtcaaaaacaaaaaccaaagtgccggtataggcacaccgtgggtgttcaggccacactgccactcaaatggaatgggcaagttccaaagactagtcttagcaagtttcagatgtctggactccaagtgccagttccttcccggtgttcagccactgtgttaatcctctgtgggggcctgcatgcgctgctctggcaaggcattccaccggggcaattgcctacccaggagcgctctcaggatctgcgttgctcaagctggctggagtcccccgcagggatgttccacagggcaagcctaagccacctaaggggctgcctcaaccgtccattaatcacctcgcttcccggtcagggaaccaagaaatgcagcaggacaagccgcagacaaaacccctcagataccaagttaaagaaggaagggctttattcagccaggagcttcagcaagactcacgtctccaacaactgagctccccag

SEQ ID NO: 468184 - DNA, 1221 bp, Homo sapiens
tgttgcacgtcctgagaggggggtcaaggaactctcctatttcatttggacccctccacaactccacccgatgcatctcttcctttggctggttactgagaatatacaagctttcagtactatgaatcttgcaagcaagttattgaatctgagggtgattttgggaaactcaaaacttatagttgagaagtggggcattgctacaaagatacctgaaaatgtggaagcagcttcagaagtgggtaatgaacagaatttggaacagtttggcaggcttagaagaaggcaggaagatgaaggaaaaggatgtatggaaatgcctggatttccaggcagaagtctgctgcaggggtggagtcttcatggggaacctctactagggaagggtggaggggaaatgtggggttggagccttcacaaagagtttccactggggctgcctagtggagctgtgagaaaagggcctctgttctccagaccccagaatggtagatccactgacagcttgccccatgcacctggaaaagctgcaggcactcattttccttctaacagtcaggcccgtctgctacaggtctgcaggagtttgctggaggtctgctcccaaccctgtttgcctgggtatctctggcagaggctgcagaacagcaaagattgctgcctgtttttccctctagaagctttgtcccagaggggcacctgccagatgccagccagagctctcctgtatgagatgtctgtcagtccctactgggaggtgtcttccagccaggatacacgggggtcagtgacccacttgaagaagcaggctgtcccttctcagatcttgaatgctgtgctgggagatccactgctctcttcagagctaccaggtagtccctggctggggctgctgcctttttttcagagacgccctacccagagaggagggaatctagagaggcagtttggttgtagcagccttgctgagctgcagggggctccacccagttcaaacttcctggagctttgtttgcactatgaggatgtaggctcctcccgagttgacctcgcggatctgctccatactctgtacccgcatcgcttcccgcagcgtctggtacagccacctgttcttccggtacagatggaagtggaattgactatctgttccactgctatggacaggatgctgcacacagcgatcctgagcttgctggcagccctgatgttctcatagtc

SEQ ID NO: 468185 - DNA, 1019 bp, Homo sapiens
ttgcctcagctgctctaacacgtgaccacagtttagacgcacaatggaccaagtggaaggcaaagcacaagagattatatggcatgagaaggacgtgaagatgattgagcagcacaatcaggaatacagccaagggaaacacagcttcacaatggccatgaacgcctttggagacatgaccaatgaagaattcaggcaggtgatgaatggttttcaataccagaagcacaggaaggggaaacagttccaggaacgcctgcttcttgagatccccacatctgtggactggagagagaaaggctacatgactcctgtgaaggatcagggtcagtgtggctcttgttgggcttttagtgcaactggtgctctggaagggcagatgttctggaaaacaggcaaacttatctcactgaatgagcagaatctggtagactgctctgggcctcaaggcaatgagggctgcaatggtgacttcatggataatcccttccggtacaatcccaagtattctgctgctaatgacactggttttgtggacatcccttcacgggagaaggacctggcgaaggcagtggcaactgtggggcccatctctgttgctgttggtgcaagccatgtcttcttccagttctataaaaaaggaatttattttgagccacgctgtgaccctgaaggcctggatcatgctatgctggtggttggctacagctatgaaggagcagactcagataacaataaatattggctggtgaagaacagctggggtaaaaactggggcatggatggctacataaagatggccaaagaccggaggaacaactgtggaattgccacagcagccagctaccccactgtgtgagctgatggatggtgatgaggaagaacttgactgaggatggcacatccaaaggaggaatttatcttcaatctaccagcacctgctgtgttgaatgcacacttcaatcattgaagatccaagtcactgacttttttgtgtagttgtattagtctgttttcac

SEQ ID NO: 468186 - DNA, 2144 bp, Homo sapiens
ggttaaagagagaagaggttcttatgttttatcttctcttcttgtctgcatttgccgcgttgaacacagagaaggagaaaaaacctgaatctcagagactcactgaaaaagccccagcattagtaccggtcatggctcctgggccaggacttcaaaggagcctggaactggctgtaactggaaggaggtcctggatctgcataccagggctggcgaggtgcctttcgctggaagtcctgactccttctcaatgcacaaggacgcccttctgctgccaaagctggctggtggttctttctggaatggcagctttccccatcccccttcaggcttgggtcgatcttctggcaggcaaacgtactaaagagttacaggtggtgcagatacgatccacatcctgccctgggggaattgacatccatcagattgcttctttaattggtgggtctgagtgtggccccatttacccagtggctgtgctaaggtttaacgactagaccagtggtttgcactagcacttgtcctagttatttgacactttttgctgtaggtcaaacttcactttcatatgtcactccctccactctctgctggctaagtgttaagcaaggtgatttctaagatctttcagtctctaagctgatatatttctgagtcgagcaaacatgaaatttaagtgttgtcctggaaaatccccctctacttaaaccttttcctttcaggggataggcgtgtctttccagaaatagagttcaacagcatcaagctaccatcatccaatggaagtgataggaaaaaaattacctagatgactcatttatcttgtgaaccatggactcataaagaagaaaacacatagcaggaacatacatatgttattacatgctgagatagtaaggttaaagaaagttagagaagctttccagttggtaatgtaccacaatttatatctgcagttgtctcttttttggttatttcagcctgctgtgtagaacattctttacactcatcctggtgtacatgtgtgcaagtttctgtagtctagggcatagacccaaggtggacacgtttatattatcaaactgttctccaaattactcttactttcttctgacatgtgtaatgtgatgttaaacatgttcgtgtaatttttattataaatttttccagttttagaagttggttttttaaatgacaatgccactcattaccattttctattctctgaagtatttttaaatttatccttatttatttaaatacataaattattgatttttgccattagtttcagaaactagttgtgattactaatgtgtcctagctcccctgaggctctgctgtaaaatagccagtgaatgaggattttttaaaggtgatgagttggccagtgatgagggagggcgaagagtggccggtggggtggggtggggggacacagaaagcatacatgtcttgactcagtgtggttgatggccagaacccattttcaatcctatgaaatcagagctttctcttggcaaactggctggtttattagtagtgaagttaatttgaaaaatgaaataacttccaacaagttaaaaagtaatgctttaaaaatttcactgtattaattttaacattggcttttcatgttattacgttaattttatatgtgatggttcaagtgaaaggagttgttctattttaaatatgacattctatttgtgaatacaattctggaaatattgggagaaacgtaattggtaaaagtattttctattaaattctctgggggtggtggtggaatgttttcttaaattattttggttagagggcaaacactgtcttttaatgatctttgaatcagcagaacttatttagcatagagactgacatacaaaagttaataaatagatgcaagaaaaactaaaacacagcatgaagtggtggggagaacactccacacaaacccagaagtctttccctttggcctcagctctatcactaatatgctgtgtgatggagacaatcacttaacctttctgcagcagactctttctttatgctgcaaggcagaggagtgaaataatagtggtcttaaagagttgctctgcttgcctcatgtattagtccattttcatgctgctgataaagacata

SEQ ID NO: 468187 - DNA, 522 bp, Homo sapiens
cccacatctggatagagttagaatgagcgggaattacttgcagcatttaaatataggcctgtacctctgggtccagctggtgtcacaatgctgcagacctttggatgaatgtgaatatccatatgctccccacatctctcagccccttggcaggaaggtagccaatgagctgcagcatttgaaaactgatgtgctacctttagctttctcttctgttgtcatggtggccttgaaagtacgtgcaccaagattcacagcaataagatttaagcagattgagtccctcagctgtcctggaggacaagtgggcagacggaagcccccagggccaagtgacaggcttgttctggctctgcctggctcaactcagggattggaaggggaggcacagaattgtgccaggagctttctctatgggctcctctgcttagacccagctggcttggcttagcaacagtgacatcgagggggcaggattcacattcccttttcagaggctttggcagcctctgcagctgtagc

SEQ ID NO: 468188 - DNA, 674 bp, Homo sapiens
ctctagatttctaaaaagagaggaagatataatgatagtggttatgacgtgtggttggggaacagccgaggaaacacttggtccagaaaacaccttaaattgtcaccgaaatcaccggaatactgggccttcagataaaggctatggttttgatatttatcttgctgtgcctacgccttatgtcagacccactgaagtagaatctcaggggagtcgcttggatgtttatttgtcacacaatcctgcgggaacatctgttcagaatatgctgcactgggctcaggcttcaagttcctctacgaagaaagatgttcaggatatagggcttcctactgacgaggagacagataggtcctcttatgagcatggccttccagaatttcaacagcagcagactgctgcctctctgaatataaatcatgatgagaataattttaaactaaaaatcaggactaaattggaatgagtaaaagattgtaccaattctgtgaattacgataagatttatcatttttattacttattttcttaatctttattgaaatttagcttatgtttctaaagactggggcataatgttaatcttctttgtatatttcttctgtactgtctttaaatgtacactattttcttatattattttaacgtgcttattttattttaggctgttaatt

SEQ ID NO: 468189 - DNA, 768 bp, Homo sapiens
ttcagttacctcccaccagagatgtcctacgttgggctgagatgaccaggcctttagaccgcaaacagagtgaaatcatccaacatcaaggctatccctgtgaggaatatgaagtcgcaactgaagatgggtatatcctttctgttaacaggattcctcgaggcctagtgcaacctaagaagacaggaaaatctaaaataacactgagttccttcctcctggcccttcactcacagtccacagtgacccacacgttctctcccttgagagacaaaatgaggcagatggaattcatgaagactgtcaagatgctggatgagtttggtgtagaaggcttttgtcctacagggagactgcatgtgtgtttggtgcccgtttatagcaataacaacaagagctacccatctgatctgagaatactcatggtttgttacagagccgagcaagtgtatatgctgcccacactcttgctggaacatctgtgcaaaatattctacactggagccagagatatgacggtccctacagcaatgtggacaggaggtcaggactggctttcaaatccagaagacgtgaaaatgctgctctctgaggtgaccaacctcatctaccataagaatattcctgaatgggctcacgtggatttcatctggggtttggatgctcctcaccgtatgtacaatgaaatcatccatctgatgcagcaggaggagaccaacctttcccagggacggtgtgaggccgtattgtgaagcatctgacactgac

SEQ ID NO: 468190 - DNA, 609 bp, Homo sapiens
cagattgcctgtgaactcatcactaggagatgatccaagccattcatgagggatccgccaccatggtccaaacccctcccaccaggccccacctccaacatcgggaattacaactcagcatgagatttgatccggggcaaacatccaaaccgtatcactccctatgcaagaagcagacaacagacagattaaaagacacgatctttgctcttgagagctcctggtttaatgggggaaacagctgcagagacaactgccatatcatgtatagatcttcttgtcaacaccaggaatggggcacaatgagattcattttgcagatgcagacgctgaggcccaaggaggtgaggcaaactgctcaagacctcatgatcgccagcagtttgtgtgaatgtttattggcagataccacatgggcaccagccaatgagaatgaacactgtccgtcttgccatattggtgcttgtattagtctgttttcatgctgctatgaagacatatccaagactcggtaatttataaaggaaagaggtttaattgattcacacttctgcatgggtggaaaggcctcagggaacttacagtcatggtggaaagggaagcaaacac

SEQ ID NO: 468191 - DNA, 1061 bp, Homo sapiens
ttaagagtggcctttgaatgcccattgtctttgcacgatgctggccatgcagctgacggcacaattctatttcttctttcctttgggttctcttggtgataggcagtttgccatcggccacataatgacaaagaaatccaaagaactctctcaggctctccagtatttggcccaaacaatagcagcagggaactgcagattgtcagagctggaagactccttgcaaattaccaggggcagctcttttacagatgaggaaaatcaagcccagagagaaaacgtgaccccccaaggccacacagccttgactttgggtgaattgtttaccctatctgggtaccactttccttatctggaaatagaaagtgtagagacctgtggtagctcctttgagtgggtgttaggaagacacaagaaaggaggtccctttagcaaatgtgttatctgaaagcaaggtcctcttaaactccctgttggaaatgctgggggctgggatgaaggactgaaatgtaactggattgacgtccttttctcttctgctttctgcttctcttccctgtttcacaaatctgtgatcaatgcacaaattgatcacagtggagcaaagacagacttctgagagccctttgcaaattgggactctgaggctgtcacctcccctgctctacccaagaagtaaccatgatcttgaaacacctctatcctttcctgtttttttttaaaacaaaacaaaacaaaacaaaactttattttgattgtttacatatgtatccctaaataacatattgcttattttttgagcttcataaaagctgtatcatattctgtaaggtcttctgttacttgctgttttcccccatttaaaatgatatttctaagattcatccttgttatggttcgaggccgtgtttcatctgcttttctctgctggagcacattgcatggtaagagtacaccaccatttacttatccatactccttttgatgggcacttgggttggattcagtgtttttgcagttataaagagtggttctatgagtgtttcaatatgtgcacacac

SEQ ID NO: 468192 - DNA, 595 bp, Homo sapiens
ccgacctgggtttggaaaccttcttcaccattcattagcagcatgaacgtggaccagccaaatccgtccgtaaggaagtcagcagccttgtgcaccaacagccaacttcatggctcagcaagtgaccaggcatctgcccgggtcccggagggcaacccattgaatgctgcccttgagtcatccccaccagtgtccccaggcataggacatcacagccccagcaggcagagctcacgggaagcctgctgctcccagggctttggtgtttttccagaagaaaaaggaggaggaaatgaaatggcctttcctcatttgctgtgcagccctttatccaagtgtaaatcaaactcctccaacacacacctgcacaacagcttaagaggaggagagtggagtggagaggaatccagacaagaagactcaaaactgctccttctgggtgacagaggggagagagacagccagagaaagagagaaaaaggggataatgagaaagagaaagggaagaaagaaccgtgttcagcatcagcagggaagcgttgccttggctctccactggcaaccactggataaggagtgatgatggcatcctgac

SEQ ID NO: 468193 - DNA, 5264 bp, Homo sapiens
gacttgggtgaataacggcatcattcgtcagccaggacgttcacggagaagagcagagacgggttctgacggttctgctggtgagttctgttctggaaatgctgctgccacgtggagatgttttgcaggggatggaaagggagttgtgagtgtgaggccatgggtgtgggcactcagatccgtgtgcgaggccatgggcgcgggcactcagatccgtgtgcgaggccatgggcgcgggcactcagatccgtgtgcgaggccatggtgcgggcactcagatccgtgtgtgatgccatgggcatgggcactcagatccgtgtgcacagcagaactaacccacctccaccaaccagtcagataaatgggaagatgccaccggacaattgcagagtgacgcatttcttaagatgggcaaaggacagattagatttattcctgagctatcactgcttcttgtgtttaaatacctatgaggaaattctacggacttatgggatccccatactgctcctcaaacacacttgcagaaatcagaaactacacacggatggctccccgtgcatcgaacacagtagacaaactcgctaggcggtatagacccccatgggattgtctgttcatcccagccaccaggagcagctcagtgcctaagacttgagcacattctcaaggaaccaggttcatcacagagtccctctctggctcctgagaatttcctcttcattctctctcggaaaattcttcctggaaactctgctaactgctttaatgcaaaccaagcccctgctataagtaacaccatgattgccattttagaaatggggaaaccagggcttaagcaacgtgctcaaggccacagggccaccaggagcctgcgttcacacctggcactgcctggctccaaactgctgtgactgcagccgaccccgctcccatcgcagaccgcagatcatggtgactgatatggtttggctgtgtccccacccaaatctcatcttgaattgtagctccccaaattcccatgtgttgtgggaggggcctggtgggagataactgaatcatggggggcagctcccccatactgatctcatggtagtgaacaagtctcacaagatctgatggttttagaaggggtttccctttttgcttggcctcattctctcctgccgccgccatgtaagacgtgattttcagcttccgccatgattgtgaggcctatccagccatgtggaactgtgagtccattaaacctatttttctcatcagtcttgagtatgtcttcatcagcagcatgaaagtggactaatacagtggctcaagtgactaccgagctatcttgctgtcccctccttgccagtgccccatctggctagtgccccgtttgcttctaaaagtctcctcgtttaagcaaagtttgtggtcaccgtccccacatatcctgtagcctctgatgagggcctcagtgtcaaaattcccgccactccctatgcctcctcacctggaatccccatccgtatcttaaaatgcaactgttgctattcaaatctgtctccttccaaacctgttcttcctcctctgtgtccctagtccttttaatgtgtccctggggacacttccaaggaagccgaggaatcaggaccagcccctctatcaactaactcttcagtcctccattaacaacaagccacctacaatttaatattcttgccaataggtggccaggtctatgaggaccaaaaagacaatatggtaaattatgatgaaagtagataaacataaagcattatttatgattgataataaatcttgtaaaaggccattttcagacaaatccagcatgatttgactcatgtgaggtacttgaagtcatcaacttcatagagacgggaaggagaatggtgccagtcaggggctgaggagggaagggagactttaacggggagagagtttcagttttgcaagacgaaaaatgttctggagatggatggtggtgatgggtatataactgtgtaaataaactttaggccactgaactgtataatttaaaatgactaaagtggtaaatttgatgttacatatattttaaaaccattcttaaaaatgaaaaattttttcaataaaatatctcaatgaaaccacccaaaagttcttgtcaatctcttgcattaactgctaaacgtgagctagaaatctaccaggtctcatttgaagtgcatgtaagtggcgcgcatgtatatatttagccaggtgtccaggaaaaatgattctgagaaacaagactccaaaaaaagatgctaaggaagacaatgcaagcaggcgaaccttcttctgggctaaagagctaggagagcataccgaactgctggaccaatgtatttgtcccataaaaaaaggactggaaatgaatagaaagtcacttggtttgtggaaaggcagagctgtctggaaaaatggtcaatgtatattttctgatctgtttcctaacactaactaattttcatcactacccaatgaaaacactctggggaataagaaaaagatcggacatgagctgacttctatttctttgctagaaaatcaaaaatctgtattcaaagagaacaggacaaagaagaaaatactgcccaaaatgttaaatatacactaaatgttgttcatcactcttttttaagacgtgggaagccgtagggtctggggaattaagcaacagagaaaatgtcaagagcaatggaattgaaccccaggcagatcttaatagcttagctagtttctccacctataaaaatcaggacactcttactgctgtttctgttaggtaattaacagtcataaagcatgctgaaagtagaaactgctaaataaataatgactgcaaaagaattttaaccataacgcactaagtaataaggataaaacatgggcttttaacttgaccatttttgttttcaaattaataatgcaaacaagagtccaatcttgttaagatggctcagcatagtgttagatagcaagttaaatttagtcattacaaaatacagaaggaatcttgcttctccaagagcagttcacccaactctaggtggagctgtgaaaataaagccatgttctattcctgtaagctacagaaatgttgccacgttgcctgtgtctacactttcgtgaattccagaaagaggccattctacttgaaaacctactaagcaatcaactttttgggaatttccatttatttcacattgattttggaaccctaaacttcagtaacgttttaaacaattttctgggaattggcaacacaatgatgtcagccacaatgactgttttccacatttcccaatcccctggactacatatgtatgagattgtaggcttatttaagacctttgcagacattttatagatgcatagtgaggaaataaaaatggagatctgagcaccaattctatgattttccttctaaactctttattccaatcatggtattgagtaagtcataagatttaaactatgaactaggagagctaactttattttactattcatatctattcatttttgcatatatacttgaaataactactgagtattatgaaatcctaggaaaaaaaaccaaagaattataaatcacagaaagatgggaaagtcttggagatcaaatccattgtaattatttatcactgaaaacccaccacctagaaaatatggttttctacttaaatataaagtatgatcaggattctgttcacaaaatacagcattctgtgaattttcttgcacctgtaaatacgctatagctataaaggatagtttcaacatcactgaacaaacaagcctaaattctgtttattagacatttggggagaaagtcatcctccaggtactattttgaggaagaattaaacaactacgaaagaaatcaaagtaaaggatataaccacattaaaatacaaatgtacaattttgtcctgataataaccgagacctggaatctcagttttagtgactcacattaatttaattgtgacatttgcttttctaatcatagatgtaaaaagaccactgtgttccaaacataattatcttgccagcatctcattgcatgaaattattagttaagatgagagcctctgactacatttatgtttgattagtttcactgatttaagaacacggaataatttaagatctgtttaaatgaaagagaagtaaggccccttctgagaagggctgctttcctccacacgttgccatttcgacaaactctacattccccccagcgactgctacccccagcgatgattgtgattaaagctgccataaacattaaacattctggtacaacttttcatgtaaacagatgggaccgctagaccatatggtaaatgaatatttaaccttctaagaagctgccaaaatgtttgccaaagttgctacagcattttgcattcccatgagcagtgtgtgagagttttagttgctacacatcttcatcagcacctggtattgccagtttttcaaaatccagccattgtaatagacaaaataatttctattttcaaggtcatggactctttcctctctcgttccgattaagctaatccaataaatttgttgatttcaaatattgtatttttgagttctagaatttctcttttttatagtttctacttcttctctgggacttcctatcttttcattcattatgagaatattttcctttatatctacagttcttaaactttaggatcagaatccccttgaaaatcttttaaaaatataaacttctgggcttctccccaacgttttgattcagttgattgtaggtggagccagagaatgtgtatttctgaaaagtgcccaggtgataccgaggctgctggtctcacgaccaccctttaaaggaccactgctttacatcacacttagttacaataggggcttgaaaatacttgtctgctcattccaacacctgggtcatgatgggtttagtctatgcttggtttagtctatgttgattatcttttctattgataatgaggcgattttcccatttcttcttttctattgggaatgaggctgattttcccatttgtcttgagcaatgtgggaattaaagaatggatattttaaatgttatgttgtggcgactctggattacgttatattcctaccaaaagtgtcaacttttctattttatcaagctatcaccttggttggactgaaactacagactctgcctcttgagaagcagctcaaatctcaat

SEQ ID NO: 468194 - DNA, 1070 bp, Homo sapiens
ttattgttattgtcctgtgcatgcaaagcacctcttgtaccaccatattgtggtcaccattgtttatggttattgctgtcattcataacagcatctttgaatcttatacactagacattcaaagtggaggcagtgggagggtaacagcagcaccaggtctgcagtgtagactggcagcaccgggtctgcagtgtagactggcacaaatctttggcacctgccagagacatgagttgctgctgactcatgatgactatatccaggcaggaactctctctgtccttgacattgaggatgatgagttgggtgtttgtgtaaatgaatgcatgccctccgactgcattaacagcccaaatctcctgtgcggtgcctcagtggtttctgatcagtgcttattggatgaatgatagaatataggatcggaatggatgtcaagacatcattgggtttttgtcatcccttcagtttaattcgataaatatttatggaagcctttcttgggtgagccacgtagcataaatgagggagtttggcatttactggaaagttctgcacatacagcatggatatctttcatgttttttaaagttctccaatggccagaagtttcagtggcaaaccccgtcagaaaatattgtcacgctcttgcagtaaaacgtttctgaaatcgtcattcatcaataatataaacattagagtagcaggtttagccaaactcttaattgttttgtctttattcttgagtcttctcaatttccgttacgttgacttagctttcaaactggtgggatttctatatggtcatagagggattttttttttttttttttggttgttgattagaaagtgattttcagaaagtgaaagttagggctggaagatacagcaatgcattttatagtttccaaatttatttctgaaatacggagttgaagttcagtaggataagatatgtggctatttgaggccagactacaaatacctgtgtttggatgctgcaacctctcagaatgtctggcttctcttttcagtatatgaaacaagagtgtttaaggggttttgtgtagttt

SEQ ID NO: 468195 - DNA, 667 bp, Homo sapiens
caggctgagagaggattaaccacgtgcagaaggcttgttatgcactgtgctgtggactcttgttgtggggtcctaggtctgcccagcattttggggttcaccccagagcctgcttcctatgactgcgtgggccagctggagaaggacgacccaagacccctcaagtttctgtgtcctgaccccaagcataggcctgagtgctcctggggcccaggggcctctacgcactactctctggggcccactgtctgcactctcaggcctggggggctccccctcctgtgcacctgtctctcccaagcaggtggacaccaacgtctatgtccccacctgagaatccgcagccaccttgccagccttcctggctgtggagccttccgccgggcgctgcccacagtgaccatttgcctcactctagaggcgcaggccaccgtggagctgtgctggtggactggcagtggtgtgcagtttcctcagctgcacctctgcatcccgcagagcaatgtcccagccttcacaggcagctgcttcttcccaccatcccagcaccgtggcactgtcccaatgcagtgctcccgcggctcaggggacttgcgtcttctgaccacttcctggctgactgtcaccttcaactcttgataaagcagcagtttctatatcctccatc

SEQ ID NO: 468196 - DNA, 2181 bp, Homo sapiens
gtcttcctcctcttcctcccttttcctcctcctcctccaccttttccacctcctcctcctccacctcttcctcttcctcctcctccacctttctcttcctccacctcttcctcttcctcttcttcttccacctccacctcctccttctcatcctgctcctcttcttcctccttcctctccttttttgtctccttcttttcctctttgttctcctcctctttcccctcctcctcttcctcctgctcttccccctccttctccctctcgtcttcttccttctccacttctttcttcttcatctcctcctctttcttttaaactctttgccctgagaacatgttactcagaggcaagggggtgggacaccttgtctgtcgtcacagaaaggaagaaggaaataggagggatgcagctgcaagcctgggtgttgttccgtggcaggaagtcgagggggctcggggcctttatttactctggaaaatagaaatcaagacagtcacccaagagcagggaggctgtggcctggctggagccctgtggcgggaaggagaggcccaggatgtggctggaggcctgtggagggaaggagaggcccaggatgtggctggaggcctgtggagggaaggagaggcccaggatgtggctggaggcctgtggggggaaggagaggcccaggatgtggctggaggcctgtggtgggaaggagaggcccaggatgtagctggaggcctgtggagggagagaggggcccggggcatggctgggggcctgccacctgtccgctagtggttcatggttcaggagttggggacccctgccttaatacatgcttgttagttaattgattgattgggaaagttctcgtgaaaaagaatgagtgagaagctgctgacctgtgaaaacctttgtactaacatgatcttttaaataccacaaaggaaactgtgactttatcaaagcaattaaatccaaattctttttcttggtaaatgtgttactttgcaaatgtcaaatgtgcaaccaggaggttgtcaaacaaaaatgtgtttgctgcaatgtatatttagtgtgtatatatacacatgtatgcatatttatgtgcttgtatatgtatatacatgtttgtatatgtatatacatatatttatatatgtatatacatgtttgtatatgtatatacatatatttgtatatacatgtttgtatatgtatatacatatatttatatatgtatatatatttatatatatatgtttagatatgcaaacagtcgccacagtgccccaattgcctgcaggattccacacagtcacatgccatgaagaaaaaccacatctgttttcctcactgctgcttagagcacccaaactttgtcaatggggtgcttcttgtctgctctctatgacctggaagtttctttctcccataagtgaaaaaagtgagagctgagagaaccagccccatgagctgcaggtcctgctggactccacgtggaagcacagaagagacgccgctcctgtgcgtctgggaagatcccgtctgtcatctggaagtcataaaagccactttcggaaacacagatgtcacttttggggaacggtcgtcatgtttcaaggcccttccttgggtttgaactgggagggccagagtcggcccagggaatggtgattggcacatggaggtgtcctggcagcggtggccgccaaggggcggtcggccctcctgtccccgccaccctcagccccgctgctgggcccttccaggcctttctcccagctccctgcgtcgcctcaacctcctgctctcacccgctttgtgactccaaccagaacagcccgtcacttcatttcttaagagtcttccttttgtgcctttcacattttcctctaaaatttaaactaacgatttgtgtgtggggtgtatacattgtgtgtgggtgtatatattatgtgggggagtatatattgtgtggggtgtatatattgtggggagtgtgtatattgtgtggggtgtatacattgtggggggtgtatatattttgggggatgtatatattgtgtggcggatgtgtatattgtgggaggatgtatatattgtggaaggatgtatatattgtgtgggggatgtatatagtgtgggaggtatgtatatattgtgtgaggtgaagtatatattgtggag

SEQ ID NO: 468197 - DNA, 552 bp, Homo sapiens
aggacaggcatttctgttttcatgccaaaatgttgcatttcccaagaccaccctggcccgccacacctccatcctgtgcctataaaaaccccaagtccctgttgggaagaatacacaagcagccggacatcgagaggaacacagtggcagaacagcacaccgacaggtaccagcagactccagcaggccatggactggcagaacgacacacaggaatggctcacaaaaggatggaggtgccattcctgtgtgtctgcaaacccctccccaccactcagaaaactggaagctgaactactggctctggctctcatcacctttggaggaccccacagaaattcctgttctttagcaaagggttcacctgagacagatgtctctataatgtcacagacaaaacatcttcattttcttcccacagctttgggagacttgttagagctctatataccatgaggctagagctaagttttctcaccacttatggagagagtgaaagaatctctgcagtggcctgctaattccctctctcatctattgacttcccatacc

SEQ ID NO: 468198 - DNA, 896 bp, Homo sapiens
gctctctctcctcctgccattcaagatgccgaaaggaaagaaggccaaggggaagaaggtggttccggcccctgctggcatgaagaaacaggaggccaagaaagtggtgaatcccctgtttgagaaaaggcctgagaattttggcattggacaggacatccagcctaaaagagaactcacccactttgtgaaatggccccgctatatcaggttgcagcggcagagagccaccctctataaacggctgaaagtgcctcctgtgattaaccagtttacccaggccctggactgccaaacagctactcagctgcttaagctggcccacaagtacagaccagatccaaagcaagagaagaagcagaggctgttggcctgggccgagaagaaaactgctggcaaaggggacatccccactaagagaccacatgtccttcgagcaggaattgacaccgtcaccaccttggtggagaacaagaaagctcagctagtggtgatagcacacaacgtggatcccatcgggctggttatcttcttgcctgccctgtgtcgtaaaatgggggtcccttactgcattatcaaggggaaggcaagactgggccgtctagtgcacaggaagacctgcaccactgtcgccctcacacaggtgcacttggaagataaaggcggtttagctaagctggtggaagctatcaggaccaattacaatgacagatatgatgagatccgccggcagccgtcagtagtaacagagctgatgggacaatggctcagagaggaggcagtgctacaaacacaaggacctagtggagagcacaccacagacatgtcgcactagggggctgccttgggagaggcaactgttcttcctggttttaatattttgtttacagatgaat

SEQ ID NO: 468199 - DNA, 522 bp, Homo sapiens
tgcattgcgcaaaatgtctagttttcaaaccatgtaaacttggtctgggaaaagagtgggctctgtggaatgttgctccttcagcagctgatgtgaagatgcttatggtgaccacaagccaagcctctgcaggagtgggaactaaacaatgggtacgaatgatcataaagatggaaataatagacactgggggctccaaaagcagagaggatggaagaaggacaagggttgagcacttacctgttgggtacaatgttcactactggtatattggggacactggaagcccaatccccactgagcttgacctccactccaacgcagcatcccagggtcacaacctggaacttgtcatcatctacaccgtgttttggagcccacatcttaaactccctgtcccttcagctcttcctcctcttcttggcaatattctctccagcaccttcagcacaagcccccgtctccagcttcgtcatgcccccctcatgcatcatctcccctccatccgtgctcggtgaagcc

SEQ ID NO: 468200 - DNA, 816 bp, Homo sapiens
ttctgctttcagttatttgataatgatgtggcttttaataactcctctgtcaactccctactgccctattccacagcacacccatttttacttaaagactttaaaggaagcaacatcacaaagagaggcatcccagagaaactcaggagagacttgggcgtggaggatgcagagaatttcactgtatgtgtgttggggggctcttggaacttctaatgagagcctcaaggaggggagattctttaaaagtggggatttggctgacaccggttctagcttcttcctgggaactgcgttcctagttcttagcccagctgtgaggctaggtcttctcactggcggctgtcatacttcatggacattcctgcctcttagtcaacttgctccttcaaagttgactgttgctcctgactgttctcggaccccagcctcttggcccatctgctaccagcactacacctgtctgtcagttccacccggaaatgcctccgtgcttgacctgtttctccacatcaacctcccctggagctcgagacccacattccctacattctcactgcctgccccgctctcacagctcagcaggagacagatgcaaacagttacttaaaccagcatatcattaatatcttaatcagtacagtgttttggcccaaatataaacacaaatctttcccctctcatttggaaagctgagatgcatggcgactttaaaatcactgcatattactgaagttactgaatactaaatgactaaatatgaagggaaactcaagtggaaatacacgagcacacatgagaaatgtaaacattggt

SEQ ID NO: 468201 - DNA, 603 bp, Homo sapiens
agcatcgcctggaattatactaaattattcacttatttgttttttaaatgttttccttttatgaacagggacttttgggctccatctctctcccctccctcaacatggcttcctaactccctccttctgttctctcaatgctccagcccacacttgctcaatcttcctctcctcgatatcctcacccttcctggtgcaataattttccagctgcctcttcggggcacctgggttccaagtttggaaacagaccttctcatggtcatttggagctctggtactttggggaaagggggctatcacagatggagtgatgacactggtggatggatgatgtttggaatttacctactgtacttgcctgaccactgttcaactgccattccagctactcaccaaaatgccacctttggtccttttaggaagctcaactgtgtcattgccatctgctgccagacctttgcctctgctgtgccctgtactggaacactctcctttcgcctttgtgagatttaggcggggacacagccaaaccatatcacatgataatgctgattatttggttatttatttatcacttagtcagttactatcagaaagtga

SEQ ID NO: 468202 - DNA, 620 bp, Homo sapiens
ccgagcctccccgatgagcaccaccccctgctccagggcgcccagtcccattgaccacccaagggctgaggagtgccgggggacggcgctggactggcaggcagctccacctgcagccccggtgtgggatccaccgggtaaagccagctgggctcctgagtctgctgtaacgctcaccgtgaaggtctgcagcttcactcctgaagccagcgagaccacaagcccacctggaagaacgaacaactccagacgcgccatcttaagagctgtaacattcaccgcgagggtccgcggcttcattcttgaagtcatttttgataatttaattggcatcattggtgcagcatctcagggaaggtacccacgcttcaaggcaagaggcattttcaaggatagtggccttgggctgtcccatcttttagaatctaaaaatcaaaacaactgaactcacggagacagagaatggaaggatggttagcagggccagggaagggtagtgggagagtgaaggggaagtggggtgggttacaagtggggtgggttaggggtggggtgggtttaaatgtacaatttaaatgtataatttaattgtacatttaaaaataactaagagtataatt

SEQ ID NO: 468203 - DNA, 600 bp, Homo sapiens
ggaaaaggaacaatatggaagcagtagcggtcttcgcacaagatgacagtcagtgaggcatttaaggtctttccgtctcttatgggagctacagcctggagccaccctggggtcagtaaacccaactatgctcacagattgtcctcctctgagaagatattttcatttaaaaagggagtcctcaaaaaagctatctgctttccttcaagcaagtccaagtgtagcaaagttaaatgctggagacacctgtgggaagatattgaggggcaaggtggaccccttaaattacatcagccacctccaccccacttctatggcaaaattgtcttccatgaaattggtccctggtgccaaaaatgttggggacagctgccctggacaactccagagggctccactcacctagaagacaatgggatggtgccttatggagttctccagagggatggccttgacctcggaccttcctgttccaatcatgacgttctaatcacttgcctttcctgaaacaagccctacacttccctgcctcaatatttttgtccacaaggttcccgctgcctgaaatatctccaggacggcattgaagttactgtgttc

SEQ ID NO: 468204 - DNA, 649 bp, Homo sapiens
agccaaaaggcactcaaggtaattcctgcagagtagtgcctctcgactttgactgtacatgagaatcatctggaatcttttaaagcccctggtgctcaggctgtaccccaaaataattgaattcaaatctcttgggtggattccttgcatcggtgttatcttagggttccaggtgcagctgaggctaccagtggaaatcgtcagaacccacagctgcttcaggatggtgagggcagtgaatggcccaggagactggatcctcgcctatatttgctgccaacgagctgtggagctgaggtgctgtctgaagctggttgcctgggatgccagggctgccgcctcgccactctgcccaccctggtggctgcactgccagaagcagcacatcgtgtcacttcttgacgcgtgccgcctccaggggagagacacctctgacagctggccagggaacagccctgatgtcaactgtcagaacaccccatagcctgcactttcgagcaggagagataaaatttcactgctgcaataagacggcagacaatatgctcgaaactaaactaaccttaagttgcagatcttttgacacaaaagttaggcattgtgatttgcatattagtgtattcctttgtgatttctgagcagagaatat

SEQ ID NO: 468205 - DNA, 666 bp, Homo sapiens
ttccaacagatactctcagaagttattactttacctctaactgtgggccacaatgtgggccagagacactgatcttctctctatcccacacaacatcatgctggttcaaaagggtattgtacacatagcactgtggcaaacttgcttgtttcagcagcaacttcatgtcaatttgctgtctgagttcagaatgcacagctgcttgtgtaggcccattggatattctgttcctaattctaggtataatagaggtcttaggtttctaacacattctcgtctggagatactgcaacggcaccagggatgtactttcctcaaggcagagttgtcggtgctgcttctctgctcaccatcatttaatggccctatcatctacggatactgtgaaaaggtgcatattctgcctggagttattcctgcccgaactgggcatatcataggctgtgctagactagtgcctacatgaaggcaaagctgatgacttcacagcccttgaagcaattgcttcaggtcccagtgccttggggatcacattcccttccttttgagcaactgaggtctagcaactctcaagtttagcttattacacgaagagtctccaagaagaacaggcaaggcaggaaggaagccctctcctcgaaggacctaaaagctcaacatgctcac

SEQ ID NO: 468206 - DNA, 686 bp, Homo sapiens
aaggaagatttcaggaccaaaacatggttcaaatcacagaccaaggacaaaggcaatccgactctggtggggtgatgtggatgaggatgtcactcagaaagctggctgaggccagccattttgagcacttatgtgtcagaccctgggctggggcctttagtgacaggatcctacttaatcttcccattttacagatgaggaaacagaagctcaaattgcttaactggtccaagatcccaagagacttaaaccagggatgtctggtgtggaggcccaagcaccttcagtttcacttcactgcttgggactggtactccctcaggtcacattgggactatgcccacatgaaccacctttgcaagattatggtgactgccataacggacaattccagtttacgatgggtatcgtcccaattggcagatacaaggctctgtgagtttggcagcaataggttccatccagggcttattttacctccacctgcccagagttcattatggaccctggaggaaggcccatccatccacaatgagctcctagtgggcagaggaaacaatggtagctattgagatgctggctggagatgtcaactttatgcagacaactgtgtctctcttattcagttcaccagctgcccctgaatatcccagtgaactactcacccctcaaatatccttcttaac

SEQ ID NO: 468207 - DNA, 527 bp, Homo sapiens
ttcaaactaaagatttggcttctcaaggaagagagagaaatgtagccatggtgagaatagagaaaaaagatgagttgtctgaaaggaaactggttcaagctaaaaattcaggccagcagtgggatccaaaaaaatggcaggtagcaggatttccagtgcctgctttttggtttcatagttcctatctcaggtcttggaaaaccaacatctccaggcagaagagactatattaccaactcccacgggaagaagccacagtcctgtgctggcattattccaatccgacgagttggggcatcagaaagccattccagagggaacactccccagggtcagatgactgggctgggccgcatgacttaacacgtccttccttgctaatctattttggtgcatgggtggaagccacagcagctatggcccaagggctccaagaacaggaatcacatcggtgaaattactcaagttgatattagttggacattggtttaggggaatagcatcataaattgctagttttggcaaac

SEQ ID NO: 468208 - DNA, 670 bp, Homo sapiens
gggtcagcatttccatcagtgctagcaaggactgaatatttccacatggctggggaggcctcacaatcatggcagaagatgaggaagagcaaagagacgtcttacatggtggcaagcaagggaacatgtgcaaaggaactcccctttatgaaaccatcagatctttgagaacggccaaagaaggcctcactgaggatgtgacatttgagtacagacaagaatgtgagggagtgagccactttgatatctgggggaagaacattccagatggagggggaacaccagatgcaggggaaacaggtgcaaaggctctgatggggagtctgattcatgtgttgaaggaacaggaagaaactggtgtggctgagatggagggagcacagcaggagatgcagtcagagaaggaaaggggaggaggcccaggtcctacagggcctttcaaaggatttggcttttactttgacaaaaccctgatggagagaacgtagcagagaatgggtggaggaaaattgcagagaacatgtatggaacttttcttttgccttcacaacttgactaactgctaggcctagtgttgtcctgtctttcctttccaaatgccttcctcactagcttaatcatttccagcttttgattttaagcaagggatgtgtgactcttcctttcactc

SEQ ID NO: 468209 - DNA, 908 bp, Homo sapiens
atagtcctataccatctgttgaatgcagaagaaacttctcactctcacacaaccacctcatgcttagcagagtacagcgccaatatgaactagagaaaaaccagatatggaccatttatcctgggtctctttgaagatgtccgaaagccacgggactggaggggaagtgcctggccaagaggaacaggtcttctcaggctcggacatcaggtcgcagtgggtggccctgctgccttcctggccacttgacaatccctctgaaatagagttatcctggagagtgacaaattaccaaccctggaggctatggcccagtgctgccagggccagaaccatgcaaagggaaggaaagccacagcacctaatccatgacccagagaaagcccttcagggaaatggagctgccaaatttcaattgggtcaatatttggtctttgttttcaaagttgccctcaagctacaactgttttccttttctgtgggctttggtggaataagaagcatgtctatttcctgcaaaggggcttaaaatgagaggcagtttccgatcatctcagttaatgtcagttgaataaatatttctctggtttctttcaaatgcaaggtatatttttacactagcaattcttttaagatcagcaaatgctgagttaaaaaaatatctgcaaagtgcctaattcacatatggacattttaggaggggatggagctggttagacccagaagatattcagcattttctaaatgcctaccagttcatcactttcctcaggaggaaaggtaggccccgtaaactgctctttcttaactgctgactgctattggagatcagaggaatcttctgtgtgattcattgaaaatgcatataattaccgtttatttgctactgttgctttgcttggcaattc

SEQ ID NO: 468210 - DNA, 453 bp, Homo sapiens
ggcgggcagctccgcctgtctggagcttcactcctgagccaatgagaccacaaacccaccagaaggaagaaaattcaaacacatctgaacatcagaaggaacaaactccagacacgccacctttaagaactgtaacactcaccatgagggtctgcggcttcattcttgaagtcaccagagaggagagctttgacgacgttctgggaagcctcttggcgttggcatctgccaagaggggtccccaacctccttgcaattgcagctcttcagagaactcacgcgcaataggccctgagccctcaaagtcaagtaggaaggacaccaaacatgacaccatttcagggtttgccaggctgccttcgactaccccagagctcctgtccccctggctttctgtcaattccatcctttttctggccgcccatgactgctgcctggactgcccttagtcca

SEQ ID NO: 468211 - DNA, 961 bp, Homo sapiens
gaagagcctttctctgctttcctggccatgccacaggtgccatgcagccttctgtttttcttacatttttgggaccccgaaagataatcccagttgtgaggaagtgggcctgctgtgcaggtgaagctcttcattgcattgccaatggggatggctcctctcttgacatcccagttcttactaaatccaaaaacattttccatgtgtgggaaggcctggtgtggggacaaaggcagatccaggttcaatgtgaaatggacatggatgaagctggaaaccatcattctcagcaaactaacacaaggacagaaaaccaaacaccgcatgttcttactcataagtgggagttggacaatgagaacccatggacacagggaggggaacatcacacactggggcctgttgggggaaacctgcacattctgcacttgtaccccagaacttaaagtattaaaaaaaaaaaactcacacatccttacatcatagtgaaactgtggaaaactaaaggcaaagagaaaaatttaaaacaataagagaacaaaagactgacagctgatttctcaaaagtaacactaaaagctgaaagccaatggaaaaacatctttcatgtactgaaaaaaattaccttcaatgtagaattctgcagctactacaatagtcttccaaagatatgggtaaaggaaaaaataaaaacctgtcaacagcatatttggagaagggccaggttttgtgggttttatatttttttgaatttctgatctgttatagacttgagtttttggtttatatcttgttcaacaagtcaagtaaactgattgtgcacttgaatattgcagcaatgttaaattggtatgcaagttagactcattttctgtacttatggtgagctggtagcagtttgcaaacttacaaccattccatggatcacactttcagtaaaaagttttaaaggatgcccttt

SEQ ID NO: 468212 - DNA, 682 bp, Homo sapiens
gagacctagcacagtggatcctgcctgtaattcccaaccctttgagaggccaagtgaggacacagaaatggccatctatgaactaggaagcctgccctcaccagatgccaaatctgcaggtgccttgatcttggacttcccagtctccagacctgacttccggccaaacacatgctctgcccttgactcaaagaggcctccacagccaacgctccccacggggctctcctccttggccacaacagcttcgctggcacaacgtggtgcgtgggtgctgagtgaggcaccagccccagtgctgggcctgtacgtgaccaggtgggggtgtgggaggcccagaaggagccatcccagaagcacccgctgtatgtacattcactgttgtggtgcgatctgcgaggcccagcttgtcccggcaccaccctcggccgccctgtacgttccctcttttaaaggcatctccctcctgtgctgctcgacatcatttcaggggtatcacaggatgtccttggagctctgctctttaaacagcttggattcctcccctaagagctggcagccttccttaccccacgagaaagttgctggagctacatttgggaatgactctgtctgggagggtggacattgcagaaccggcttctgtgcaggagggcctgtggaggcttggtagggagggaac

SEQ ID NO: 468213 - DNA, 554 bp, Homo sapiens
gaagagaccttgatgttctcataaaaatgacagtccagaggcaggggcaaacattaattaagttaggcaagaaccgaggattccctcacttcctgataagtcttagaggaagagctgttagcagcagacttgtcatatgtggcttttattatgttgaggtttgcagtcaagtgggcgtggagcctggtcatggggctgctgttgattcttcagtggggtccaaggctggtgggcctcttaccagagttttctttgctaagatctatggtcttcctgtgaaaatggaatcatcagctggggagaaaaaagccccactgctaccaggatttttagagacacacattacattccattttggtgaatctgaagggggtgaaggggacctggaagatccagaaatttttagagaagaggccaggatggatgatactttcttgcagagggtcaagagatatctcaaagcatggagtaatggaaatgaaattgagtactagttattgactaggcgtgatgcagatgccaacgcacttgctactcacagtgcctgcaaggtg

SEQ ID NO: 468214 - DNA, 573 bp, Homo sapiens
cacaggtgcaggtggaggccatgacgctggctcttcatcgtcatgcgcctttttataaattgtgcaagcagtatgcttctgctaagatagtaaaacaacgaggaatacgggctgtcagccccttcgctatcatcacaggcgatagagtaggaggaggccatgtcgataataatagggtaatccgtccgatgggttgtggcctcttatctgttgttagctctcccaccaagtggtcctttctagcttgtacccttctctccccctttctgtctgcagcctgtccctggatgctcataagcagagtggctacagtgcagcaaggaaaccttccagcaaacactgcacttggcacagccgcaggtcacgtccctgcccaccaggacctctctgtgataagggccaacgatgtttccattcctgttcatgaaatcacttggcgatgagtgaaatctgtgtgcgttgtaacaacaaatgactgcaacagaaaatcaccagatttccatcataactcaaatgccagccaggcttggtggatgggctcctcgctgaaatctccatagctgcataatcatt

SEQ ID NO: 468215 - DNA, 560 bp, Homo sapiens
ggcctctggtggaaggtgacttccagaagatgctccttgaagatgggagagagagctggagctcatctgtcctggcatcagagaaccgtgactccggagggtgggagaggcaggcccgagtcatctctgccctggggccccttcccaatgtgtcctgtcttcctccctatgcaggagtgagtgaagcagctgcctctgtggctgccgacgctggctacgcacagcaagggaggaggctgagacatgaggaaacctggccctctaggcgggcactttggaagctcgctggcatgctgctggagacccaccggcaaccacgaggacaaggacccgaggacagcgagtcacagagcggctgcagacctggcatcaacgaggataagggaatggaagctcttcttacagcagttctcagggagcgtttctttgccattcagtaaagatcagaccctcaacattttcagaactgcaccctgacattcttaaaagccagggctcctgttctcccacccctccctgggtgccgccatctgtctagaaggcagcatttgttttcaatc

SEQ ID NO: 468216 - DNA, 739 bp, Homo sapiens
ttcatggggcaatgtggactgaaaaatgtcctccctatcttttgggctccctggagcaggtgaacatgtccccttcagtccacccagttgtcatcaactgctcaggccctggaatgctgccctctgcttcccacggacatctatgcacgcccctcctgcctctggagaccagcttctctctggcctcagttaccttcacctggatggcagaaggaaagcacaaaacagacttactgttgtgtgatgttcagagctgctgggcccagcaggtcctgagcaagctcttcctgactttctctcagctggccaccatcttgaaggaatcgtctttcttctctccagggaaaatacccaacagtgtgtctcctaaagaaaggcttaagaccaacctccacctccacagaggaagacgtactccctgcaatccttgcccacctccacaagaagctccacctccactctcaggggtgtggtcttatcctctggcttccatcaagacaactaaattacccaagaacacagcagaacaaaggtggtattttcctatccatttagcagtcttacttgtgagaagtgactggcagtttgattaacggccctcatttataagtgagaacatgcaatatttggttttctgcttctgaattacttcacttaggataccgacctctggcttcatccatcttgctgaaaagctcattatttcattcttttttatggctgtgtagtattccatgta

SEQ ID NO: 468217 - DNA, 541 bp, Homo sapiens
agacacatcatgggagaaatcagaaaggcagaaatcagtccggaattgtcatcccgaagacccccatatacagaatgctggagctgtccccatctctcttatgaccattccttcctccctagtagagcaggggcaaagcattggctgcttttaagcaaaggaatgaccatgatgatatttgcatctcagaaagatccctctgaacgtagattggagaatgaatgggtggatgtgtgtatcaagattaagggctttggaaggaggttggtaagaggcaaaggggtggagaaacaaaaatttacaagaagtaaggataataatgctgaactaacatgctggttgaccagagaagttcaccaacttctgtctgagtctgatttaattcttagtgaggaacagattgaaaacataaaaagaagggactgcggaaatgggatgattttgaaagggatgtgagtgttaagcaatagcccttcagggaaggaattaactgggggggggcgggtggtgagggggtgggaagagagatgaccttttcttt

SEQ ID NO: 468218 - DNA, 534 bp, Homo sapiens
aagaaggcagtcatgaagagagggaagtcgggtgaaggacctgaagaaggaagtcagccaatagtatttcctgaggtatccttcaaagaagcctgtggggcatatttgagggaaggcattgtcattgaaaagtgggtcaaagcttatctggagctgattgttatacctgtgcctagaatcaaaggagacatctcggtggaggagagggcagcaagtatcattgatgtctattcagggaagccacagagcgcatggtcaccctgtgacatgcagttcttcgttacaattgtagggagcaccacactcaccaggaaaagaggatattggctttcgatcttgtctctgagaggtacaggccttctatctatgctgtctgtatttggcctgtggatcactcacagcagaaagccagccgggaccctatgacatggccaggccccagtgaaacgtccccttgtgaatgcccttcaccattcaaagaccaaggatgcctttatgtaagtagaggtcccatgctgggttgtttctgataat

SEQ ID NO: 468219 - DNA, 595 bp, Homo sapiens
agtgaacacagctgattttctagcttgactgctataaccactccctggctacggcctatgtttgctcaaggccctgggactctaccatcagcaaatggcaaagctaacgaggcctatgtccttcccttcagggtggcaatgtcccccaggccccagtccctctttcagcgctatgaagttaaaaccagcagccgagagtatgaagggaactactactacatatatttcctggagacaaagaattttgacaggtcccccaaggctgagaacatcctgtgttatagcgcctatgaagaacaggcccaggggtggtggcagctccctgccgtttgccagctgctgggtgcttcaccatccctgagtcacctcaatcccacactcttctttgtgaattgtcccttcattaaactctcctcaagtattctgtttgagtgtgccatgtatttcctgctgaggccttgaattatgtgtacagaataaatataaatgtaaacaaacaaacagctattgtaactcaaagtactttatttcaacagagctacttcccctaaaagtaatacttctgtgcttgtggtctaggtcacaatggggtgac

SEQ ID NO: 468220 - DNA, 1164 bp, Homo sapiens
agcctaaaaatccttgttctctctcaatccttccaaacagatgagcaatgtcgggctcagagtcaggaggagccacgaatgaatccaaatctttctagctccaaacttacgggattcctacctctttcctcctgctttaatgaggacagagtgggcttctcagtcccctcaaaaattcaccatggagttgaaggcctactccgaggagtgggccaagcgctgaccttccccactgtggactcatgggagcagacgttgcctgacggtctcagccagcctgaccctgtgtctgccgatgccctgctgaccttgccacccagcacgagttgcctctcccagcttgagtccgggagcatcgcccagcacaggggctcaagctgggggtcatccctggctggggctcagtcatactcgctgcatgctctggaagatctgcaccacactccggggtaccctaccccgcctccttaccccttcacccctttcatgacggtgtcaaatgacctaccgcccaaggtggggccactctccccagatgaggaagcagacaccggttccctccatgacccttccccttgggtgaaagaagatgggagtattgcctgggggtcatatgaatgccgcagagcttattgaggggagggccaaatgacttctgggtttttctttaacttgaggtgtattccaaagattgttttaggtgtgtcagcccattcaggactggattttcagaataagcctcaatgctgctctttgttagtggacgagggcatttatttgtaatcctctccactgtaaccccactgaaataaaacagaatgttaattaaatgtgtcagagaccgtattctagtaagataaccttacaatgtggtctttttggaactgttgtaacccattacgttctgaatcttctgttatctttgaagtatcatttttggcactgatttttcttaaattacattaaaaagtttatgcagatcataaaagatactgattttcctgtcagatgtttcttagttttaaactatgtgtattctgcagtaaaagacactggataggatataatatagatatgaccacataaaactcattttatagcatgtgacttgaaagagtgaagtgtttcatatacatatatttatggcttattatagtgacttgt

SEQ ID NO: 468221 - DNA, 595 bp, Homo sapiens
tcatatgatcatttcaacacagtgttgtccgttagggagaactctgaggttagtgaagactactgtggcttgggtggtagtggtcatggaaaagttcctagaggatgtaacttccaagctgagcggaaggaggagtgggaaccagcaagataaaggaagatttggtggcaggagggttgcatgtagaggaaatggcacattgaaggatccaagcatgaaaaagaaagaagatgtcaactgccatgttgtgagttgctctatggagaagtccgcatggcagggaatcaaaggatgccagcaactagcagcaagtaaaaaactaaggcctttaatccaacagcccatgaaatctaaattctgcctacaattatggcatttccaagatcttcccccagttgggccttcagataagactgcagccccagctgacatcttgttgcagccttcagagaaacctttaggtggaagcatgaagctaagtcctgtccagattcccaacccagagactatgagacaatatttaagttacttagtttggaagtaatttttagtgcaacaataaataatgaattatattgtagtaattattatttac

SEQ ID NO: 468222 - DNA, 523 bp, Homo sapiens
tagaatcctggaaaagggctaccatgcagcccacgcctggtcgactggaccaccttagtggaaaggggacaatctgggcctctggcctgccatatgttcagatgtgtctggagtttcttccttccagtgggtttgtggtctcgctcacttcaagaataaagccgcagaccttcacagtgagtgttacagctcttaaaggtggtgcagacccaaagagacaccccaactgctgttgggaattgggcaatgaccactctagctacttcctgctggataggggtgaagaaggagaggagattaacgccgagaaggtgtgccagtgtccaggaggaagtcaatttcctggccttcaatgcttaaacgtatgggggctcagtgagggtgatgacatgagctggcacttgtcctgggcaccctcagtcctgttgttgggtcatctggttgggggcttctggcccagagaacctttgtcctctggggcagtatgccttccagtgattgcctcggcatagtggacatgggc

SEQ ID NO: 468223 - DNA, 696 bp, Homo sapiens
ttcaaagttccgcaaatctctatggcaggggcaaatgctgccagtctctctgctaaaacaaaacaagagtcatctttgctccagttccccacaagttcctcatctccatctgagaccacctcagtctggaccttattgtccatatccctatcagcattttgggaaaagccattcaacaagtctctaggaagttccaaactcttccacattttcctgtcttcttctgagccttccaaactgttccagcctctgcctgttacccagtttcaaagttgcttccccagtttcgggtatcttttcagcaacgcccgactctactggtatcaatttattgtattagtctgttttcatgctgctgataaagacatgcccaacagtgggaagaaaaagaggtttaatttgacttacagttccacatggctgaggaagactcataatcatggcagagggctaaaggcacttcttacactgtggcagtaagagagaatgaggaagaaacagaagcggaaacacctgataaacctatcagatctcatgagacgtattcactatcacaagaatagcatgggaaagactggcccccatgattcaattacctcctcttgggtccttcccacaacatctccaacaatgctagcacatctaaatttaactaatatagttgacagaaggaggaggaggaggagtaggaggaga

SEQ ID NO: 468224 - DNA, 640 bp, Homo sapiens
aggttattttccttttgttctgatgggcaccgctcggtctaaagaacactaacaaatgcactgatttcaacctagaaggcagtctccctggagttcctaggaatctcctgtctgaggtctatgaccacccccaccagtgttttccagccagcagtagttccaaacctccctggggtgaagctcccagaggaaggggtgggctgccatctttgctctttggcagccttagccgttctggctttcagaacttggagagtgcaaggtgactgcgggctggagcagacccctagcacggcacagctgctgtatgaaaaaaccaccaactgcttttttacagaggtccccagtcccattccttttaactgggtgggacctcctgactggggtctccagccaccccctccagtgcgtttcagccagcaacatgtccatatctccctgggatggagctcccagagggagaagcagggtgccacgttagttgtttcacagccttcactgtcgataccttcaggtactggaaaatctaaggtgactagggactggagcagaccttcagcatactccagcagccctaggaaaagtggccagactgttcgttacatgggttcctgatcctgtatctcctcactgggtgggt

SEQ ID NO: 468225 - DNA, 1307 bp, Homo sapiens
gactggcagcaggtctgcgctggtcaggaggatcatgagggaggtggggtttggtgctggaatggatgagtctgggacttttcaagtccatggtcacagtgtgaccacaagaaagagcttttccctcctgggcctcagtttacctctctgtaaaacagggtcctctcttctgtcctctcagccctccctgtctccacatacccacacccggcagcatgcggctgttggacactgctggccctgagttcaacatcattttcatctttgacaggcttgctcagccaccatctctgaattatagtagtagtcataacccaacaatgctctgggcaggtccttggtacccaaggccaaagactttccagtctttggaaaccagtcataaccttctatggccagatgtgaaggaatggagtcctgacctcacagtcccagtttctaaagtgatccattctctgaattcctacacccagaaatgctctggctttgcacccttgggtcctctgcctttccaaggagggattccagaagaaggcactgtgatcataggaggtgacagctccatacatattactgcccctgaagaccttccagtgggacaagatgtggaggtgaaagacagtgatactgatgatcctgaccctgtgtagatctaggctaatgcgtgggtttgtgtcttagtttttaatgaaaatatttaaaaggtaaagaaatatatacacatatatatacagagagagagagagaaaagcttgtagaataaagatatgtatatataaagaaaatatttttgcacagctgtacaatgtgtttgtattttaaactaaatgttattacaaaagagtcaaaaaactttaaacattaaaacgtttataaggtaaaaattatagtaatctaaggttaatttatcatggaagaaaattttttaaataaatttagtgtggcctaagtgtgtttataaagtctacagtagtgtacagtcatgtcctaagccttcacattcactactcactcacccagagcaaattccagtactgcaagctccattcacggtgagtgccctagacaggtgtacccttgtttatcttttataccacattttcactgtaccgttttctatgtttagatacataaatacttaccattgtgtaacaattgcctacaatattcagtacagtaacatgctgtacaggtttgtagcctaggagtaataggctacacaatgtagcctaggtgtgtagtaggttataccatctaggtttgtgttaagcacactgtgacgttcacacaaccatgaaatcgcttac

SEQ ID NO: 468226 - DNA, 585 bp, Homo sapiens
aactaacctagtgctctttctatcatgcccaactgctctgccacccagtggaggtttgagctaaatcacacgcagttcggacagttcaggcatgatgatagccaggttccccagtcaggtggccgagccccaccagaccctgagccaaccgaggatgcagctttcctagggaggagcctgaggcacctatcgggggatccctggtccctggccttaccctggagcatcacccaccaagtgcttctccaggacctggctctgggtttctctacttatctcctccctggatggctgtataagccagatgacggctacctgaacactctagaaaaagtgaattcacagaggctttcacaggggaagagttatcagctggggtcttcctacatcatgctgggctgagagatctacctcaccctttggcaaaaaaactcagaatatatttatcatagcctagtaaatgttatatctggaaagactggtgaagcaggaagtatatagggaaaaggcaaggcttctacattgcacaactgcagggggtacaatacacatgggattcaacgtagaggactcattctggaattc

SEQ ID NO: 468227 - DNA, 598 bp, Homo sapiens
aggggtgtttgctaaaatgcagattatgggttcccaacacagatgtattgactcagaatctctaaggagccaccacacccggctctcagctcctatcttaaagcagagactgcccaaccctccacatctccaggggtggagggggtggtgtgttcagactgtctttcttggtgctctacatggatggtctcaagacagcttcaacttggatatggttggtggcatggcgggaatgccaatgcatttagtagctgggcattggccaaccaagcaatttacagggttgagggaatggcttcaagccagtatcccttggggcatgatgagaaaccaccagccctggggtcatctatgtgatgagtatttgcttgtagagcaagatggtgggtgggagctgggagggaccttagaagaatgctgtgataactacaataaaaggtagtatggtctatggcaaagataggcactgtgcattgtgatagcatgaattagggggacctaaatgtatgtggggtatgaaaaacatgacagaatcttttaatctcttagtcttttttggaaatattttttaagcctttttaattggtgaggaagtgaa

SEQ ID NO: 468228 - DNA, 537 bp, Homo sapiens
agcagcacctctttctacaaagatctacctcttcaggacaaaaatggaataccaaagagaagaggattggcatgcatgggaatacaggcaggcccacggcatgctccatcatcctctcctgctcaggccaagttattctctagcactttttataagtgggaaggaggatgtcaaagctcgaatcagcataccaggcagtggaggccaccacattgagcaaagaaaagatcaaagcagcctcttaggacaactgacccgtgacatttgtaaatatcagcgaacacatcctcagatctgcagagaagctggcacctgggaagaacaatttccccagcagctagccaagctggggtcttccaagtggatgcagagacctgccctgctgccctccccatcctctgagagtgccttctctgggcttttgcttcaaagagccatctttttccacatggcactcatcttccttgtcctttgcttcatgacaccttgagcgtgttagaagctaatcctgaacaagcatagaaggggcactggggt

SEQ ID NO: 468229 - DNA, 730 bp, Homo sapiens
tctccttcaatctagatctgagaccaagccgcctcttgaatacccatctgatcctgtgaaactggaagcattcagacccaaagctgcagagcaaaagccccaataggcccagcccatgggaggctaccatgaggatgcgggctacctggagctcctggggcagagacaagaaggattcaaaggccttgcacacagtggcgacttcctctcgatccacgcagacctcccaaatccccatgatccaggtctccatctcgttcagttccagattaagagtcttccactggggcaggatggtggtaacacaggagcagacccagccaaggagggagagaaaattgaacaaatgtacaattgggttttataccgagacattcagttcccaggggcaggcaggagacagtggccttcccctatctcaactgcaagaggctttcctcttttactaatccacctcagcacagaccctttacgggtgtcgggcagggtgacggtcagatctttctcatcccatgaggccatatttcagactatcacatggggagaaaccttggacaataccccgctttcaagggcaggggtccctgcggctttccacagtgcattgtgtccctggtttattgagactagagaatggcgatgacttttaccaagtatactgcttgtaaacattttgttaacaaggtatgtcctgcacagccctagatcccttaaaccttgatttcataca

SEQ ID NO: 468230 - DNA, 807 bp, Homo sapiens
cagaaacttctgcagacttaaacatccctgtctgacagctctgaagacagcagtggttctcccagcacagtgtttgagctctgagaaaggacagactgcctcctcaagtgggtccctgacccgtgtgtagcctaactgagagacacctcccagtaggggccgactgatacctcctacaggtgagtgcccctctgggatgaagctttcagaggaaggatcaggtagcaatatttgctgttctgccgcctctgctggtgatacccaggcaaacagggtctggagtggacctccagcaaactccaacagacctgcagctgagggacctgactgtcaccaacatcaaagaccaaaggtagataaaaccacaaagatggggagaaaccagagcagaaaaactgaaaattctaaaaaccagagcacctcttccactccaaaggattgcacctccttgccagcaacagaacaaagctggatggagaatgacgagttgacagaaataggcttcagaaggtcggtaataagaaacttctctgagctaaaggaggatgttctaacccattgcaaggaagctaaaaaccttgaaaaaagattagatgaatggttaactagaataaacagtgtagagaagatcttaaatgacctgacggagctgaaaaccatggtgcaagaactacgtgatgcacgcacaagcttcaatagccgattcgatcaagtggaagaaagggtatcagttattgaagatcaaattaatgaaataaaatgagaagagaagtttagagaaaaaagagtaaaaagaaatgaacaaat

SEQ ID NO: 468231 - DNA, 1677 bp, Homo sapiens
tttcaaagccagtccctgaaggaggtagggaagaggaggaaacaagcctagaaacttgaagagcagactgaagtcacacacctgattagtgaaagtcagcagaaagctgactgtgtttctgatgatgttgtcgccctcagagtacccctctctcctcgccaccacctgcaggctcctcagggatgctcttcctccagccatgggcccttcagacaagaaacgtgctgcccctgcctttctacccaccttttctccacaagaagtgcccagagagctccaagcattgaaaggcaatgaggaccctggctctggaagtagctcttctttggctcctggccattctctgatgaagtcatctgaagaggccagtgctgtcattgtggccaccagcagtctgccagggcctgtcctggggctcatccaagccccagctccaagaggcaaactgcagatgtttcttctatttttagatgctgggatgttgcccatgaacgagccagtgacctggaaaagccaattctccctccaatctctgcttctgactcgctcatttcccttcattgttctaccagatttttcctcctactatgggaccggcatgaaatgacccagagttaactgagctagaccttgatctattgagatttctcatacatgagcatataacttgaaaacaatagaaatgttatcatttcccttttaattcttaaaaactcttattgctgttgttattattattagttttatatagcattaggcaggatatccagaaatggtcatagcagacatcttttgggttatttctgatcttatctatttagtgtgatgcttactgtatattttgggcatagctcctttactaacttaaaggaattcctattttactaagtgtttttattatatatatatatgtgaaatttctataaaatattttttctgaatctattgagaaatcatttgatttttctcccttggtctagtgtatggcttatattaacagatttctgtttttaaattacctcaagattactgcaataaaccttatttgatcacaatttttaaaaatgtgctgttgaattcagtttgcttatattctattttggatctcagcttttagaattttgactttgtgtttttaaatttccttataaagtatcaaggttttaaatcatatttatcttattagacattccataaactctttcagtctgaagtctttcatctttctttaatactaaaaaatccttggttattttttctttgacacttctctttcttcatttttttcttcaaaacttcctattacacagatgatgacacttttattttattcttcacagcttctaattctgttatattttccaactgtttgtcttttctcagtgccttctgggagagtccatcaacctggtcatctggctcacttatcccagcagaatccatttttaatatttatgtcatttattggattctttatttcaattattaaatttttggcatccaatgtttctgtttggttcttctttataactgctttatgttaccattatctttccttttccttatttattacacttattttaaattattaatctgtgtggtttcattagttctaatttatcttctataggttgtacagtttgttttctttctaacggtgatgtttctcagatgtcc

SEQ ID NO: 468232 - DNA, 580 bp, Homo sapiens
acattctatgggtttgaactaatgtataatgacatatatccaccattatagtattatacagaatagtttaacagccctaaaaaccctctgtgctgcatgtcttctgtcctcactggcaaccactgatctttttgctgtctccagagttgtagccttttcagatcgactcttatgtttagcttatcctcagtttgttctgacctacctagaggagctaaatgcacaagtagatgtgacccagacagagtatcacattcaccatggtgcctggaccacagctcatcaggaacatggcagaaacttagcagaagaggttctgcaagaaagtgccagcaaccttggtctgaagcaactgccagaaccctcagacaaccatttaatgccagaaggttctcttgaggagacgggggagctgacagtagcactggtgaggaaactggaagagaaacatcctaaggcttctgctcagagctattgtaaaaggggttgaattcttgatttgattctctgcttggtcactgttggtgtgtagaagagctactgatttgtgtacattaatcttgtatctggaaactttgcc

SEQ ID NO: 468233 - DNA, 613 bp, Homo sapiens
cgggaaaccaccatggcacatgtatgcatacgttacaaacctgcacgttgtccacatcatgtcaccaccttgaaggtatttgatattctgctgcttttgggctttttcattcagccttcccctttctccaaccagaggatccttttctatcatctttaccatgacatgcccaaatgtattacctctataccttcacccactccattagactgttcccgcttatgtggaattccctgcatgatgtttctttttcttctgtttatattaagtcattacttcaccttttctttaaaacttaaacctttcaactgtagccatcccaaggaggactggttcttggctgctggctcttccgccctctggggacctacgtcctgctttgcctcctactcctcgttcccgtcctgccactggtgcagtttgactgggtcacatttgggggaaaggtctgtgttctactgttgacctttactcttttgttggggttaaatttttattgtgttagaacattttgaattttacattgctgattgctagattttgctatctttatttcaagaatgtcaaagtttcacaggaggttaagttacttgctgataagcttcatcatttt

SEQ ID NO: 468234 - DNA, 709 bp, Homo sapiens
aaactttcacaaatgcgtaacataaacttcagtgagcagagtagggggaaaagaagtgacttaactttggaaaatggcattttgactggatgctgtaaggctaaagacaaaaagaaagagacatggatggagctggaagctgttatcctcagcaaagtaatgcagcaacagaaaaccaaacactgcatattttcacttgaagcagaaattcattatgaagagcagattggtaaaattattgtggagacacaggaacttaaatggcaaaagacagatccaaaggttgtgcagattgtgggagtaaaatcagggttgaattatatgaaggacaagtctgaaacagacctatctgtggagggaaagaatatggagggaaagaataggtaaatactaagtacaactaatttcaagcagattttaaaatgtaaagttatatcttgtttttgcatagagctaacagcataaagttatcacagtccctaagttttcatgcctcttattttttatttagatctttattttaattgaaaaataaatattgtatatatgggctacaatgtgatgttttgatacacctgtgtatgtatatgttgtggaatggttatatcaaactaattaacatatccatcacttcaatgcttatttttttatagtgagaatatttaaaatctacttttaccaattttgaaatatacattattattaacta

SEQ ID NO: 468235 - DNA, 1636 bp, Homo sapiens
tcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtatctatctggaggccgttgatgaaagacaccaggctactttagcctctgcaaccaccaaagccaggctcctggaagccatcagaagctataagaagccagcaggtgtgttatgcacagcagtaccaagaagctgtgtccaatagttcacagacttttcattgccttttaaactctcatttacaactctgctaaggaaatgggctcaaaacttccctggaggagccttgaaacttagattataaactattttagtgagttataaaaatgtccatgaaacccactaatgatatgaaatcacactaaggggcagtgtggtcaaatttctgatgcatttttcagaggaggattattaaattatttttgatattgaatgtaatattaaattccatgtaaaattgggatgtaacattttatatggaataataatattggatagaaaatagaaatgctaaatatggtttatgaatattttaatataaaagaaaaaataattggagacataagaagatttggtttgaaatagaatacaaaaagctgcaacaataactaaccagtatagaaaatgagattctttcagtcatcttagtaattgtggagttaaagtggtccttaggaatactatttctaaagtcaggatctcgatggatatatcattcattaaatattttaatatgccactatatgaggtacccaggataataatagtttataaatatgtgaggaaactgacacctaaacaaataatttaagtacagcaatgtgggagattggagtatgtagaaggttctatgggatctcagcaagaatctaaattagaattgtctggaaaatgtagagtagtgtgtcttagtctgatttgtgctgccataatagaatgtctgagactgggtaatttataatgaacagaaatttattagctaacatttctgaaggctgggaagtccaaatcaaggtatcagcatcttgtgagagccttcttgttatgtcataacatggtggaaagaaagaaggctacagagaacaagagggggccaaactcattcttttatactgtcaccaaccacacccatgagcatggaatcctcac

SEQ ID NO: 468236 - DNA, 719 bp, Homo sapiens
ccagcagcacccccctccactatcaccatgagccatgctgccttcaccactgtggtgaatgcctgcatggagggaggcctgggcacagccaaggagtatgtaccccaccgtgctgctgccactgcaaatgagaatggatcctgctgctaccgcaggatggctgctgccactttggctgacaccacccaacagaatgtagtgaccagcagtctgggagcacctcggctcttccagtgcagtggatttccaaccttgaggagccagagaacaaagtcaggatccagtacaagtcccccagagttagagcatgcagataaaagaaaaaagaaaccatccaaatgtcagcaacttcaaagattaaaggaagataagcccacaaagatgagaaagaacaaatgcaagaactctgacaactcagaaacccagagtgccttctttccttcaaatgaccgcactacctcaccaacaagggtactgaaccaggctgagatggctgaaataacagaaatagaattcaggttatcgatagaaataaagatcattgagatgcaggagtactttgaaacttaatccaaggaagctaagaaccactataaaacaaaacaggagctgacagaaaaataactagtatagaaaagaatgtcaccaacctgatagagctgaaaaacacactacaagaattctgtaatgcaatcacaagtattaacagcagaatagac

SEQ ID NO: 468237 - DNA, 3436 bp, Homo sapiens
gcttataggcgtgagctgaggaagcatacagcgatttccctctcccacctggtgagagagcctccacgggctctagggtaaaatggtcgagtgctgtgtgggtgttcttggtgctggaaggatcctgctctactcagttccaggattctctatggggcctggaggtggattctccagggggccgcccttgtggattgtggaatgcctcaccaatggtcagaagcacgtctcccctggtggctccccacagtcgtcctcccagggcccatctccaccctctggtgccactgggcatgcggagagcctctggcaagctgcaggagctgccaaagcatttggttattttgctcattttattaataaatgtgcacctatgccaaccacatggcgactgccgcctaggaacaagagtcggaacatgctctggggagatttctggctggattttggtgacaaaggaaacagacagggatctatggggagaagggagtcaggcagctgacagacatttgcgggcttgcaaggacctctgcagtttgtgaaggcctttttgggaaaaggagagttgggtggaactgtatggaaggggcttggggccctgacccttcagccagagggactgtaaaccgcatggagcttggacacatagcttggcctgactgcaggcagctggacacatctttctcccagggtctgttggctcgtgggttcctggtgagggcggagctgatggcaacagtgccgtacctgcaaaggactttgaaaaccccaaagcaaagagaaagaccttccaccagaggggctgctggcccaatgccacgctccatggagggagttggccatcacatgtgcggtgctgggtctgggggctgtacacacaaagctggcattattggcacctttccgggatgctgtacagagaaatacccaggagtgacgtgacccataaggacaggttggatgagtgggcctttgtgtagaagaagccagcaggcaaacctcatagggagcaagccccaggcctccagggctccagacccctgtgcaggcaccagaatggactcctcctccagccaggaagtgtgttctattctattactggccagagaataaataatctgaaagcctcgccaggatctgccgtttaccctttaagggaatgaacttctgttcatttgtaaaggggggaaaaaaaagccttcccagatgaaagtctgggctgagggaagagtgagctaggcagatggcatggatgccagcaggaagcccttacagccagcaggccgggcccaggggccctggcatcccgctggacagtcagtgcctcccacagcagccccggtcctgggctcctcaaatcttagctcgggcctctctacttagtttgctcatgcccttaaaacagcaaaaaatgtcaatcacacatactcaatctagtaattcatttataaataataatcatgcatgactataccaacatgaacattgtcaaacatgcacaaaaatacaaatttaaaaaataaaaccaagataaaatattttaaaattccttaattactatggatgatttcttttttaccactattacctttattaacaaagcaaaaatatacagtatagctaggttcattagtaataatagtggatataaattcttatttcaaattgtcttctcattcatagtataaatctgggggccaccttcttgtgggatccaactggattgtcccagctccaaggtcacccttcagagaagcttggatcggcccctcatctaaagaatattactctccccccagtgactgtctcagggcttcctttataacttttaaagtgcccatcacatgttgtcactatgtaaatctgctcatggactctgactactgtctccccaactaggcaatgtgcttggagttcatcagagaggatccatgtctgctgttttcattgctatatgcccagagaccagcatggtcccgggatattgtaggtgctcaataaatgcatgaataatgagatgaacgaatcagcccaggcctgagcagatggcccacctgagtctccggagccttggggcccagcaggaagctggggcggtggggtccaccctcctcttagagaagttgtcagcaccagacttcaagtcctggccctgcctcacagggcctctgtcctgggttgccctctccacctcccactggccagccagccccagcccaggccattcagagaggtaccacgaaggctgcacctgcagatgccacccaggtcagtcccctgatttcatgcaggaggcatcagccatttgccagaggtggcagcccattggaggaacccgaatctctggctcctggtgagttctctctgtgatgagcatcagatcacttgagtaggggagagaggagtggctacaaatgcagatctctcagctcaaaccccatggatttggaccccggaggtctggagaggggcctgtgaatctgcatttgtaataaactttacaactgagtccctgaagttctcctgggcactcccatccggctgtctctgttcatttctagcctgaatgacaattaaaggtcagtgacataggtggagcaatagtaactatacccatttaataggtgaggaaatcaaggccccaaaatgcatacagtttcataaagtaaatttgatgctgtaaattcataccagagctaggcacggtacccagtacttcaggctccttagttaatggcttttggacaccagtcccctggggagatcagggatggcccttaaacatgcccctccattctgcccctgcacagctacaatatttaaaggccctaagtcctgaaaagactatggtgtctcccctcatccccaatgaattctaaacaaaaataacactaaactgtaactgtaaggaaatcccatgatgacaacagtactttaatacatttttgtaaataaaattgtttaaaaacatttttccttatcttatgggtggccctgcttctgtggtgcccaatgcaatatcctggcttcctaggagatagctccttgtctgcaatgctcattccagtgtggagtctgggtgaggggcaggttggtccctcccacccctggacattgttccacctcctttaatcccacctggtttcctccccgtggaactggaatgcactcaccaggagagcctagcatttcaaagatgtgccctggcaaggcaggctcttattgatggggattttaaatgtatgcctcctgtctccttgacaatctggcttccattcctgtgggagcttcttccagggaaagcccaggctccctcccctctagggaaggggcccctttccaaccctccttagagaggacagagactagagggaagggcagcccacccacgggtgcaggccagaagcccctctctctgcttagacccctccatgtt

SEQ ID NO: 468238 - DNA, 1284 bp, Homo sapiens
tgatttagaagctgcctcaaaaatatgataacttcctccagctctgggaggatgaattcattttctgcagctcagccctgtgcactgggcagctcaaccctgtgcactgggcagctcaaccccatgtactgggaagctctaccccatgcactgggcagctctaccccatgcaccgggaagctctaccccatgcactgggcagctctatcccatgcactaggaagctctaccccatacaccgggaggctctaccctatgcaccagccagctctaccccatgcactgggcagctctaccccatgcaccgggaagctctaccccatgcactgggcagctctatcccatgcactaggaagctctaccccatacaccaggaggctctaccctatgcaccagccagctctaccccacgcaccaggaagctctaccacatgtactgggaagctctaccccatgcactgggaagctctactccatgcaccgggaaactctaccccaagcaccgggaagctctactccatgcaccgggaagctctacctcatgcactgggaagctctactccatgcactgggaaactctaccccaagcactgggaaactctaccccaagcactgggaagctctaccccatgcaccgggaagctctaccacacgtactgggaagctctaccccatgcactgggaagctctaccccatgcactgggaagctctacaccatgcaccaggaaactctaccccaagcaccgggaagctctactccatgcaccgggaagctctacctcatgcaccggaaagctctactccatgcactgggaaactctaccccaagcactgggaagctctaccccatgcaccgggaagctctacccccatgcactaggaagctctactccatgcactgggaagctctaccccaagcactgggaagctctaccccaagcactgggaagctctcctccatgcaccgggaagctctacctcatgcactgggaagctctaccccatgcactgggcagctcaaccccatgcaccgggcagctctaccccatgcactgggcagttcaatcccatgtactgggcagcagcttgactcccactggtactgctgccaccaggccatctactcatggcactgtcttcctcacccatcactcccagatcccactagccctcttcagtgggccctgctagagtgagagaggcagcagtttcctcactgaagtcatcaggaatctttcagaagtgtttagaagtgacaaaatttaaactcaaaagacgtctaa

SEQ ID NO: 468239 - DNA, 551 bp, Homo sapiens
gaggcacacccacttcttaagatctctggccagagtggtaacctcactcccacccatatcccattggtgggaatgagtcacaaggtcatgcctggctgcaaggagggctgggaagtatataagaacgagctcagcacctgtgtgggtctgatcctgcaggcagacagtcctctctgcgagcaactgagccagactggggaaagcagggacaccaggacaggtcatgaaggccgatctacccagaaaaacacagaagaccgggagaatgacttggctcctgacaaggatggcttcagcctatcttctagaatttctgtcaatgaggattcagttttggaggacagcagatgtttgacttcctggaggacaaagcagaaaagccgacactttgaactttcttacccctgtttgaacatcagtgctcaggtaacaggccagtggctggagagcaagcttccaagattactcttcactgtgaattctccagcattttccaagcaaagaaaagctggaccttccactgatgtttacatctgacaatgtcttttggt

SEQ ID NO: 468240 - DNA, 521 bp, Homo sapiens
ggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagagagctgaatccgggaggaacctgaaggactcttccccaccccctagcagctctgagctccagccagtcagagggggttggtatggcctcccccaagatgtctctgcagacgtccctggagacaggagggcttttatcccatgcatttgctcatggccagagccccttcgtgcaggaaatagcccgtgctcccattgtaaagagcagcagaaggggtctggggaagcagtttggaaggatttccctgcataggcttcctctagagcaacgccttctctgattgtttcttttaattcacaca

SEQ ID NO: 468241 - DNA, 591 bp, Homo sapiens
agcttcagagatgtggctctgctgccacctggagggcagagccagaacagctgagtcccccgccgacccatgatggctactcctccactcagccctcatcccatatatgacccaatcactttaaaaacacaatctcctttattaaatgtttctaagggagaagatgaatcagagaagaacaacggaaaaccagagagaaattgggaaacttggaggttacgaggatctaaacaaaggcagaagatctggagttggagagagaaggatcctgaccactcttcccatcatatgctcctgccccaatccaacccacccatggctaatacacagtcaaaagcaccagctgtgatgcaaagcagcatggtccacttattgagtgcttactctgtgtcaggcactgtgctcagcacttcatgtgcactgtcatttcactgtagctccaatgattgccacgcccacgttcagagactctcattagctgcatgcctatatccccattcattaccctttataacatggccctgagcttgtactgccattcactatttaatgatcttgggtaagatgtgctatgtaatctcaaaagatctc

SEQ ID NO: 468242 - DNA, 560 bp, Homo sapiens
actgtaaaactatccttaaattctgcgacatcctataaattcatgtttactttttcacattataagattatgtatcagagctttccttctaacagtcaggcccctcttctgcaggtctgctggagtgtgctagaggtctactccagaccctgtttgcctgggtatcaccagcagaagctgcagaacagcaaacattgctgcctgttttttccattgaaagcttcatgccagaggggcacccaccagatgccaaccagtgctctcctatatgaggtgtctgtcgacccctgctgggagagccaacaggcaataacatttaagtctgctgaaactgctcccacagctgccctttctcccagggatgcccttcccagagaggaggaatctagagaggcagtctggctacagcagctttgccgagctctggtgggctccacccagttcaaacttctcagaggctttgtttaccttgaaagctaaaattctgagctgttgaccttttaaaatctcctcattttaactagatttaggagttcaggttctaaattactttgcatttc

SEQ ID NO: 468243 - DNA, 1483 bp, Homo sapiens
agagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacaggtgcagccactaatgcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacaggtatgagaccactgttctgatctgaaagcagcaagcctggcctcagagatgtaaccataatgtttattttagatcagtggtcctcaa

SEQ ID NO: 468244 - DNA, 1345 bp, Homo sapiens
tgaggtttgtcgccttgcctgattgccatgcttctattttaccccacagttctctttctcacccaaaggagagtgcagatcagtgaatccttgaagttcagtatcgccaaagggctcacacaggcattgcggaaggctttccaccagaacgatgtctcagctcacattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccctctgctctgccttctgcatccacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcaggcttagatcattttaaaagatgagctaccttcatgaatatggagatttaactgtctagaatctaaagatatttcttaagttgacatatttgaaaaattgaggcctaagagaaaacatgtgaccactaaaaatttttaaatatttgacttaatttgtaatcgaagtaaggcaagttttaactaccacaagatgccattttcacctaccaaagattagtaaaatactaagatccagtattgatgagtgtggagcgaaaagggcactttcaaacagagcaactggtctcctgctccagcgagagcaggcttcttgagaggctggatatagggaggtatgtgaaggttggcgtctagccacagaagtcttcagcagtcaggagaggaacatctgctgatcacctgggtgattgcagggtccatgcaaaatgccctgcaaacactcggcctctctttttccgaaagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccgtaagggaatggtctttttattcagtctttttaatgccattaaatgtttcctgaaaatcaaaatgattccccaaaatcatgttaatggtctcagagctaaacatatttgtattctggaaggttcttaaatcaatcagctatgtttctgtgttgtttcaagcaataagggatatgttttagatactggaaggatggtaatgatatt

SEQ ID NO: 468245 - DNA, 611 bp, Homo sapiens
atcacagcgcctaacacacagacttgggactggggtggggggttatgtctgggttgctttcctcttcccagtgttgcttgtcatgtccctcctgctggctctttcccacagccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaaggtatatggaagtgtctcaggacctgatggtttgtggttatctgatgcccattcggccatcagtgcttccaagtgttttatatacagcagctctctaattctcacagctgcccttggaggaagtactattattttacagatgaggaaaccgaggcatagaaaactacaagctaaagagacatgaaagggattttagagataatgtaatcagactccctcctttcacccatgaaaagtaactctttcaaggtcatatggttggtaagtagcagaactgatggtagaataaggtctgctatgttctgaacgttgtggtccacagatttatatgttgaaa

SEQ ID NO: 468246 - DNA, 762 bp, Homo sapiens
tcctcagaggaccccgaataactcaatctccccaacatcataaaatcgatgtgtttatgttgtgcttcagtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggtgcagtctctaagggattctggagttttacttcagtggtctttgggataggagctgggatgggagctgtttttcctggatttcatgctgacactcagggaaaatgaatcaaagccacgaaatcaaggtttgaagttacatgtgcaggtttgttatatcgataaacttctgtcatggggttggttgtatggattatttcatcactcaggtattaaacctattagccaataattattttttctgccctctccctccttttaccctacaccctgaagtataccccagtgtcggt

SEQ ID NO: 468247 - DNA, 605 bp, Homo sapiens
ccacagtcaccaccgaccgacgtgccatggtgacagcattgctcctcttggctgtgacagtatctcagattttccttatttttgatgaccttgacagtttttgggaagtttctattgacatatcttcaagatcactggttctttcaacaatgtccagtctactgatgaagtatggcaatttcacattcacctccagaaattcatcaaaattatcattttactgtttttaccagttgttgactccagcagcttctgcttcagattgtcaaattatccgtgtagctggaggaggaggaaagttgggaacgaaggaagaaaagaaagagagagagagagagagagaaagaaagaaagaaaaagaaagaaagaaagagagagaaagtcagaaagaaagtgacaaagaaagaaagaagaaagagagagggagagagagaaagaaaagaaagaaagaaaaagaagaaagaaagaaagaaggaaagaaagaggaaggaaggaaggaaagagaaggaagaaagggagggagagagagaagaagagagggagaattcacaatctcatttattcctttctacaaacaagtaaacagagtcctggaaagttgaaga

SEQ ID NO: 468248 - DNA, 484 bp, Homo sapiens
caggaaattacaatatgatcaaaaagggaactgatttagcaactggtcatatctacagtcaaccctacaaaattccctcatctgttcacagaaactataagtcttcaaagtactgtcccatctacccattcctcagcccagccctgcaacttgaacaggaaggtccattgcctgtggtctggctgggcactgagagtggagagacctggattctagcgctggctcaccattggttcatggcgcatgagcccatttcctcctctaaaaatgaggagagtcccttcctttcttaccccatatgtctgcactcaggtttcagggccaatttcagatgggccatatgctctctgtcctctgtacctttgcccaagctgtcgcctgctcctcagtcacctccctcattgccctgtgtctacctgtttaagaattaagctctaagattctactctatcatccctcacctccttcagaaagccttcctaga

SEQ ID NO: 468249 - DNA, 1105 bp, Homo sapiens
aataggaggtccttatcacccaggatggagccgggtgctctacttaatttaggggaaagctactctccgggaaacaggacctacattagctgccttttcagatatcgcacttcctcaaaaccacttcagaaggaaagtgaattagaaatgaatttgagacatatgagcggctttcactgcctcctccctgctcctggccagcagcctgcggagctgggacccacactctcccagcactgggtgacaccgtcccccaaagtctgtggacacactgaacccgcccatggggctggtgtggagccccgaggccaaggacaccttaaggaattcaacaacccctcccctgcacacaggcttcttccagggaagccagatgccatgttgcaagatttcctctggagagggcctcttggcaaggaactgatgtctctggccagcagccagcgaggacctaagatctgtcaacagccatatgagaaactcatggcccttggacccttctggagcctgagaagagactgcacctcccttgctgctcgtgctccccagggcacccgcccccaaactctaaagctgaatgctgtgagcttaggctccagggaaatgagggttcagggtacagttcactactgcctctattttggcatctacttcttggaggacctcaattaagatacccttttggagctgttacagacctgcttgttttctagtcatagtggggcaggagaagacagagaggctgtctcaagctcttggtggctgcgatcactgtcctctttcctagtggggtatgtcatctttgctcttgcttctctggaataagtggaatacagcttctgcctccaagggatctatgcaggatggggcatagctctctcctactctctgacatctaaccctgtctgaaaggggaagaattggccccatggaggaccccagattattttcagaaatccccttcaccagcatccaaatacctcctctcccctgtttggtagaatgtccattgtctgccaaaatccactctcctctcctttcatagaaagagctttttgtttgttttgttttacaactttattgaagtattaattacatacaacaa

SEQ ID NO: 468250 - DNA, 736 bp, Homo sapiens
agggcatggaggctgtgagaagccactgaggtggcatttggcttttgtcactgagcagtcagtcttcaacaggattctgcagttttccaggaatgacccctgagctcctggctacgtccacccagacacacaccttgccattcctcagagctgtgaatttgccaatgactatgatggcacagcctctcactgagggtgaggcactccttaagccccagctctgggctttgtgccctgcccccactcattgccttttttatagacagggagacaaatggtggactagtggacctggactttccaggtgttcatttctgccccaaggagggaaagagcagaggactcagggcagaaccttcccagtgctgggggagttctgcttggtggccatgccgctagctattgggaagcccccttcatggatggtccaggctggtctctgccctgtagcagctggtgcaagtttctccctagagagcagggtggagggtgttcccgattttactcctgaggcgaccagtgtggggctggtgcttatttgctgaattttctgacttaatgactccacaactgaaactccaataagtcattcaaaatgcatgccaaaatagaacactattagaaagtccgttttcagtccaagaagttcctcattcttcttaaatgtggaagggggggatggtgtggaaaagactgaaaaagtcccccaatgtctgtgcaccccactttctatgtt

SEQ ID NO: 468251 - DNA, 563 bp, Homo sapiens
cctcattctcccccaacacagttctgttctaaacatggaagcctgttcctcgtgccacacactgaccagccgggctacctccttgccacttccgcacctggggcctgtggccatgggcagacaagggcatactcaggtgggccagggtagccccaggaggcctgagaacaacatttttaatgatgcagacattggcgaggtttttgaccctgatggaagtgatgctaggtgtcttccaaggctgggatatgaagggtcatatgcctttcacctggttctactgggatgccagcttttggaaccaccatgctttgaggaagcccaggcagcctgcagagaggcccacttgaggaagaatcacagccctttgctggcagcccaggctaacagccagcgtcaacctgctagccactgtccaaattgcggattcaagagcaaatgaatgagccttcttgctttaagccatgatattttgggctgggtttttacacggtaagacaactgatacagttccctatttatgtaaacactaaacacgctatttggtgtttgtgttgagtaaa

SEQ ID NO: 468252 - DNA, 615 bp, Homo sapiens
tttatttttaattagacaaggtgacacatgatgccaggatggatggttaccttaggaggaccctcgtgatgcctgtcgtaggcctcccaccagcagatcggccttgtcgcaaagccttttctggtagatgtaggacagccctctatgctctttggggctttggaataggaggaacagaagtgcacagcgtggaatggggaggaagaagagggagacgtcgggtcgcagtgcgcagcgtgcaaccctctgcaccttccggccctctcacctcttcacacggcatttgctctttcattcactcagcaacaattctgtgccctttatacgtgctgggcactgctctaggcactggagacgatgaggagaagacacttcccaccttcatggagcttatttgctggtggggaccgcagcagctacagggtgagcaccgctaggagataatgcctgggaatatccttcttaaattcttgaatgtaaattcactttacaaggaaggcacagtggcaacaccacactgaagctacgacttcagtctgaggttcacgtgagcccctggtccaagcttccaagtggtttcagcaaatatattagatatgcttgattgaaatgtgt

SEQ ID NO: 468253 - DNA, 697 bp, Homo sapiens
accaactgtttgctatgacaccatggagctaaatagcagagctgccgaaataacagttgagagagagaaggttgctggtcagacctggtgcagttcccctttcaccactgggctccatccaactctggccttgacgttttctataaattcagaaaaggcctgtgccttgacttcctgcagtggcacccttaacctcatctcacactccactacgctgtccttgtacctcagccatgtcgggaaccacagaccatcactggacattcaccagagcaagcctttgtccactgcaatgctcctctgggctgctggtgtggatgacgtcattctcacaggctacaaggtcccagctgccttccagctcaggccagcatgtctctgccctgtgttctccctggatggccccagctgggtggttctgagcagaccggtccaggtttttattattattcaccagccccggtcaccttcagatgacttccgtctcacctacagccttgagaggctccctgagccagaaccatcaagctgagctgattcctccttgagtctagaagctgtgtgaaataatacatgtttattgttttaagctgctaagttttggagtgatttgttaaatagcaatagataactaacacgacgtgctcttctgtttctctaggaggcaggcttctttcattatgttctctacaataac

SEQ ID NO: 468254 - DNA, 959 bp, Homo sapiens
caacagcagctttcctctgctgctgccagtgggcgcctgtgggagtgggggaagtggaatggtgatcaggaaagaagaacgactacacatagccagaagaaatcttgtacagattgaagctgagcctcctttggtctcatggatggcactattgatgggccagaatgctccccctccacggctgggttccgggagtcaggactgggtgtctccgatggacagtttgctgtctcggcctgcagcttggatggcgggagactcagaaatccctacagatcagtgcacatggtggcagccactaccaatgtcgggaagcacagctgctcggagctctcttttgtgctgctctaaagccattgattggagactaatttctcctgggacagattgggattgggagccccaaaccgaaagaatgtttaattctagatttcttaattgtgctgggaagggagttcttgggaatggtagagcaatgaaaggagcaaagtggtggggtggtgtgggtcagggtgagagttacagagaaaagaagcaattcacttctggtggccttgaaagacttacctggtaggaatgttttcaggctagcactctgtgactgcctcctttgggtggaaagagtgcttctcatgctatttctctcttggtatctgacatgtttctataattcggtagttgtttccgatctgtactgaatgtattttttctctccaccctgatgactgtttcctgaaatgggatggccacccaaattttttgtattttatgagagcttttgggttttcaaatatcatcttctcataagtcaagttgcaaattcttatttatttcctaggtgtttgcaatcactgatattcattttcattaactcattgggttgccggctacatctgttcggtagctccataggaattgcctgccatgaaccgagagctatatgggaaatgtggctggcc

SEQ ID NO: 468255 - DNA, 463 bp, Homo sapiens
ctcaaaggcatgcccagtaacctcctctgtagtttcttctcagttgtctccagcagcattgagagactgctctttgatgatgcttaccaaaatgccattactagcatgagtgcaagcccacagccccaagatcacagtgattctcatccgaaaatgatccctcaccaggggacatctgacaatatggagacattttggtggtcccagctggggcagtgctgctgcttgcatcgagtgggtagaggccacaatgtaccctacaatgtacagcacagcccccacacaacaaataattatctggcttcaaatgtccatggtgctgaggttgagccacttgctctagaaaaatgcagagtctgtcctcatacctatggcaactcaagctctggttcaggtgctccccaggaaaaatttctgcaggacaaaagtcctgagctggttaggaactgacaaaagatgcctg

SEQ ID NO: 468256 - DNA, 1023 bp, Homo sapiens
gcaggcctccacatgccgctctgctggaactgcaatctagtcctcctcccatgcaccggccttgacctcttcccccgcagcccggtggctcagacctgcgaaggaaccaaggcaagagggagaaaagccctgccgcctgatcccacgccgccactcacagacccttcgttgaccggcagcattgaacaggaaaaaaaaaaaaagatgaaaacacagaaaaccccaaaaacccagacggggagacgatgtggggaagagaacgtgctgggagcctcagtagccagtctcctcctcgtagtaagcggaatattcaggggcctctccagggccaggacggtcgcctgcacccgagggagccccatcggccactgggccttgcgggcagtacttggggtcgtatatctgccggcccaggccaaagacctggccgctctggttggcgccctgcgcgtagcccatctgcagggacatgaaagagttgttacacttgtcggttcccagcttggtgtcatagatgtaccgccgggtcccgggagccgtcgtgcccacctggctggcacacttgtttgcacccatctggaggctgatggtcgagcggtccatggggggcaatacgtggttcttggggtcatagagatgcctcctcgtgctgtacgcggtcatgcgggactggctggtgcatttgtgggtgcccatctgcagcccgatgacgcactggcgggcattcatggtggcgtcctcaaagtcccactcctgcttctccgagtgcgtgtcaccgatgtccgcccctctctgcggccccttagtcttggccttccctgccagggcgagaagagacacctgcacctgcatcgtgttcccactctcagacaggtcgttggcctcaaacaggtccacggggttcatgccatttggacttgccaaccctcataatcacatgatctaattccctaaaataaatattttactctctgtatacacatgggtaagtttaaggttgaacttaagttctgtcttggacaa

SEQ ID NO: 468257 - DNA, 1596 bp, Homo sapiens
ataggagttctcaggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacagatggagctttgggaacgcggagaacagtggggttacagggagtcatcatcagccctaccccttggccaaccacatctccctgctgtgtcccctgggcatttctctacctcccaggtggaagtccttcagggtccagcagcaacctgtatcagaagaacatccttctctgcttgacctgaagaagggccagacctgggcagaaagactccagcaggtgagctcttcatgcgacagtgtcagcactggagtcttcttgctgaactgcgaataaagagattttttggaaaatgtttcacttttttccactcttttctttttctctttgtgtttcagtttgggtagattctactgacatttcttttttttaaattttttaattattattacactttaagttttagggtacatgtgcacaacttgcagagtttccatctctctgtttacattacccatctgttcttgcgtgttgtccactttccccattagagcccttagcatatttttcatagctgttttaaattcccagtctaataattccaacatatctgactggtttctatacttgctttgtctcataaagctatgtatatatatttttagcaagctttgtaattattttggggaaagcaggacatgatttatcaggaaaaggagctgcggtaaataggccattagtgtgaggctgtatgtttacctggctgggaggctgtgtttatggttttgtagcatgtcagaggttaaggtttcctctggcatccttgtctttgtctttcttgttgtctttgagtgtccctagaggctccttcttaaatagagtctgaggtttacagttatttctgctgtaatcccgttattatataaccagggattacataattatataataatttaacacaatatgggaagcctatattgtggtgataagtgcgtgggaggggaagtgttctatatttgcaagattagttctcagtgtttagtgagcctttccctctgggctgtgacctttctgtgtgatt

SEQ ID NO: 468258 - DNA, 607 bp, Homo sapiens
ctggagaagagtttaaagcatgggaaaagtcttcttcaaaggacgagaaagagctctcctccactttgcctttcttcacttactctcttggctgctttctgctcctctgtatccatctacatcactcacatgctgtcttcccaactcgtagcactcaacctcttctgtatactaccggcttccgggatttatggtgggggatatccctactgctttccctgggcttatggcaaaagaaaatgaagtccagtttgaagtctcctgcaatatcattctgctttctgggcagaagaaagagttggtttgttggcaggggcaagggagtagttctggtcctagctcgaccatggacttgctgtgggactttagacaaagcacttcctctctcttggcctcagttccttccatgaaatattgtagtgtatactgtttgctttgtgcccacaaaaactcattgctgcaagtgggcaggacttgtggaatggctgagtgcagatctcagcaaatcctcttttcccaaaacaattatgaagccagacaaaattgccaaagacagtcatttaaagactggaaatttgaccaaagccatacaacagattgagaaggg

SEQ ID NO: 468259 - DNA, 654 bp, Homo sapiens
gagcacacgctgtttgaaaaaaggcgccaattgacttatctgacgcacgggctcttttctttgctccaggtagttgatcaggtctggcttagagacagcaataccatttctaggcttccagcggagtcctaacatcttagctatggatttccaaagacctgcaggtcacagggccacagaagctgggtctctaggagatgataacacagcagtgaagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcagtgtccggggcttggtgggccctggtgtgagaaacctcccgtcccgtgagaatttgcacatgaaga

SEQ ID NO: 468260 - DNA, 1273 bp, Homo sapiens
tgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagctctcttttggactcaggacttgtgcggactatgaaattctcctatggtggctggtggaatctgctcggtggttgataatcaccaataaactagatgagggcttaaaggcacttagaaaagttgcacgcacaaatggaataaagaatgctgaagaaaccctgaacatagaggtactttatggagctgtcgctctcatagttcgatgtcttgctcttttgacactaaatcatatgggccgtcgaataagccagatattgttcatgttcctggtgggcctttccattttggccaacacgtttgtgcccaaagtaattgtccacatgctggttctaccttctatagaatgggcatagcgaatactggacagaataagtaagaaaaaatttctgctagaaaatgcagaccctgcgtgtggctttggcatgtctgggaatcggctgttctgctgctactttttccagtgttgctgttcacttcattgaactcatccccactgttctcagggcaccagtcatattgagtgaggggtcccactctactccaatatgaccttgccttaactagtaacatgtgcaacaacactgtttctgaataatgtcacattctgaggtatttagagttaagacttcaacatataaattttctttggtggggggacacaatgtaacccataattaatggtgagatttcttaaattttttaattcaccccttaactttcaaagatgccatttaccacaggtctaaaaagaccaagtgagagtagcaattttcaaaactccctttggatctgcacaggcagcaggaccttttacagagtgagtgtgattcgctagaaatactgactt

SEQ ID NO: 468261 - DNA, 802 bp, Homo sapiens
gcctaagtctgaacacaaggggaaaatgaactctctaacccagaaatatatacaggtaatatctgtgtgggttaaaaaactctataagaagcaagtgactaaaaagattagactttggtttcaactttacaaatatctttgggagaattccacacaagtttgggcagtaaaagctattttgagaagggaatcaaaatgggaacctatatacatccctcccctagggtgcattatcagtatgatacactaccatcttcctggtgggatggaagagattacagccacggtacagaagcttgttgaagttaatattatatggccagctgagttctttcagtcttatgtgacagaagggctgtgggcttcagatgagatgttcaggttagggcagagtggctttgctgtgggccattcactggagatggctggaacctccacctggggcaaaggagactggtggctgttccttgaggtacactgtgatattgtttatttgaaaccttatttgaaataagcatttattgctataaacttcactttagcaaaacttttgctgtatctcttagtctttaatgtgttgtgttttaattttcatttatttcaagacattctgaatttcactttttaatttctttcttgacccagtgattattccagatttatgttttgtaaatgcagctgctatttacatattcttttatgaaatcttatggacacaaatatttggtaatatttggtgatttttatttactaagtaggcttatttttaactttataagccttttaacagaactttataaga

SEQ ID NO: 468262 - DNA, 512 bp, Homo sapiens
gtcaccagcatcaaagaccaaagatcacaactcctcaccagcaagggaacaaaactggatggagaatgagtttgacgaactaacagaagtagccttcagaaggtgggtaatagcaaactcctctgagctaaaggagcatgttctaatccaatgcaaggaagctaagaaccttgaaaaaagggtagaggaattgctaactagaataaccagtttagaaaagaacacaaacgacctgatggagctgaaaaacacagcacaagaacttcaaataggcaactatgtgaaaagacaaaacctacatttgactggttctcctgaaagtgatggggagaatggaatcaagttggaaaacacacttcaggatattatccaggagaacttccccaaagcaagacaggcccacattcaaattcaggaaatacagagaacacccacagatactcctcgagaagaacaaccccaagacacataatcatcagaatgaccaaggttgaaatgaaggaaaaaatgtt

SEQ ID NO: 468263 - DNA, 677 bp, Homo sapiens
agctgcttcacaactcagctaggtacagaaagcctgcttcagccctgcctcgcccacgggaagtccaagggccccagtatggacctggacctcacgctgaacttctccatacacctgctaatgtgcccccaattctccctccctctcctcccctctccccgctccccaacccttcctccacaccctctgggcctcacggtctatcagcagcaaatttcccacatcctcaatatcttctctggacagttctgtcatcttcttgctctaaaggaaacctggctgtcctgtgacatcatcacttcccctgctgccttgcgtctcatgcccagtggccttggcgtggccagtgtccactctgctttctgtccacctctttcttctgaaggcccaggtcctttaaaatttgtgccgtcggacctcaccacctccccggtgtgctcacctgcccactcttcacaagagctgtttcacatcgtctcctccctgagcctcctctcactcattcctcctgcccctggccccattgctgaccaccaaggactgtactgccttcccagccacggtgactctgggcctcagcttctacctcattgagaagcaactccatcccctaaatcttcctaccatctaagctactgacttgctaataattgcactgacacatgatttcctttttt

SEQ ID NO: 468264 - DNA, 749 bp, Homo sapiens
accacaatcctcatggaagacgccaacaagctagccctaggtcagaagttaatagttcgggtgccacaagctgtagacaccttaatgcagcaaagaggacattctgcacttcttgataaactaacagctgcctggggctctggccgtggagctatgccagacaagttaatagatgcctcctacacctctgtcacaacccccaaaatgatcaccgacctgctctaccagaggagaactatttccttggctggctgcctgactcagctctttgtggagcacttgctgggaggctcagagatcatcctccttattgtcatggcctatgaccgctacgtggccatctgcaagcccctgcactacacaaccattatgcaacaagggatctgccaccttctggtggtgatagcctggattggaggcatcctgcatgccactgtgcagattcttttcatgaccgacttgcccttctgtggtccccaatatcacacatctgagtttcagcaacaaaatttgaatctaggtcttccaaatctcagtcgtacttcaaataaaacagttgttcatgaaagatgatgccaaatttgttgtagccttttatcacatgtagtatatattactactgaaatatatttcatgagttatgttcctatttatgcatggaaaataccagatcattctttgttactgtaaaacctttcatgaatcaaagtttctctgactgtaacacagttactttgcacaaatgttat

SEQ ID NO: 468265 - DNA, 589 bp, Homo sapiens
gtcttggaaattccatgagaatgggtgtacacctcttgcgatatggggagtaatatcatcttctcttcttctggaagtaggaataatatcacacaggtttgtacactttctgtgatattgggagtaatatcaacttctcctcctttgaatattaaaaacagtatcacagaatggatgtacaccccctgtgattttgggagaacaatatcacagaacgggtgtacactccctgcgatactgggagtaatatcattctcttcttccgcgaacattaggagcaatatcaccgggtggatgtacacccactgctatattgggagtaacgtcatactccaccctctggatattcggatcaatatcaccgggtgggtgtacacctacggcaatattgaaagtaataccatgctctctccctccatggacattgggaacaatatcatagctgtattttctcactagagaacactactagaatgttctcctaaatttcagatttcagatatgcatctgtaaaatgatcttatggagacacattttagttgctactgaatacttggttgttttcataagttcgcagcattactactgt

SEQ ID NO: 468266 - DNA, 1088 bp, Homo sapiens
atcacagtggtgggcaacctaactatgatcattttgaccaaactggactcccacttacatacacctatgtacttttctatcagacatttggcttttgttgatcttggtaattctactgtcatttgtcccaaggtgctggcaaattttgttgtggatcgaaatactatttcctattatgcatgtgctgcacagctggcattcttccttatgttcattatcagtgaatttttcatcctgtcagccatggcctatgaccgctatgtggccatttgtaaccctctgctctattatgttattatgtctcagcgactgtgtcatgtactggtgggcattcaatatctctacagcacatttcaggctctgatgttcactattaagatttttacattgaccttctgtggctctaatgtcatcagtcatttttactgtgatgatgttcctttgctacctatgctttgctcaaatgcacaggaaatagaattgttgagcatactattttctgtatttaatttgatctcctcctttctgatagtcttagtgtcctacatgttgattttgttagctatatgtcaaatgcattctgcagagggcaggaaaaaggctttctccacatgtggttcccatttgacagtggtggttgtgttctatgggtctctactcttcatgtacatgcagcccaattccactcacttctttgatactgataaaatggcttctgtgttttacactttagtaatccccatgcttaaccctttgatttacagcttaagaaacgaagaggtgaaaaatgccttctataagctctttgagaattgatgtcaactttgtgtttaataatcaatttgtaatattgttataataaatatataatatagattaatgtcacttgataatttttcatgtgtatataaattttccaattttcaaatttttttaattgttttttatttcaataatttttgggaagtaggaggtttctggttatgtgaataagttcattgggatctctttagtgtgctggctttctcaaatgccggttatgctagcagtaaaattgtcacatggacagactcaggacctctggttaa

SEQ ID NO: 468267 - DNA, 2541 bp, Homo sapiens
cgatggtgatcagggtcaacctagcagccttcatcatcctccttctgtaaagggagtgtgtgaggacaccatggacagaggtgaatcttccaaaagggtgggatggagtacattggctctgggcctctttgaaccagttcaaattgttgcaggagaaaggagtcaagatgtagacctcaagagagggttcctggatctgatgcacaaaggaattcaaggcaagtcacagagtgtgataagagatgtaaaagtcttgaacttgaaaagatacaaatttggagatgatctaataagtgtcatgaccaaatctggatctttgcttaaaaatgtgaaatcacttcatagtaattgctttttaattcatgactccaagggaacatttgaaaatatgcaatcatcattcatcaataaaacaattggagataaggttggtgagagaaatcacaaagttaaaggcattttttattatattaaaaagggaatctagccaaatgcccatcaaatgagttaaggatttttaaaataaaactctgtactataattttgttaaccaaacctgaaatagctcactatatgccctcaaggaggttggctcataaaatgtggttatgatgacataatatttatagatgaatttattataaatagtgcatgtaaatactgtatttcatgtactgttaattttattatagaatattttgtagaaataagtatgtaactgattaaacatatgaaacatattacatatgtaaattcatgatatactttcttaagaatatacatgcacttatacttttaaaacagtatgtactgaagatttatgtataaaaactgtttgtaagacaaaaatggccaaaagtaaaatatgcaaaataaataaaaatttgacaaacagcaataacaaaattgtaaaaatacaccatcaaaaaatggtctttttgaagtctattttatgcaggcactctaaaattgtagtggaaagaatgaacaatttgttatagtaaaaaaagtcctgggctctgggaataaagtatctgtgtggatgtcctggttttgttaaacacaagatgtagtgaaaaataatcagagaaaacataaactagttcttacaatgttatattgatatcataaaagaacattacatctatgtgatttccaaagactgtcatgtataaaatggggaagatgttcttttccttgtcatgtagttaacatgcattgcaattcaattatattacattattatacattatattattatactatttattatataatatattatgcgatataattatatacaataattatataaaacagtatatattataataattatataatataataattattatacattgttataactcccattatcccaaagcagtattagacacataatacaatgtagggaattcacatatgtttcacatgatttattgatttttacataaggttgatgaattatttgtatgcttggatgctgttaagttctgttgttagaattgtaacaggaaagcagagtgttatatgcaaataaatgaaataataaagttaaattgtacaagtagctctaagttactatataaactaagtattaaataccataaacatccacacacaaaaaaatattggttataggtgttatgtaaatattgccctttttcgtgaaatgagaagaccattgaaaaataaacaaactacagtttaagaaattgttttctggctgttcagaagcaatgctaagatcatacagtcagtaacagattattctagcttgaagaggtaacaggaaataacagaagtgtaaaagaaacttgcactaccacttcctaaacatactcacaactaagaggagtccacagatattctagcatgaggaggtaacagggattaagagaagtgtaaaaaaaaacttacactaccacttcctaaacatactcacaaataagaggagtccaaattaagcagagcacctagtgcagacaaccaggatttcatgatggttaaaggacttattgttgggaatagagactttttatgtgtagtttcttttcactggggacacaggctgcagcttattgtgcagatgtgagtcttcagtgtccaccagttgcatcattggcatcctttcttgtctcctgagactggaactaatcataaagctacacattctctcaatcgttgttcagtagatgcctctgatttcacatggataaaatgcgaaaattttattctttttataaatgtgaaaattatactcagagacaattttttaagtatattttatttatatatcaaagatctagggataaaaccaaattgcagatattaaatgcaattgcaggaacaaaataaatggttccaatcacatatttgctactcagacaagcattcaaatgtgctaatgatggaacagctgaagttttctttcttataaagtgggaatattcacatatttgaaattgatgtagattaatgcatcatgttatactccaaaactttaataatctcttattgaattagttttatgagtac

SEQ ID NO: 468268 - DNA, 1236 bp, Homo sapiens
agaagagaacccacagtatcttcatgttcgcacaaaatatatttgtcacaaatgaccagaaaaaattatacctcactgactgagttcatcctattgggattagcagacacgctggagctacagattatcctctttctgttatttcttgtgatttacacacttaccgtactgggaaatatcgggatgatcctcttaatcaggatcgattcccggcttcacacacccatgtatttcttcctggttaacctgtcctttgtggacatttgttactcaaccaccatcaccccaaagatgctggcagatttattatcagagaagaaaaccatctcttttgctggctgcttcctacagatgtacttctttatcgccctggcgacaaccgaatgcatcctctttgggttaatggcctatgaccggtatgtgaccatatgtcgcccgctgctttactccttgatcatgtccaggacagtctgcctaaaaatggcagccggggcttttgctgcagggttgctgaactccatggtcaacactagctatgtcagcagcttgtcattctgtggctccaatgtcatccatcacttcttctgcaacagtcccccactttttaagctttcttgttctgacacacacttgaaggaaagcatattttccacttttgctggtgtgaataaggtcggggctctgcttgtcatcctctcctcctattcctacgttctcttctccattttttctatgcattcaggggaggggaggcacagagctttctccacgtgtgcctctcacctgacagccataatcctcttctacaccacctccatctatacctacctgagacctagttccagctactccctgatcaggacaaagtggtttctgtgttctacacagtggtgatccccatattgaatcctctgatctacagcctcaggaataaggaagtaaagaaggctttagcgaatgtaattagcaggaaaaggatcccttcatttctgtgatttttttgcctaaaaatctgagctaaagagcatattttagttactttcaaagtctagttcatgcctacaatttttgttagaatattttctcattaaacacattctgccaatactcaaatatttgtatgcagttagggataaagcaaattacccaaaatgataaaagaccaaggggcctttactttataatcattctaaatcttcactgagttctcatagttaggggcttattttaatttta

SEQ ID NO: 468269 - DNA, 2702 bp, Homo sapiens
agatataattttctgctttggctaagtaattgaattcctcctcctgggactctcagaggatccagaactgcagcccatcctcgctgggctcttcctgtccatgtacctggtcacggtgctggggaacctgctcattatcctggccatcggctctgactcccacctcgacacccccatgtacttcttcctctccaacctgtccttgcctgacatcggtttcacctcggccacggtccccaagatgattgaggagatgcaatcgcatagcagagtcatctaccatggggactgcctgacacagatgtctttctttgtcctttttgcatgtaaggatgacatgatcctgactgtgatggcctatgactggttgcacatgaagtccaacgacaagtgttattataaaagacaaagaggcagaagaagtttgaggggaaaaaaggtgcagagaaacagagaaggacatcatgtaaaggtgaaggcagagactggaatgattcaaccacaaaccaaagatggtcaagattcaccaaaacaaaaaggggcaaggaatgagtcatccttaaagcctttgaaggaagtgagttcctgccaacgttgtgattttggaggagcctagagaactgatgagtgactaatctgctattgccttaagccacccaatttgcagtaagttgttaagataaaccaggggaaataatatatcacacaaattgtcctcttatttaagttttttatttgaatatctggaatgaattctgtattccaccttgcctcagctgattcagctgatatgccattccaccctacccttcaattgttgcatgcattttgggcagtaaattgacttctgtttaaaaaaaaaaatatatatatatatatatatattcttcttactttacaagctaaatcaatgaaatttgatcttgtagaggtaatatattttcaatagttattacaaacgtgttttttcaaaaacttttataacgaaatttgttttattgatgcaaaacaaatttgggagtaaagggaagtcactctcagagtatatgaagacactggagtacatctttaccttacagtaatgcacagcctctcaagataatgtctcagaactgctcaattgaagaaattcctacttccctaatatgtaagaatgcatatgtacttaaaaaatataacatcatttttgtaaaaccaataataatagcaactataatttcatatagcattttacatgtgcatattaggaatgggatgtttgcatattagcagtgtctaggaggatatgcatcagaagagaatattggcttcttcatactggcaagaattcagaagatttctgttttattatattttaatttacaatttatatttactacatggggaatataaagttagatcacaagaaataatatgttttgttattatgaaaatataaaactatattacaaagaaaatatttgcgtttctcttttttatttctactaaatgtcataaagaatatttcccatcaagtaggtaaattttttacatcaaccaaatctaattttgaaagaaaaataaatatcttttgatctaacaggaatgccataaaaacatatggcatttagggacattctttcaaagtataactgaaagtcatttaatgatagtatcagagagagacaaatttaaaataacaaaagtgggcataattaaaaacaaatgactaacggtgagccttaaatgatggtcaacgaaacaatctagaaaaaaagaaagagaaaaatatgaacaaatattgaattgatgagtggattcttactaatatttagcaaatcaaatagataataagcacaataaaaatttacgtgactattgacaaatgattttccagtctgtaataaatgaaatatgcaaaaatgaatttgcatattatcagaagccatataagtggtgtatttataaagtgagcctttgtcctttttaatgcaaaaagatatgtataaatttttgttcatatacttgctgacaatgataatttaaacaaattccaaaataacaaagtaaaaaaatagcaaaaatttaatcatttaaaaaaatggaacttaaagcacttaataaggctaataaaataaagataacatgaatctatttatacttaatgacaatacaatggtgcaataagtcattctctcattttgttattgttgttgttgttaaactgcctaacaacatgaatgctatgataaggatagctatggtcaaataaagtgatgagagggaaatggacagttggcatagacagtctaaggaataccaatgtgtaatggtcttgaaaaaaaaatcactatcatgatcttgttttcttatatatctaaattgaaatttcaaaagatatatgtttttagctgtattggatttcttatctgtatctagagtgcatcgactgtccagagaaatcacttcttagggaaaaagtacctttttttggtaatgtactttcacaaatgatgttgttatataagagcagtaaatattaagcataatttatgtataaatcagactaaacatttctacatgctataactctgtaacttgataaaatataaattttattaaaatatatgcatataataaaaacttgaagaaataagtgtggagaaattaacaattttaattgaatattgacaattttttttctaaatatattttcctggaga

SEQ ID NO: 468270 - DNA, 977 bp, Homo sapiens
cctgtctgaatcaataatcatctgtctttctgtgatctctgctattctactgcaactgggcccaagatgctggtagatctacttgccaagaacaagtcaatacccttctatggctgtgctctgcaattcttggtcttctgtatctttgcagattctgagtgtctactgctgtcagtgatggcctttgatcggtacaaggccatcatcaaccccctgctctatacagtcaacatgtctagcagagtgtgctatctactcttgactggggtttatctggtgggaatagcagatgctttgatacatatgacactggccttccgcctatgcttctgtgggtctaatgagattaatcatttcttctgtgatatccctcctctcttattactctctcgctcagatacacaggtcaatgagttagtgttattcaccgtctttggttttattgaactgagtaccatttcaggagttttcatttcttattgttatatcatcctatcagtcttggagatacactctgctgaggggaggttcaaagctctctctacatgcacttcccacttatctgcggttgcaattttccagggaactctgctctttatgtatttccggccaagttcttcctattctctagatcaagataaaatgacctcattgttttacacccttgtggttcccatgttgaaccccctgatttatagcctgaggaacaaggatgtgaaagaggccctgaaaaaactgaaaaataaaattttattttaaggaaatagtaaaaatacatgtttatacacacaaaaatgcatattcatactggtgttttcttcaaattatatattataacataaagttgtctcaaataccctaatttaatataatacatattttactcagccacaatctagcaattctctggaattgtctaaatatgctatttttttaatgtgttttcaatttagtataaatatagatgtatattatat

SEQ ID NO: 468271 - DNA, 684 bp, Homo sapiens
tgccctgaataccgcttgctccagccatgactaaaagggggcaagtgacagcacatgaaggcagccaggaggggtgctataccctgcaaagccacaggggcagagctgcccaagaccatgggaaactacctcctgcatcagcgtgacctggatgtgagacatggaatcaaaggagatgattttggaactctaagatttcactgccctgctggattctggatgttcctggggcctgctgtagatcagagggttcagcatggggttgacaactgtgtaaaatacagaggccactttgactgtttgccgagagtttttggagttgggtacacagtaaaggaaaaggatggtcccatggaagatggtgatagaagtcaggacagtcccgtggaaaatagtgatggcagtcaggtgggaagcacaggtagagaaagctttttggtgcccaacagcagaaggcatttttatgacagcaataaagatgaaaatataggtagtgaggatgactcccaagctgctcacctcattgaatattgcaatgacaaaacaaagcatttggctgatgtaggggtcagagcaggagacagagatgatgacagagtgctcacagacaaaattattgatgatgttagacccacagaaggataatgacaagaggaaatagctttccctgaaatgagtgccaag

SEQ ID NO: 468272 - DNA, 747 bp, Homo sapiens
cttgaagcagcaaatgaggccatgcctctccctgttgacacctccttgtcctctcaacataactgtcttgcaggcacagacatgtttatttgccaactcaacactcaccaaaagctacaaccgaagtggacaggcccctacactgtgatactcagcacaccaactgcaatggttctagagatagtcactagccaaaccgccttggccctggaaatgctcgtgcaacaacaaaaccaaatgggcacagcaatttatcaaaataggttagcactagactacttattagcagaagaaggcccagtcccaaggtgcaaggctatctgcactagcagcatgcaccagcaagatagcagaaacaggaagagagctagccaggacacaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgttaataaagtaatccttttgataaatgtcttaacaaatagtcttgacaaaggtgtgggaaaccgtcaaccctacaaacttttggtgggaatgtttttacttatttatttacttattttttaactttaagtttaggtgtatacatgtaaatttgttacataagcaaactcgtgttatgaggatttgttgtgtaggttattttat

SEQ ID NO: 468273 - DNA, 740 bp, Homo sapiens
accacaatcctcatggaagacgccaacaagctagccctaggtcagaagttaatagttcgggtgccacaagctgtagtcaccttaatgcagcaaagaggacattctgcacttcttgataaactaacagctgcctggggctctggccgtggagctatgccagacaagttaatagatgcctcctacacctctgtcacaacccccaaaatgatcaccgacctgctctaccagaggagaactatttccttggctggctgcctgactcagctctttgtggagcacttgctgggaggctcagagatcatcctccttattgtcatggcctatgaccgctacgtggccatctgcaagcccctgcactacacaaccattatgcaacaagggatctgccaccttctggtggtgatagcctggattggaggcatcctgcatgccactgtgcagattcttttcatgaccgacttgcccttctgtgatcacacatctgagtttcagcaacaaaatttgaatctaggtcttccaaatctcagtcgtacttcaaataaaacagttgttcatgaaagatgatgccaaatttgttgtagccttttatcacatgtagtatatattactactgaaatatatttcatgagttatgttcctatttatgcatggaaaataccagatcattctttgttactgtaaaacctttcatgaatcaaagtttctctgactgtaacacagttactttgcacaaatgttat

SEQ ID NO: 468274 - DNA, 698 bp, Homo sapiens
tatcatctgaacatttattccagccttcgggcttgtgttctctctctctctctctctctctctctctctctctctctctctctctctctctctctctctccacatactgattattcattcatcaatcaatggacacgaggtgctttcacattttggctattgggaacaatgctgccataaacattggtgtacacatatcttatcaagttcctactttcaattctttgggatatatcttcccagaagtagaattgctggatcacatgtcacgagtgctgagagatggggccatcctagaggactgggaaaggaagcatggggccttatgggtagaggtgagtcagggagcaccattgtgggaacagaagcagaagccagaagtctgtgggacctgcagtcaccatctaacagggttggggctagtccccctccagggttcccagatcaaccctgtgggttcccagatcactaaccagcctgcattgtcactattagctcaattatgtcctccagggggcagtgggttcctccagggcaaggctggtgcctagaatatcacatatccattatgtcatctccatctcaatgtccataatctagtttgggttctcatgaactcttgcttgaatgtgcaaactcttagtttgtctctcagccttcactttctccccttgcacttacctttccagaagctgccc

SEQ ID NO: 468275 - DNA, 547 bp, Homo sapiens
cctgacatctcacagaaaggactttcagtttctcagcatgattctccaagtgacgtccagaacaggaactgatggtccctgtgtgatagcagccttgtttgttctgtctactgctgccgtcctgcacctagatcagtgccaagcagatattaggtcctcttcacagaggacacaagtgaatgaatacacaagggagaggaagaaggaacttgaatcaagagcaatgcccgagggattaacctcagatttaagggaggaggaggaaaaagaggaaagatacacagagatgctgaagtggaaagaaaataatttgaagttatcaaatgtgaaagaatatgtctcattaaaacaggaaataaagtcatctgctttgagtggggagctgaacagaatcagggccttgtgcagaataagagagagatggaaaagtctctgggaagtgaggtgatggattgattaaaggtgaaggaaagcagtgagcatcagtaaacccaacaaagaacagattcagggtggatccagttaaaacagtttcacaattttctcc

SEQ ID NO: 468276 - DNA, 706 bp, Homo sapiens
ctgccctcagcctttagaaaaggtcctatggctctccgtgtatttctacattcttctctgggtgtaattccctacctgatgtggttccagtttagagttgaccaaaagaacaatgtgcatgcgatttgggatgtcagagtgatgcaacagccattcctctcagaagttcatcacagtcagacatgttgtcagacagacaaagagatgagtaccttgtgggtcttaggtggttctggccctcctctgctctgcattcagcttgtcctccagactgtgggccccgatgaccaacagcagctccaggctgtgcacccacagaggcagacccctccagaggtaactgtcttgtatgggagcactggttctcacctcaaccacctgggaggtgaagaagatctagaagatctcgttgcttctagatctctaaatggactcaagttctggaaggccccaggagtcacgtacaagtgtgacccatgaaaagacaacctaagtcccacttttgaaaaaaattaattcctattttccctccactatttagaaaattactctctccattcttatgagtatctttgatactacagtgcacacttaatttaacaatgttgaggttaaccaatatcttacagcttttgtcctgaacagttcatgaatgttaaaacacttaattcagatcaccctatcccaacttacatactacttctat

SEQ ID NO: 468277 - DNA, 581 bp, Homo sapiens
tcactttcctttcacacggggtgagtaaaaaagaatacttgaagtaatgggaaatagtgtataccacagctctgaaatgggaaggagccttggtgtactggagaaactgagaagaggctggtgtggctgcggtctgacagcaatagaggaatttgagttccaaaatgctggtgtctatgcaggcggctttcaaactgggcccaacatcacagtagaaatgactgataacattattgccacagaatggcaactggatgagcagcatcgtctgacaaaagacaatggtgaagcccaccacccaggagctcagggccagctgcaggcagagtttgctggtcatgatggtggggtggtgaaggggattgcagatggtgaggtagcggtcaaaagacatgatagtgaggatcaagaactcggtggtgcccacgaagaagtggaagaaggcctgcagcaggcagcaggacatgcagattactgttcttgccactacaaaggttcctagcagtttggggatgactgtggtggtgtaccagatttctaagaaagacaagttacaaaggaagaagtacattggaatttgt

SEQ ID NO: 468278 - DNA, 561 bp, Homo sapiens
tttcaaccacagtctatgtgtacagtgtttcaaccattacgaaaacagtgtggagttttcaattgagtaatgggaagacactggaagaatttggagatcccagaagaagatggcaagacaagggaaagtttgcaacttcttagagacttgttaagtgattatgaccaaattgctcatagaaatatggacagcgaaggccaagctgataaggtctcagatgaaaatcatgaagttattgagaactggagcaaaggttacccttgttatatcctagcaaggaacttggctgcattgtatttatatcctaggtctctgtgtaaggttgaacttaagagtggcagaagaaacttatacgcagcaaagcattcaagatgtggcctgcctgcttatgacagcctgggatcagatatcaaacaaaataattacttaaaatttggcttgcagagccaccacttgccagaaagattagcatgactaaaagggagccaagtactaatagccaagacaatgggcaaaaggccttaaaggcatttcagaagtctttaggacatcccccttcca

SEQ ID NO: 468279 - DNA, 983 bp, Homo sapiens
agtggatttcagaaaacacttgaagataaggcagcatgtagcatgtggaacatgctagctccacacaaaaaccaaatacttgaatcaggccactcgactatagggctgctgcggtttgctgggggtccactccagaccccactctctttggcctctcctgcatctgcaggaggcagctggggtcccccactggaagatctcacccagtcaggagggacaggatcaagaacccaccccatgaagaagtctggttgcttcttggtagagcaaacatgttgtgctggagctgaggacccacccagtaaggagaagtgggtcggggtcccggttaaagaagtagtctggctaaagaagcagtctgtccaccatctggtaaggcagctatactgtgccccggggtcctttccttttctgtgcccctggcaggctgggatggctgagtctacagaaccacagatatggtggtcatccctcctaccaggaactccctgccagggagagatcggagttctgtctgtggaacaaaggacccacgcagtaaggaggactatgtcagggcccaggttaaagaagcagtctggccccgatctggcaaggccattgtgctgcaccgtgggggcccctattcatctggactgtatgcgttctccacagccagcaagctggaatggctgtttccctctgaaccataaagatggtggccgtccttcccttcaggaacaaggtcttgtctccagccgacttaaccctctgcccttggctggccagattctaacccagtgggtcttaacccatgaggtactatggaagtggggcctacagaacgatgctgcttgactccctgtattcagcctccttcctagggatgtgtatagaaggattttccaccttgtcagtatctctggcccgagcatgcaaaactcctgggtctttgtatgtgtgttgcaaagacctgtgggagaagcatggcttcccaggtgagt

SEQ ID NO: 468280 - DNA, 1327 bp, Homo sapiens
tctaaaataggaagctgcaggatgctggttgacttgctctcaggcaaccctaccatttcctttggtggatgcctgactcaactcttcttcttccacttcattggaggcatcaagatcttcctgctgactgtcatggcgtatgaccgctacattgccatttcccagcccctgcactacacgctcattatgaatcagactgtctgtgcactccttatggcagcctcctgggtggggggcttcatccactccatagtacagattgcattgactatccagctgccattctgtgggcctgacaagctggacaacttttattgtgatgtgcctcagctgatcaaattggcctgcacagatacctttgtcttagagcttttaatggtgtctaacaatggcctggtgaccctgatgtgttttctggtgcttctgggatcgtacacagcactgctagtcatgctccgaagccactcacgggagggccgcagcaaggccctgtctacctgtgcctctcacattgctgtggtgaccttaatctttgtgccttgcatctacgtctatacaaggccttttcggacattccccatggacaaggccgtctctgtgctatacacaattgtcacccccatgctgaatcctgccatctataccctgagaaacaaggaagtgatcatggccatgaagaagctgtggaggaggaaaaaggaccctattggtcccctggagcacagacccttacattagcagaggcagtgacctgagaatctgaaagatgctacagggtattagcctgctggataggaccctcgagaagccattttatgctactcttaggacatcatatgctaaagatattatggcttaaaatagataatggacaatgttacactgatgagaattatctgtgtaaagaaagttttcagtcattctaggatttccaaaccttgtcttcttaaatatgatagaatggaaaaaaaaaaaaaggatattaatctgagaggggtttggtatcattgttattttttaaaaagtggatttttaaaaattttctttaaacattttttacatgcctacttaatatggttaatccatatgaatgggttaggaaaaactgaaatgtctactgattaactgagttacctcaaaaactaaactgcagcattaaattattctaagatgttacccaaatcgagaatatgtgttgaattacataaagtatgtagcattccagatccttttcttgaatctcttctcctaaacaagataacttattggctgtttaaatgctcttgtggaatgtttcttatcttttcctttttgccatcaaaatata

SEQ ID NO: 468281 - DNA, 1406 bp, Homo sapiens
tgcctctgctggcacctggagctgcccatcccaccacagcagcaagtgtgcctggctgtgtgcagtggccagacccctgtgcttgctcactcacacacctctcgcctctcccacccttggcaagcatggaatccaggctggtagcacgagccaagtgcagcctgccaggccaagtgggtgaaaagaacccagcagccatgagcaaactcaagcagaggaaccaccagccacagaggtttctgtctggaaaagaaagggatacagctatttattccattaatgtcagttttgttgcaaaggggatgactagccgctctgtgtgtgagaagatgaccatgacaacggagaaccccaaccagactgtggtgagccacttcttcctggagggtttgaggtacaccgctaaacattctagcctcttcttcctcctcttcctcctcatctacagcatcactgtggctgggaatctcctcatcctcctaactgtgggctctgactctcacctcagcttacccatgtaccacttcctggggcacctctccttcctggatgcctgtttgtctacagtgacagtgcccaaggtcatggcaggcctgctgactctggatgggaaggtgatctcctttgagggctgtgccgtacagctttattgcttccactttctggccagcactgagtgcttcctgtacacagtcatggcctatgaccgctatctggctatctgtcaacccctgcactacccagtggccatgaacagaaggatgtgtgcagaaatggctggaatcacctgggccataggtgccacgcacgctgcaatccacacctccctcaccttccgcctgctctactgtgggccttgccacattgcctacttcttctgcgacataccccctgtcctaaagctcgcctgtacagacaccaccattaatgagctagtcatgcttgccagcattggcatcgtggctgcaggctgcctcatcctcatcgttatttcctacatcttcatcgtggcagctgtgttgcgcatccgcacagcccagggccggcagcgggccttctccccctgcactgcccagctcactggggtgctcctgtactacgtgccacctgtctgtatctacctgcagcctcgctccagtgaggcaggagctggggcccctgctgtcttctacacaatcgtaactccaatgctcaacccattcatttacactttgcggaacaaggaggagaagtggtgtacatactagtacaagtttacttgaaatttaaagggaagagggactagaaaattaactagtattaatgataatggaaaaaaaacttcacaaaaggagaactatataagattatcattttcccagctcccctacaatgaaaataggacacaaactggtattttccttatg

SEQ ID NO: 468282 - DNA, 807 bp, Homo sapiens
gatgatagaggagaaattgaaaatgaagtaaaaatgatttgaggttgaggttatgccagtggggagagagatgaagggtgagaagaaatgtccaactcatgacagcattcatcctcatggaccttccccatgtcccagctctggacgccccactctttggagtcttcctggtggtttatgtgcttactgtgctggggaacctcctcatcctgctggtgatcagggtgtactctcacctccacacccccaagtactacttcctcaccaatctgtccttcattgacttgtggttcttcactgtcatggtgcccaaaatgccgaggaccttgttgtccctgtgtggcaaggctgtgtccttccacagttgtatgacccaactctatttcttctacttcctggggagcaccgagtgtttgctctacacggtcatgtcctatgatcgctatagaggaaatactcagcacttcccaggtagtgaaaacactccccacgaagtgagccaaatgctagtggcccggggggcacacgggctcccactcatcatcctggcagatctgagtgggtaactaagagttgatagttcttagtgggcaattcaaaattagtaatataatttagttatccaagtgaaatttattacatgtataggtctcagcattaaacattattccaaacaacttgcacagttataattctttcacagattatctaagacatttttaaattcacagctagatttttatttatgatgaacatgcttgtagtatctattgatgcatttctcatcaatagatttttttaactttt

SEQ ID NO: 468283 - DNA, 1559 bp, Homo sapiens
ggcactccccagtgagagggagagagaccaagggtgagaagaaatgtccaacgccagcctcgtgacagcattcatcctcacaggccttccccatgccccagggctggacgccctcctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcaggtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgtgatggtcatctttgtggacattgggatagtggcctcaggctgctttgtcctgatagtgctgtcctatgtgtccatcgtctgttccatcctgcggatccgcacctcagatgggaggcgcagagcctttcagacctgtgcctcccactgtattgtggtcctttgcttctttgttccctgtgttgtcatttatctgaggccaggctccatggatgccatggatggagttgtggccattttctacactgtgctgacgccccttctcaaccctgttgtgtacaccctgagaaacaaggaggtgaagaaagctgtgttgaaacttagagacaaagtagcacatcctcagaggaaataaatactaggaagtaaatacactagtttgtttaaaaatagtaatctaatttagttattcatgtgaaattgattatatgtatagttctcagtgttaaacattattccaaaacacctgcacagttataattcttccacagattgtctaagacagttttaacctcacagctagacttatatttatgatgaacatgattatattctgaattattgactcatttctcatcaataggtttatattaagtttaaaacatattttaatcaaatctcagggatagatgattaattcatgtttataaattgataaacggtttttgtgttttgtttgatttcatatacacataaacttaagaatttaccatcatggagacatagttcaaaaccagcaacaaatattattcaaaaccagcaaaaaatatcatttttctaattgtggctgttcaaatttgtttttggttttaacgtatctatatatttgtatgtgtatatactattccaaacatgtatacaaaagaaagtacatgacatttagcatatttaacatataggttttcatatatttatgtatgtgtatgtatttgcct

SEQ ID NO: 468284 - DNA, 1695 bp, Homo sapiens
ctccttatatccccagagggagagagaccaagggtgagaagaaatgtccaagaccagcctcgtgacagcgttcatcctcacgggccttccccatgccccagggctggacgccccactctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcagatgtgccctcctggccaccagcacttggctcagtggctctctgcactctgctgtccagaccatattgactttccatttgccctactgtggacccaaccagatccagcactatttgtgtgatgcaccgcccatcctgaaactggcctgtgcagacacctcagccaacgagatggtcatctttgtggacattgggctagtggcctcgggctgctttctcctgatagtgctgtcttatgtgtccatcgtctgttccatcctgcggatccacacctcagaggggaggcacagagcctttcagacctgtgcctcccactgcatcgtggtcctttgcttttttgttccctgtgttttcatttacctgagaccaggctccagggacgtcgtggatggagttgtggccattttctacactgtgctgacaccccttctcaaccctgttgtgtacaccctgagaaacaaggaggtgaagaaagctgtgttgaaactgagagacaaagtagcacattctcagggagaataaatactaggaagtagatacactagtttgtttaaaaatagtaatataatttagttattcatgtgaaattgattatatgtatagttctcagtgttaaacattattccaaaacacctgcacagttataattcttccacagattgtctaagacagttttaacctcacagctagacttatgtgtatgaggaacatgcttatattctgatttattgattcatttctcatcaataggttcatattaatttaaaaaaatattttcatcgaatctccgggatagatggttgagtccttcatgtttacaacttgataaaaagttttgtgttttgtttgattttttttgcacacaaacttaacaatttaccattatggagacatcgttcaaaaatagcaacaaatatttgaggtcatttttctaattgtggctgtagctgttcaaatttctttttggttttaatgtatctgtatatttgtatgtgtctatacaaatccaaacgtgtatacaaaagaaagtctgtagcatttagcatatttaacatataggttttcatcatgtatgtatatgtatctgtctatttacatacatgtattggaaaacatttctagaaacactatttttaatgggcaaaaatagcaagctattaatatttaaatattatcaatgaatcaaatagaaattgtgtattcacagaatagattactatccagcaatgataatgtac

SEQ ID NO: 468285 - DNA, 1085 bp, Homo sapiens
tgaggtacctagggtagtcacattcatggaaaaagaaattagaatgctggttcccaggagccacagatgttggaaggaaatggagaagttgtttaatgctatcatctcctccactcgacttcacactcctatgtattttttcttgggaaacctctccatctttgacctgggtttctcttcaacgactgttcccaagatgttgttctacctttcggggaacagccatgctatctcgtatgcaggctgcgtgtcccagcttttcttctaccatttcctaggctgtactgagtgtttcctctacacagtgatggcctgtgaccgctttgttgccatatgttttcctttgagatacacggtcatcatgaaccacagggtgtgctttatgttggccacggggacctggatgattggctgtgtccatgccatgatcctaactcccctcaccttccagttaccttactgtggccctaacaaggtgggctattacttctgtgatattcctgcagtgttacctctagcctgtaaggacacatccttagcccagaggagacgaggaagtgggcagaaaggtgactgattaggctccctcagcgtacgttatcacatcattctattcccaggttgctatggtgcttcctataatccaagttgcttatagacagtgtgcatggagctttctcaacctgccttgctcacctctttgctttctcaacctgcattgctcaacctgcagtctgcaactctttgtggccatggacagaagctcagaccgagagctctctgcgattctgtgattcagagaccgaacttgtgtgtgaccatctccttgaactccttgatttctagcctgagaaatgaaagtgtgaaacaagcttcacataaaatatttaaagaacaaactttattcatgaaaataaatgagaagatgatgaacttctaaaggaattttgaatattcttttcttagcagctttcaaaaaaacttcgcattaaatagtactgtgtctttaacttcattcctaaaccctgtatcttagtatgaaaatttgctagtacccatgcttttaaagtaaatatagcttatgc

SEQ ID NO: 468286 - DNA, 564 bp, Homo sapiens
gtgtgcgcctctcgacgtccagccgcctgtgtgtctgcctgagggaaggggagctggaagggggatggagtgggaagataatcttcccctggagtcccgcctggggacagtcaatctcttctctgaagtcccaccatcaagccttccctccaaagtcaagctgcttttctccaaagtccagctgcttcttctcttctctccttctctgccactatgctgtgcttctctgctagaggagcttgggatttttatgggtacagggtgtggggcagagcaggacagggtggttttggaaaaagcaacattccggcgggaaaattgggatgtgaagttctcatttagggccatgagtccaggcttaagggtggaaccctcgccagagactccaccctttcaacccagtattccctgcctcctgtctgtatctgttttaggagaattttgacagattttgaaaacaatgaattgcatcccagagagtggaaacagcctatccaaatataccaaagtttgatatagttagttttggaaaaatgacaaataatttggtgagtttagagtgta

SEQ ID NO: 468287 - DNA, 543 bp, Homo sapiens
gcataactgggagatgctacactcttagtttgtgtgagtgcaatgagcccccagcagttctaccctttggcagtgactatccctggagtgggtgtcataattgtagaagcacaggttactgctcgagcagagcacaccactcgggctctgaattacacccaagtggcccttctcttgttaacagatgaggctgatcagatcagaaaggaatttcttttctccaattcaacaggaccaatagcactggtatgcctatatcagttgttaaatgatctgaatatcatgtttggcatgtggaaaaacactagtggggacattatctattcatttataatgtgtcatgcaaataatgccccataccaaccacaccgagaggttgtgacttttatactcccttttaaagaggaaggtatgcaatgattctcatttttgttatattatgtgtctttaaaatgtatataagaagtgactttttgaaagtcaaagaactaactttatgtgtcactgtgtgcagacacgtgtgtatggggaggtattcccatg

SEQ ID NO: 468288 - DNA, 1090 bp, Homo sapiens
ctgatttttttttttttttttttgagaaagggtcctgtcaatccacaacccccgtggaaaagactaagggataaaaggtcatgaaccttaagagaggcacaatccaacaggttctctctcccacttcctactcaccggctgagcttcctgctgcctacagccttcctgtcagccgcccatttgcacgacacccctaccttctttgggatttggctgaggaggcagtgacccacagggctctcagtgaaagccacgaaggaccatatcttaggaaagttacaaatgagagaggacagatcagcaaatttcaagctaaaagcaaatttcaacctggctatggtgattttcaaatttctaactttttgtttacacagacaagtaaaggtagtgatgtgatggtagagacaacattctgcagccttaaaacaaaaactgcaggactgtgtatggtgactttggctgctctctttgaaaaggtacagtttgtcacggcttgccttggctacttggctaggaaagggaaatcccccgaccccttgtgcttcccagttcctcaacttcactgccagtggcctggagaaaaagggtgagatagtagtttacaaaataattaaaccgcctaaattagtaggtaataaagtcagattctaggacggttataggatttttccagagtgtttagatgccaaactccatgaaggttagaacctggaataagacatctacttattgatgtctttcataggttctgccttgaattcagatgtttctataggagacaattttaatcacagagaagatcagaggttttgaagaatgcgttatttctgaaatgaatgaagaagggaagctggaaagttaaggtttgactggaaagctaaggtttgcattccacttctgccattatctaccttggtgaccatgaaaagaacaattgaaagagcaacaacaaacttccagtaacaataattgaattcacattattaataataattttaacagatggaatggaatgtgtaccacatgcctcaaactgtgtcaagcacctaaagttaatcagttataaaatgttgaaattatatttattaaa

SEQ ID NO: 468289 - DNA, 621 bp, Homo sapiens
agcacgactgtccagcaaccaggcatggctatgctgggactccaggagaagccagcagagcgaagcgttcgcagggcaaaagtctcctacgggagcaagtcaagcatagggcgatggccagttctggctgagcttgactgtagacattcctgtaccaaatgctctggactttacatcagctggcttgctgcccctaccacttctctaagcatctgtccctgccaacttgagtgtctgtgggtgatcaaggggcctctttctgtgaaggttccagaggcctgcagtgagagtcagctgctccttcacagttcaactcactcgttctcctggagccaggaacaagtcctcatgtgtgatagccccatgcagggttcccagctttctccacattcagcccagcttctgtgtcttccttctgtctactctctgcctagcagtcatgtttgttagagatatgcctgttgtctcagtccctgtgtgggagctgttccacttggttgcgtctaatttgtgtattagtagaaatagaatattttgatatgtattagtaaagtttgataactagtatacacattaggttcatatagtacgtctatattttgttaagcattaatgtataaa

SEQ ID NO: 468290 - DNA, 540 bp, Homo sapiens
agtggctgctcacttcctgctgtatgacctggttcctaacaggacatagactgataccggtccatggccaggggaatgatgaaagcaattctctgctggcaacaggaatgcacaagtcaacagtcaaggatgggaggaaaaatgtttgcaattgtgttattgggcagtaatagactatttgacgtgcagcaacaagagaagagaggatatgcacaaagactgctttatacaccagtgcgggggcagtgtacaggtgatccaggcaatagtcccctggccacccctggttccagaccagcccagagcaaggtcagtccacagagccccaggcttcaaacctgccccagtacaagatcagaaacccttgcctcagacaccaggttggcatctgcagacacaggttccaggcctacccaatgccacaccagcccctgtggcctcaagctgcggcagacccatggtccagatccatgccagtggaccccagtggtgggggagcccccaagacctagaccccagaaccacccatgaatacctagg

SEQ ID NO: 468291 - DNA, 491 bp, Homo sapiens
aaaccccaaaatggtagatccattgacagcttgcaccatgcacctggaaaagccacagacactcaatgccagcccactaaagtacccatggtgggggtctgtaccctgcaaagccacagggctggagtggcccaaggccataggagcccacctcttgcatcagtgtaacctggatggctcaattcaacaagacctatcaagcctgaatatgtgtgtacccaatgcgggagcaccaagattcataaaacaggttattagagacctacaaagtgacttaaataaccacacaataacagtggaagacatcaacaccccactgaaagtattaggcagaccatcaaggcagaaaattaacaaagatattttggaactgaattccacagttaactaaatggacctagtaggtatctacagcaagctctaccccagaataacagaatatacatttctgttatctgcatatggcatatgctctaaaatgaccatgaaat

SEQ ID NO: 468292 - DNA, 2420 bp, Homo sapiens
ttttgtttatctggagccagcagtttatctagagggaaaagttcttcaagtccccacccgtcccagaagcccagccagcttcacctctcactggcactcgccacaggcagtcaggcagcccagcgggagctcatcccctgatcaagcccagcaggctccggcaggccacgcccagtgcggggccgcggagctcgcacccacccggaacccgcgctgggctccggccgcgcgcaggccccgcttctgcaggagcctctccctccgcacctccccgcgaggagagggagcgggctccgcctcggccagccccagagagggcgcccacagcgcagcggcgggctgaagggctgctcaagcgagaccagagcggacgccgaggctgaggaggccctgagagcgaggagagcgagcgagggttgctagcacgttgtcacctctcacaatgactgtcttcctcaagacaccaatcatcttggattggggcctcatctttttgacctcacttaatcttaattactttcctagaggccccgtctggaaatacagccacattgaggacaaccagaccttatgggcctcatttaggaaggacacaataccagtactattgctggcgggatcaaacctgaatctgctcaagcctcaagttcacctaccaatttgtagaaaatacagagcccagaggaacatatttaaatgtaccatgagtacgcaatctgcaaaatccagagactgtgagaaactacagattaaacattgtgtagataaagaacaggatgtatatttaaaggatacattaaatcaaaattttaaagtggcacggataaaggatggtattttgaaagacaagtctgggctaaagcacacacacagaggaaagtgattactataaaagtgagggtactaattgcatataggaagggagagggttgaaactggaggggaccacgggaaaggggcctctgtaatggttgacaaggctgtatttcttgacctcttggcttcaccatacatctgatttgtgtgattcattttgcgttttattttgtgatttattttgtgattattgtgtgttttattttgaaatggattatttttaaaaggagctaatttctcaaaatacatgaggaatctcccaaaatatctggataagacgatgaagaaatgtgattatcaaactagaaactaatactcgttgtaatttcatactttaaatataatatgcaataactaagttatttaaataaatataagatgccaaaacaattaactaaagtattaaaactttcaccaaagaatgttttttgcagggcttcagatcttgccaagcagtaatctaagtgaatttcatcaatgaatttttttgttgagttggctgaattaactattgtctgtcatatttgagacaaagacttgaaacatctgagacaaaggacttgactaaatcgccttgataacagtatctacactgtggttttttgaagtgaataccatacagaaatggcaagaattaatgtgataacatataaaaattggtattttttgtttacctagtaccctctggtttagatttctacttcctgcaaaattttcgttatttaatttacaacatgctagtgtaggtttttgatgatctggtgtcaccatttttgtgctacagcttttctcattactctgagcatatgctgagcaaaattcacaggaggttttacttgagtttaaaatagggtaacatcatagatccatagagtatatgaattaaaatggaatattagatacaactaggtaaggacagtggactgagcatttgcatttatctcttttaaaaccatactaaataagagtagtaggatttttttgaaacaatgtaaactcacaagaaaaaaatgaggaataatagccatattttaaaataaactttatttattagaagagttttagacttataaataaattataaaaatagtacagagattctcatagggcccatacccaagttcttctattatttatatggtatattaataaatgatacattattacaattaattgaccatattaatttattgtcattagagttcatacttcattcagatttctttagtttttacctatttgttcctttccaggattgcatccaggatatcactgtatttaataatgtatttaatagtcatgcccccttaggctccttaggctccttagattcctcttaactgtgatagtttctttttgtctttggtaactttgatagttttgagaagtactggtcaggtatttggtaaaagcacgtttgtcaatcagtatattttcctgatgccttttgattttgtaaatagatgttgaagaggtaaagggtcattttctccatattatatccagtgtatatattatcaacatgacttgagactgttaaagtc

SEQ ID NO: 468293 - DNA, 969 bp, Homo sapiens
gccaggtgcttttttaggtgtgaggacacaaaggttaagtacataacaatcaatgtgggtgaaaagagtggaagagaaaagaggcaccgaatctgagtataaatgactgaatacattgttacatatgccaagattgataccgaccatttatctacctcctggtatattccagagattataagcatgattaacagcaaatctttgttaaacacctactatatgccaaacactggaaaatcaatggtgaacaaaggaaaagttgtccttgtcctgcagaagcttctggatgcaaagacccatccctccagcccagcaggccttccaggaggccagtgggagagtaaagagtcaagacaaaaagcagagaaggtgtctgtagctgctgccgagcctaaggctttacagaagtggagtgggggatatgccagccatggcctgaaaccagtgtccaagaggcagtggaggatgctggatagagcatgagcacgatgaactttgctctgtttcaagtccatgccccaggctttcccacgtttctgcttttgctcaaattctttgctccattgctccatctggaatgcccttctgtctccttctttgccaaatttctaaatattacttatccttatggtcttctgtaaggtcctttttcttcatgaagcctttcctaatctgtttagctggaaatggttataggacattctttatttccttttagtggaacattccttatttctccttgtaaacgtatgctttctgaaggttaagttcatgtccagttcatatttgaacttccagtctgtaatacatgtctttatatgtaatagccatgtgttcatttactcaacgaataaatcagtcagtaaatgagtgtataaatcttgagggagttctgaattgtgtgtggtgttaaagatgtgccaggagaattgtacttgtttatttattaagcacatactgggtttaaga

SEQ ID NO: 468294 - DNA, 3861 bp, Homo sapiens
actttctgattaataagtctgccaattttattaatagaaactcatcaaagaatggcagcagaaaaccattcttttgtgactaagtttattctggttgggctaacagagaagtcagagctacagctgcccctcttcctcgtcttcctgggaatctatgtagtcacagtgctggggaacctgggcatgatcacactgattgggctcagttctcacctgcacacacctatgtactgtttcctcagcagtctgtccttcattgacttctgccattccactgtcattacccctaagatgctggtgaactttgtgacagagaagaacatcatctcctaccctgaatgcatgactcagctctacttcttcctcgtttttgctattgcagagtgtcacatgttggctgcaatggcatatgacggctacgtggccatctgtagccccttgctgtacagcatcatcatatccaataaggcttgcttttctctgattttagtggtgtatgtaataggcctgatttgtgcgtcagctcatataggctgtatgtttagggttcaattctgcaaatttgatgtgatcaaccattatttctgtgatcttatttctatcttgaagctctcctgttctagtacttacattaatgagttactgattttaatctttagtggaattaacatccttgtccccagcctgaccatcctcagctcttacatcttcatcattgccagcatcctccgcattcgctacactgagggcaggtccaaagccttcagcacttgcagctcccacatctcggctgtttctgttttctttgggtctgcagcattcatgtacctgcagccatcatctgtcagctccatggaccaggggaaagtgtcctctgtgttttatactattgttgtgcccatgctgaaccccctgatctacagcctgaggaataaagatgtccacgttgccctgaagaaaacgctagggaaaagaacattcttatgaacagaagtacaatgaaaaagattgcattagatctaagtttttggctatgatattgtatgaaatgatgtctttcactttagtgcatctgtcaacattctttctaatttggggggattttactgacctcatgtaggctgctttatgcataaaattatttatagccctctgcttatacagtttgtaattcatctaagcctttagctggagggaaggtaggagagtaagctacagctgtaaagggctgtttcctggaaaatctaaaaacacattacactaatcatatcaaatagagctggtcagggtctccgtcagtcatggactctattgttttgagccaacacaaatgctagcgtgaatgtatttcttccacttatggctgatttctctaagctaaaccaaactattggcttatttggtattgcctgtgtacctcagggtaatcaacacaacataaacgtatgccagaatcagacctacaaaaatatacttgtaaaggctagaaatgtcatttcttcagagaactcatctttgaaactgcagctaaattatacaccatccctctcttcttgctctcagatactggctacttttcttctcagtacgtatggcttatgataataatatgatacttaaatgcttattcttttaatctttctctgttgagttgacttaagctctaataagacatagagtagacactcaaataacattgattgaaaatagtaccagacacctcagacatcccatgtcagatcctctgcctacctctcatttccatctcgtacacatctgttagttctgtgcaagctcaaactcaacttgcattaacagaattccactttaaatatccacgatgaaacttttttcatattttaaaattaatgttatttttaggacagttttaaatttatcaaaaactttttatgataatacagagttcccttgccctgtataatttttcctattactaacatcatatattaatatgctacattagttacaatgaatgagtcattgaaacattattaaatagcatctatattcttttgtttacttgtttaattggaacaaatatattatttgtggtgtacaacactgatgctttgatatatgcatacatcgtggaatgacttaagctaattaacatatccattgcctcacaaatttattatttttttgtggtgagaacatttaaaatctactctcttagcaattttcaagtatacgatatactgttattagatatacttgccttgttgtacaataagtctactgaacttattcctcctaactgaaattttgtatcttttgaccaacatctccccagttgccatcccctcccgcaaaccctggtaaccaccattttactgctgctttgatctactttttagattccacacataagtgagatcatgcagtgtttgtttttctgtgcttggcttatttcatttaacaaaatatcctccagattcatccatgttttagcagatgacaagatttttttttaagtctgagtagtattccattatgaatatacacctcattttctttatccattaatgtgttgatggacacatattgattacataacttggctactgtgagtaatgctacataaacatgggagtgcagatatctcatcaacatactgatttcatttccttgggatatataaccaatagtgggattgttggatcacatggaagttctattttttaatttttgaggaaaccatactgttttaaataatagctgtgtgaatttgtattcccgccaccagtgtgcaagggctttctgttcacatcctagccaacccatgttatatcttgtcttcttgataatacctatcctaatagctatgaggtgatacctcattgtggttttaatttgtgtttctctgatgaatagtgatgtcaactatcttcatttacctgttggccatttgtaggtcttctttggaaaaatgtctatttgggcctatttttaggttggtttatttttttcttgctattgagttgactttttaatatactttggatatcaatcccttatcagatgtatggctgcaaatattttcttttatgccataggttatctcttcacactgttaattatttccttttctgcacataagcttcttagtttgatgtaccctcatctatctatttttgcttttctttcctgtgcttttggagttcaatctaaaaggtctttgctcaaaccaatatcaagaagatttccctaaagtttttctctagtagttttatattttcaaatcttatactttatgtttttaatccattttgagttctttacttttgtacatagtgtgaaatgaggccaatttttattcttttgcttgtggatatccagtttttccaacagatttttgaagtttctgtccttccaatattgtgtgttcttgacacctttgtcaaaaatcatttaaccacaaatgagtggatttatgaagtttcattttcaccatattatatcaaaggtacatactatcaactttaaacacacttattactgttgatgccaaccttgattttgtggttgaggtagtgttggtctggtttcttcactaaaaagttacactttttttcatattttctgtactctctggaagaaagtcagtatgcatggcttacacttaaagagtggatggttatgtttcactttatttagggtgaagtatcttcataaattattcagaattcttctttgtgagatttttctcttttctcatttatttatttgtccaatcatgtatttatgttaccagtgtggactcatggacattactatatatattgggttataattcaataatactttatttgctgctcaaattgttctaacattgtcatc

SEQ ID NO: 468295 - DNA, 781 bp, Homo sapiens
cagcaccaaggccatgcggaaggataatgatctgaagtacattgagaaggccatcaagaaactaagcaagtggcaacagtaccacatccacgcccatgatcccaagggaggcctggacaatgcccgacgcctaactggattccatgaaacctccaacatccatgacttttctgctggtatagccaatcgtagtgccagcataaacattccccagactctcggccaggagaagaaaggctactttgaagaccattgcccctctgccaactgcaacccctttttggtgacagaagctctcatccgcacgtgtcttctcaatgaaacctgcgatgagcccttccagctttcatcagttgagaggattgatctggaggacaacactccagatgaggttgaccagtatgcatctaaccggcttgttgcctctcataagaagaacaaagatatagaagatgaagacactaaaagtctagaggagaagatggacagatattgtaatgttggcacaagtcaacgctgtggaagatcagaagagggagagattggctctggtgaggagttcagagaagacatctcagaagggatatttgagcctggcctccaaggatcagcacaatatttataagaataggtaggaaaatgaagggagcagtggaaggcagtaatttgcatcctgaatgcatatcaatatcacttggtgcttagataacagccaggggtgctagttctgggtaagatggggtaaacattttttacccttcctcccatactgaacatgtct

SEQ ID NO: 468296 - DNA, 748 bp, Homo sapiens
aattccacagggagagggcgcaaaagctctgcattctggacccttccaggtcttactctacggtctttgcatttctggcaattggatgggccaacctggatctgccaaccagtcctgtggccctcacccaggaacctactcaacaaaagaagacagcttcaattgctgtgtgggtctgagtggattaggtgggggaagatctgccatcagtgctggcgggaaccatccaattggctgtgggcccagaaggaacaaatacagaaggcgaatttgtctctctctgagagctgggacagactttactggtgctgtcttggacatcagaagtccaagttcactggcctttggactcaaggacttactccaggggacccctgggaccattaccgtgctgtgtccatcctacctgcagaacctaggaagattttccacaactttagacttcactgcctggggtccagcctctgttggtttaccacaatgggaacacactaagagaggcatccagcacaaagctagagaatcagagaagctgtagtttgatatataatactttattgttgaccatactgttaccctactgtgcaacagaacaccaaaatatgtgatattattaccctgctgtgcaatagaacaccaaaacttattctaattgtaactttacagaacaccaaaatatgtgatattattaccctgctgtgcaatagaacaccaaaacttattctaattgcaactttgtacccattga

SEQ ID NO: 468297 - DNA, 617 bp, Homo sapiens
agacttaaacacaaaatcttatactataaaactagtagaagatggccgggtacagtggctcatgcatgtaataccagcactttgggaagctgaggagcccttcaacccgccgctgcgctgtgggggcccctctctggggctggctgaggccgaagccggctccctctgctggcggggaggtgtggagtgggaggcgcgagcgggagccggagctgcgtgccgcactcgccagctggctcggtttctgggtgggcgcgggctcagcgggccgcacttcgcgcggcggccggcgcctgatgggcttgatcagggggacgagctccctttgggctgctggagagccggggccaggtgccgcaaagtcccactgcaagtgccattgagaggtgaagccggctgggcttctgggtctgcagcttcactgctgaagccagcgagaccaggaacccaccagaaagaagaaactccggacacatctgaacatctgaaggaacaaactccggacacaccatctttaagaactgtaacactcactgcgaggcttgggtaacagagcgagactccatctccaaaaaaaaaaaaaaaaaaaaaaaaaaaaaaaaaaaaaaaaaaaaaaa

SEQ ID NO: 468298 - DNA, 1468 bp, Homo sapiens
cagccaccatcactcctggaaaataactcaaccttttattgaaggttccccagtgatgacagcaggcaccagccatggtgagagggagcaggggaatattcaggcccaggcagagttcctgtgtgaagtgtggtagcagttgtgctgaggccctgcagctggagagatcagccactcttcaaaagaaatcagagagcgaatctgctggaaataaaatcaacccttcctcattatgtttcctctttgtgtacttttcctgggttgatgcccaggtctgggaagaggagaatggatacagctcggagtgggttagctgtgagttcttagcatctgtgttcttggatcccacagcctttggatcaggaggaggtcagaagtccagattcaaagtgccagcaaatgtggttctttctggaggctctgagggaagcgtgtcccatgcctctctcctagcctctggtggttgtcagcaatccctgacggtcctgtcttaaacagcagtccccgaattaaagactcaccttggtctagtaagtcttcatcttaactcattacatctgcaaagaccctgttttcaaataaggtcacattcacaggtactggaggtgaggacttgaacatatattttagggagacacaattcaacccacaataccttgtgtcctgcagccttgctaaattcacttactagttctcgtatattttcctgcagattatttgggattttctatatagatgatcagtcagtttacttttgacaaaacaccagagccacatatgagcaaaggtttctctatattaaccacttctcttgtgttattgccatagagtttgaggtttttttaaaaaagtgtttctgttgattccaatcttgactaatcatgttgagcctctttttcagcacttacttgacttgtatattttctttggtgagatgtatattcaaatattttgcactttttactaatggattgtcttattgaattttgagagttcttcatatattctaaatatgttctttatcagatataagtttggcaatattttctccaagtatgtagcttgtctactaattttcttacagtgtcttctgaaaagcagaagttttaaattttgataaatttcaaggtatcaggtttttcttttatagttcataatttttttgtcctatataaaaaatctttgcttaactcaagatcacaaagattttgtcttatgctttactttaggcattttattgttttagctctataaatctttgtttaaaattttatttattgttttattttctttattgtggaaaatcaggttttcatttttccaaaaattgcaccaaagtaaagcaaagctctaattgatgtgggtgtcttgtgtaggcgttagcagtagtgccctcactgtgcactcattggacagtagtaaaccttaagttgacttttcaaaattctttcaagcttctctttatact

SEQ ID NO: 468299 - DNA, 825 bp, Homo sapiens
agacatccaggtttggtctctgatgcccactgctctctcctatgaacaggaacagccacatatgctaatgaagctcatccaactttactcactttacattcctcacagtcttcagacaacatctggacaaattctacatattttggacaggatttctcagtcgtccctcccctcccctgcccctccaagcatgcctcctttatatgcaggggtattcactctaaggcatcttcttgaggatagacattatttctcttcattgaaacccccagttcccagaagcgactcagaagcaccaggtaagcagctgcaggatgctgactggatttgtggggctatgttgatcacaagccacatccctctctttctgtctgcccccctctctctctctgactggctgtgtagcagaacctttcagcagaaaggtttagaggccatgcagattacatgcgttccattgattaataattgtatgctctatcatggattctatatcataattgtatagaagcatacattactggtctagttcccatagtacacttcaagcatcagcatactgttactgaatcagcatactcatcaacatacaagaatcagcatactcatcaatcacagggtacaggtattaaataaatattttgcaagtttactcttgaatgtcttcaaaagtctttagaatacacttacaatgattttaagctgagaataagaagaaccaatacatatttaatgaagttcagtaacactaaatatattagtactatattgatctttgaggaaaacatcgattgacacagatttccgttcccttgaacagtattg

SEQ ID NO: 468300 - DNA, 699 bp, Homo sapiens
agacttaggtcacctagcctgaggggcagttttggagaaagagatggccagaattataaagcccagcagctctcggtgccagaggctgcggagagtttctgtgtttttcgactattcattagtgattacatacccccctgaacacctgcaagaccaattcataaagcaagcattcatggactttggcaacagcttcatgggaactgcagggtacggggaccctttcgggaatgagaagaggggagtggtgggcactgcattgattgtgacggggccagcccggccgtgggtacgtgtggcatgctctccagcgagtgacactgatttacagcaggataacaggaagtgtggagcttgggtggcctgctgtgtaattctggaatggcaggggctggaagagtatggctcggaaagacaatgccggaacatcgtggcagctaagtctgagctgaatgcgcagaatgagaggtttactcagaatgtagactctacgtagcagtaatggagaaggttgttagttacctaataatgatgaaacgctggataatttacccagaataaaaagcttgctcttttctggatgatctggttaattatttggttaaattaggttaaaaccttttctgtcggggtctctaattatctggaaaaccaggtaactgtgtccttttaagagcttttagacttgaattattcatc

SEQ ID NO: 468301 - DNA, 695 bp, Homo sapiens
aaataactctcacagtggagcctgcatctcattgccgcccttctccccatcccaaagcctcctttgcgtcttcctctcgtatccccccaccttaatccacaagtatgggacatctctactccttccctggcaaccgatcacatgcccattaccatcccattaaaacctaatcacccttaccccgctcaacgccaatatcccatcccacagcacgctttaaaaggattaaagcctgttatcactcgcctgctacagcatgggcttctaaaagctataaactccccttacaatttccccatttcacctgtcctaaaaccagacaaagcttacaggttagttcaagatctgtgccttatcaaccaaactgttttgcctatccaccccgtggtgccaaatccatatactctcctatcctcaatacctccctccacaacccattattctgttctggatctcaaacatgctttctttactattcctttgcacccttcatcccagcctctcttcgctttcacttggactgaccctgacacccatcaggctcagcaaattacctgggctgtactgccacaaagcatcacagacagcccccattacttcaatcaagcccaaatttcttcctcatctgttacctatctcggcataattctcataaaaacacatgtgctctccctgctgaccgtgtccggctaatc

SEQ ID NO: 468302 - DNA, 2636 bp, Homo sapiens
cgccccggcggctcgccgcgcccacccgctccgcgccgagggctggaggatgcgttccctggggtccggacttatgaaaatatgcatcagtttaatactgtcttggaattcacgagatggaagcatagatcaaagctgtttggagaaaatcggaagtacattggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcagcagacattaaaggtacaggttcctggactcagctctatttgattactgattaccatgaaaatggatctctctatgacttcctgaaatgtgctacactggacaccagagccctgcttaaatcggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctatatggctccagaagtgctggacgaaagcctgaacaaaaaccacttccagccctacatcatggctgacatctacagcttcggcctaatcatttgggagatggctcgtcgttgtatcacaggagggattgtggaagagtaccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcgttgagaattaagaagatgcttgccaagatggttgaatcccaagatgtaaaaatctgatggttaaaccatcggaggagaaactctagactgcaagaactgtttttacccatggcatgggtggaattagagtggaataaggatgttaacttggttctcagactctctcttcactacgtgttcacaggctgctaatattaaacctttcagtactcttattaggatacaagctgggaacttctaaacacttcattctttatatatggacagctttattttaaatgtggtttttgatgcctttttttaaatgggtttttatgaactgcatcaagacttcaatcctgattagtgtctccagtcaagctctgggtactgaattgcctgttcataaaacggtgctttctgtgaaagccttaagaagataaatgagtgcagcagagatggagaaatagactttgccttttacctgagacattcagttcctttgtattctacctttgtaaaacagcctatagatgatgatgtgtttgggatactgcctagtttatgatagtttgtcctgtctccttagtgatgtgtgtgtgtctccatgcacatgcacgccaggattcctctgctgccatttgaattagaagaaaataatttatatgcatgcacaggaagatattggtggctggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccatttttttttgtggttattatttttgtcacggaaaacatcctctccaaagttggagcttctattgccatgaaccatgcttacaaagaaagcacttcttattgaaatgaattcctgcatttgatagcaatgtaagtgcctataaccatgttctgtattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagggaagaaatgttataaagtagaactaaatataaattttcagaattaatgcattcaaagtaatatatcaaatccaggactttgttaacttcaggcaaaaacttcattagggtaatatcatctcaattttttcaaatgaaaggattctctaattagaaatttatatgtcagagctgttctaaatttatcaactgtcaaatatgttttggacagctaaatcatttgagatttttggttttttgatttctattccctaacttgtgaagacaatgaaaaatcaggcagaaatatttagtatctagtcagtatctgtagctacactgtataactgttcttcaataaaatggttcatatttaaaaaaaaaaaaaaaaa

SEQ ID NO: 468303 - DNA, 2048 bp, Homo sapiens
gccgccgcccaccgcccgccgtcatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccaggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggagtccctggggctacccccgatggtgagaccccttcagaccctacagagaccccactgctctcacagctacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctaccc

SEQ ID NO: 468304 - DNA, 1437 bp, Homo sapiens
gacgtttgtgatggagcctttggtctctgatgttgagaggcccatccctgtctcctcgtttcccaatccctgaagccctccagaacggtgcccaccacctggaggtgctttgcgtgaggtgatgggctgcaggttttctaagggccaggtccgagtcatcgtgcctctaaccgtgcccagcacaggactggcacacaggaacaactgggaaatgccccagtgcttatgactgtgatgatgatggtgatgataggaatgacaatgatggtggcgctgctgctgatggtggtggtggtgactgagatggtgctggtggtgactgagatggtggtgatggtggtgactgagatggtggtgctggtggtgactgagatggtggtgatggtggtgactgagatggtgatggtggtgattgagatgatggtggtggtggtggtgattgagatggtggtgattgagatgatggtggtgatggtggtgattgagatggtggtgattgagatgatggtggtgatggtggtgattgagatggtggtgatgattgagatggtggtgatgattgagatggtggtgatggtggtggtggtgattgggatgatggtactggtggtgattgagatggtggtgattgagatgatggtggtggtggtggtgattgagatgctggtggtggtgattgagatgatggtggtgatggtggtgattgagatggtgatggtggtgattgagatgatggtggtggtggtggtgattgagatggtggtgatgattgagatggtggtgatggtggtgattgagatggtggtgatgattgagatggtggtgatggtggtggtggtgattgggatgatggtactggtggtgattgagatggtgatggtgatgactgaggtgatgataattgagatggtgatgatgatgattaagaaggtgctgattgaaatggtggtggtggtgactgagatggtggtggtggtggtggtggtgatgattgagatgatgatggtggtgattgagatggtgatgctgctggtgacggagcggagcctcacagagtgagctcagagcagccagtgctggccagggcttcaacagaccccgcagaccccctaaacgagaggcagtgtggtccaatggttacatgcacagactctgggctcaggctgcgtggatttgaatctctgctctacccaagctgtgtggccttgggaaagttcttaacccctttgtgcctccgtttcctcctctgtaaaatggtggtgctgatagttctgatttcatcaggctcttgagaagactaaacgagtttctacaaatcacctagaatagtccccggagtgcagtgaatgttttattcgtattgctgttgttattatgaatgatttttgacaaagaggactgtgggaaacacgtggaagctgccagagactgaacttc

SEQ ID NO: 468305 - DNA, 536 bp, Homo sapiens
cctagcacctccctggaggccatgcaccttcctggctgcatcaggtggccatggaacagaagctcagggacagaggttttgcaacaacaattggatgtgctttttgggaaaaaacaattcaaatcacaggacagtggcagaggaggggtcagatataaactcacccccggttctgaagatctgaggacccctaaagaacatttcaccccactccctcccatcactgaccccatcctcctgggcatggccagcctgggggattttctccttctgcctggaactgacactacccaggactcagaggacggctaccgtgaaatgggaacgagtagagccgtccgaggtacactgttgtgggaagtcagcgcaaaggggaagagtacctttgtgtaaaaggagtaaaatcagaatgtgcgtctcccctcgcttatattttcagaaagaaaatctggaaggatgcgcaagaaactaaaaatggttccccgagggtgggtggaggtgggatgggagagagcctcttcattctacacatgttc

SEQ ID NO: 468306 - DNA, 2125 bp, Homo sapiens
gtgactcaggagtcttcatcatgacaagggcagcttgagctgtgcctaatgctttactaggctgccatcttgagatttagcaacaatggcctgcatgaaggaagccccggcggcgttgccaaatccggttgtggtcatcatctgcagtacaggattgatgacgggaggctgctatagaactggcctccctagtgtccacggagaagagaggatcccaaaacggcagagaccatgtagcactcttaaccctcagaggcaagatgatgccattaccaaaatgtgcaatgagggtggaaaggcttgccaagccggagtgtttggccgtaatgaaaacaatccactgaatgatgaaaatggaacagtcaggaacatgcctgagcaggtcctaatgagacttggaaggaacgagattggaagatcagaaaaaaatggcctgggaaagagtgatgggaatgagcaaatgggagtgagcacattgtcttacgtcaacaccaccgctggccccctgaaattatcaactgcagatgaagcactgaagaaccagatagaaaaggaagccaatcactaaatccagcccacactcaaggggaggggaattaaacttcaccatctacggggtggatatctacatatatttttgggattcttctataaggaagatttgtcccttctccccccatttatttatttattcaatcatttatttatatgtggactgacgtatatgtatttatatgtggacttatgtatatttatttatatgtgagctgatggatatttatttatatgtggactgatgtatatttatttatatgtggactgatgtatatttatttatatgtggactgatgtatatttatttatatgcggactgatgtatatttatttatatgtggactgatgtatattatatgtggactgacgtatatttatttatgtgtgaactgatgtatatttatttatatgcaggctgatgtatattcatttatatgtggactgatgtatatttatttatacgtggactgatgtatatttatttaatacgttgggctatggtccagcactacattatttattttgctgctcaagtggttcttaggctgctgggagcctttgcagttggttcccatgagcctttgacataaccccgtcactgtgggttgttctggttttgttgtgttttgagtgcttccttgcttccaacactgaaagatgctccaggctgatcttgtatattccctgccccagacctagaatcagccatttctccaaggatccccagttcctttcactggagaatggcatttcaaaaccaagatctgtataaattaatttaaaacatgaaaatatgctcaacctcacttacaataacagaaatatcaataaagctagaatgatactgttattcactaatagatcaacaaagaaccaagatttgataggacgttctgttggaaaagccaggaggtaaataggacctctcactctacgctgctctaggtagatacggcacagcctcaatggaaagcatttggcaacagctgtcaaaattgatatgcacatatgctttgatttagcaactccacttctaccgacctgcttgctgcctatgaaataatgggtaaaagaaagggtttttattgcaatgttgtttataaatttcaaagaactataaacaacataaatatatatcaatagagaacctgacatttagattatggttcatcaaattcaatggaatacaatgcatttgtaaaaacaaatgaggaagctcttcacatactgatgccaaatgatctctaagacatttttctaaggacaagctaaaacacacttcagagctgaaggagtaaggtttgtctaggaaaagcaatatatgcatatttacacacatacataatatatatttctatattcatatatacacattttactttgtgtgcataaactttacctggatggactctcagctaatgaataatagtaattgcctatgggtggctggctgggggacaggagtagaaaaaatagttttccttgtagactttttatgcgttttgaatattgaaacttttgaatgtattacctaccctttcatcaaaaaacaaattaacactatgcctct

SEQ ID NO: 468307 - DNA, 956 bp, Homo sapiens
tgttttccctcggcaacacaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtacatgcctgactccttcctgaatggctgggagggacaaaactaaggcagaggaagaggctaaaacggaacagtagaccctcttcctcatctttagtttccaacaaagacacttgtttgtaatctctgggtctgattaactgctggggaagttgcggaggagaggtgctaaaaggggtggagagtacattggatggcaccttttactcctatggatagacaaaagaggagcaacttggttgactaggctgtggggctttgaccccacttatttaatcccctcagtggcagctccaataaatcctgaccagatccagagattggggaccactttacatttctaaattaatgttttacaataatcctc

SEQ ID NO: 468308 - DNA, 529 bp, Homo sapiens
atgctcagaacgaggcctggaagaaccctctggctgcaggatggagacagtgctggagggggcagggcaaggccggatatggacttgggctactggaggagaaaagccattttggagcaaacaaactggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagccttgagtctgtcacactctcggg

SEQ ID NO: 468309 - DNA, 613 bp, Homo sapiens
agtggttgctgcccaggctggtgcagcagctccaaggggtcggtgagatgaagcagccaccctccaaggcggcctcagccatcctgacacctccaatgcggaggtgtggggtgcagatacagcgctctggccccaaggaggcgatgtttccccagggatcggctggcggaggctttgcaatgatgaagttggcctgtggtgggagcctcctccgtctgtggccacccttctttgatacaaataggcaggagaagaagggtgtcccagctccagcagagagacagcaagagcaaattcaccctttgtctgcctttctgttctacgtgggccctcagctgattgggcccacactgggagaggctccacttgatcttgaccggaggagttccagccacggcagggatgccgagcagtctcctgaccagcaggtggtgctgtggcgcagcggcagagagcaccgcgggccggtcctgttgaatgtctctggggctgcctcatgacaacttctgctctgctggcagccctcacccacccggcccaggcagcgcatctggatgggaaatgtgccccttgctctccctctctttctccttgtcccttcccagaacatgga

SEQ ID NO: 468310 - DNA, 681 bp, Homo sapiens
tgagtttctttattcttttctttcctatgatattgtggcaggaaccactgtggtaaaaagaaatggggtcagatgatgcccccaaagccctgatttccacacgctataatgacaagactaaattatgtatcaaggccatcagaagcagcacagtgaaaagaacaggaggctttggtaataataatccagcaggaaaggctgtgtattgggttaatcaagtgtctgacaaaagacctatttgcacagtaactgttcagggaaaagattttgaaggactagtagatactggagctgatgtctctattattgctataaatcaatggccccagcactggcctaagcaaaaggcatccactggtattgttggagtaggagctgcctcagaagtttttcagagttccttgattttaccatgtcaaaggacgaatggtcaggaagggacaatccaacctatcattacacctattcctatcaatttatggggtagagacttattgcaacaatgggatgctgaaatacctattcctatggatcagtatagtaatcatagcagacaaatgatgaaaaacatgggatatcacctgggaaaaggactaggacaatataaaaatggccaatcagaacctttagaattaaaagggcaaacagatcagaccgaattggggtgtcatttttaggagc

SEQ ID NO: 468311 - DNA, 1628 bp, Homo sapiens
aacaaagaaacattgaagatttaagagcccaactgggtggattcttggttttcattgtggctgagattttcacgctggctgcaatggcctatgaccgctatgtggctatttggagccctctgctctacgccgtagtggtgtctccaaaggtgtgtcgtctgctggtgtccctcacataccttcagagtcttatcacagcactgactgtctcttcctgtgtgttctctgtgtcatactgttcttccaacattatcaaccatttttactgtgatgatgtccctttgctagcattgtcctgttctgatacctacattccagaaacagcagtctttatcttttcagggaccaacttgcttttctccatgatcgttgttctgatatcctacttcaacattgttattaccattttgaggatacgttcctcagaaggacgacaaaaagccttttccacctgtgcttctcacatgatagctgtggttgtgttctatgggactctccttttcatgtatttgcaaccaaggagtaatcattcattagatactgacaaaatggcttcggtcttctacaccctggtgataccagtgctgaaccctctaatctacagcctcaggaacaagaacgtgaaggatgcactaaagaggttcctagataacccatgccgatcactcaaactaatgtaaatgtaaagctaaaactatcttcctttagtgcttttcgttttttcctgaaaactgctgtgttttaaaaaaaagtgtcaagaaatttttagaaattccattcatttcagtgggaaatgtttaattgttcttatgtcaacctcacatacgcaaacaagaaaacaatatctataattaataaaaataatttgaaaataatcacagtttatagataacttatagataaaatgtaagccactaaagggtttttaaaataatttccaaacaaggaaaagaatgcctgatagtgcgtgtggagacaatgtgaacttttatcttatttaacaaagacatcttatattatttccctgatcttaacagtttgacctgtttgatctgttagccaaacttttataaacttttatttagttttttcttttacactattaatcctttaactaactattctactaccctaattgttagtcaaacacagttacatttatatttccaagttaccatgaagctgttgtagcttctaacaagtgttctgatctatctttgggtaatggatagctatgactgctgcacaagttagaggttgcagaatactaagaatggaaagttgaaagtcctgtggagggttaattatgatacactcagaagtgaacagaggcattgactggggtggaagattcaggggatatgaagtgttcagaactttgaattaaaaaaaaaaatctttgtatcaatctagaggtaagagacttaaagatgaagattaatgataaagaaaaagaatgaaaaaatatttacagagctcacctaaatatatcctgaatattctcttctgctaccaaataatatggagtaattgagatgagattttaacttcccatttaaacaagaaaaagaaaatgaaagacaaaatatatgaaacagtagctttcatgacacagatgtcagacaact

SEQ ID NO: 468312 - DNA, 1359 bp, Homo sapiens
aatctctacagtcctgcagcagccaacgcctggctccacatgcccatgtactttttcctgagccacttatccttcgtggatctgtgcttctcttccaatgtgactccaaagatgctggagattttcctttcagagaagaaaagcatttcctatcctgcctgtcttgtgcagtgttacctttttatcgccttggtccatgttgagatctacatcctggctgtgatggcctttgaccggtacatggccatctgcaaccctctgctttatggcagcagaatgtccaagagtgtgtgctccttcctcatcacggtgccttatgtgtatggagcgctcactggcctgatggagaccatgtggacctacaacctagccttctgtggccccaatgaaattaatcacttctactgtgcggacccaccactgattaagctggcttgttctgacacctacaacaaggagtttttgtccattctagatctgtgtttctccacaaatttcactcccaaaatgctagaaaatttcttatcagagaagaagaccatttcctatgcaggttgtttgatgcagtgctatgttgtcattgctgtggtccttgcagagcactgcatgttggcagtcatggcatatgaccgctatatggccatctgtaatccattgctctacagtagcaaaatgtcccaaggtgtttgtgtccacctggtcattgtcccttatgtctatggctttcttctcagtgtgatggaaaccttaaggacctacaacctctccttctgtggaacaaatgaaatcaaccatttctactgtgctgatcctcctcttatcaaactggcatgctctgacacgtacagcaaggagctgtccatgtacatagtagccggctacagcaacgtccagtctcttctaatcattctcacatcctacatgttcatccttgtcgctatcctcagaagccattctgcagagggaaggaaaaaagctttttccacatgtggttcccacctgacagttgtcacaatcttctatggaaccctcttctgcatgcatttgagacgtcccacagacgagtccgtggagcaggggaaaatggtggctgtgttttacaccacagtgatactcatgctgaactccatgatctatggcctcaggaacaaggatgtgaaagaggcgttgaaaaaagcaataggaaaacaaacattgggaaaataaaaatgctaagctatcattaaaaatttgtgaagtaatgagatataatatcattgggttagatgtcacattttaggctacatttgcacaattcatttctaattttctgttaggtagctgactgagttaagcttcctgaaactagcgggttgaaac

SEQ ID NO: 468313 - DNA, 1390 bp, Homo sapiens
ttgccctggaccctgagacaagatgctgcatcttggaaaaatgctcaatttcaccgatgtgacagagttcattcttttggggctaacgagccgtcgagaatggcaagttctcttcttcatcatctttcttgtggtctacatcatcaccatggtgggcaatatcggcatgatggtgttaatcaaggtcagtcctcagcttaacaaccccatgtactttttcctcagtcacttgtcatttgttgatgtgtggttttcttccaatgtcacccctaaaatgttggaaaacctgttttcagataaaaaaacaattacttatgctggttgtttagtacagtgtttcttcttcattgctcttgtccatgtggaaatttttattcttgctgcgatggcctttgatagatacatggcaattgggaatcctctgctttatggcagtaaaatgtcaagggttgtctgtattcgactgattactttcccttacatttatggttttctgacgagtctggcagcaacattatggacttacggcttgtacttctgtggaaaaattgagatcaaccatttctactgtgcagatccacctctcatcaaaatggcctgtgccgggacctttgtaaaagaatatacaatgatcatacttgccggcattaacttcacatattccctgactgtaattatcatctcttacttattcatcctcattgccattctgcgaatgcgctcagcagaaggaaggcagaaggccttttccacatgtgggtcccatctgacagctgtcattatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaaacaaaataaaatcaaatttgatttaattttatcttctattatttgtttggaaaaagtttattacccagtacctaggaacattaagataaagatattctgtgggttgaaaagaaaaataaaagtggtacaaattgagaaaatataaggaggaatgattcatttctgttgatggtctgttcagagactgctactttgaaaatagcaatactattgtatttcatgatttttaaatttttggtgtttcttaagaaacacaacatgacaaaaactattaactttcataatattgtttaaatatatgtatgaatggagttggggatatagggtcagttggcatgattggtccagtaatttatgccttcactggttttcttcatgaaaaattcctgaagtgttaatagaaatgaattttgggttttatttgtc

SEQ ID NO: 468314 - DNA, 1254 bp, Homo sapiens
ttctcttttttgtggtgttcctagcggtttacatgatcactctgttgggaaatattggtatgatcattttgattagcatcagtcctcagcttcagagtcccatgtactttttcctgagtcatctgtcttttgcggacgtgtgcttctcctccaacgttacccccaaaatgctggaaaacttattatcagagacaaaaaccatttcctatgtgggatgcttggtgcagtgctactttttcattgccgttgtccacgtggaggtctatatcctggctgtgatggcctttgacaggtacatggccggctgcaaccctctgctttatggcagtaaaatgtctaggactgtgtgtgttcggctcatctctgtgccttatgtctatggattctctgtcagcctaatatgcacactatggacttatggcttatacttctgtggaaactttgaaatcaatcacttctattgtgcagatccccctctcatccagattgcctgtgggagagtgcacatcaaagaaatcacaatgattgttattgctggaattaacttcacatattccctctcggtggtcctcatctcctacactctcattgtagtagctgtgctacgcatgcgctctgccgatggcaggaggaaggcgttctccacctgtgggtcccacttgacggctgtttctatgttttatgggacccccatcttcatgtatctcaggagacccactgaggaatccgtagagcagggcaaaatggtggctgtgttttacaccacagtaattcctatgttgaatcccatgatctacagtctgagaaataaggatgtaaaagaagcagtcaacaaagcaatcaccaagacatatgtgaggcagtaaaactgtagtggatattgttgtccctattataaatagggtcctgttataaatggtcacatgtaaaagtcctagctcagaaaacagtatcaaaagaaatataaaacttgctatccaactgtatgtcagagttctaatctctccttattatcctgatatacatttgtgggggtttgggcttttttgttttaacaacttaaacagcataaatttattatttcagaattgccatgggttatgagtgcaggagattattcttaactttacatataactttcttctgatctattgtcaaaacttagtaacaaatgtatacttctgttcataacagtctctgaggatcttttgcatttctgtgggattggttatatgcacacaacctagaaaattt

SEQ ID NO: 468315 - DNA, 1112 bp, Homo sapiens
cagcgtccaggaaatatgaggtcacacaagtgaattgaaggatggtaaatgccgatgattttattgccagtggaggtgtctctcagtgggaaggggagctgagaagaggatggggaggaattgagaaaatgctcaatttcaccgatgtgacagagttcattcttttggggctaacgagccgtcgggaatggcaagttctcttcttcatcgtttttcttgtggtctacattatcaccgtggtgggcaatatcggcatgatgttgttaatcaagataaaaaaaaaaacaatttcttatgctggctgtttagcacagtgtttcttcttcattgctcttgtccatgtggaaatttttattcttgctgcgattgcctttgatagatacacagtgattggaaatcctttgctttatggcagcaaaatgtcaagggatgtctgtattcgactgattactttcccttacatttatggttttctgacgagtctgacagcaacattatggacttatggcttgtacttctgtggaaaaattgagatcaaccatttctactgtgcagatccacctctcatcaaaatggcctgtgccgggacctttgtaaaagaatatacaatgctcatacttgccggcatcaacttcacatattccctgactgtaattatcatctcttacttattcatcctcattgccattctgcgaatgcgctcagcagaaggaaggcagaaggccttttccacatgtgggtcccatctgacagctgtcatcatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaaacaaaataaaatcaagtttgaattaattttgtcttctattatttgattggagaaaggttattgcccagtacttaggaacattaagataaagatattctgtgggttgaagaaaaataaaagtgatgcaaatggagaaaatataaggtagaatgtttcacttctgttcat

SEQ ID NO: 468316 - DNA, 948 bp, Homo sapiens
agcctttgtggatttgtgctatacatcaaatgcaaccccgcagatgtcgactaatatcgtatctgagaagaccatttcctttgctggttgctttacacagtgctacattttcattgcccttctactcactgagttttacatgctggcagcaatggcctatgaccgctatgtggccatatatgaccctctgcgctacagtgtgaaaacgtccaggagagtttgcatctgcttggccacatttccctatgtctatggcttctcagatggactcttccaggccatcctgaccttccgcctgaccttctgtagatccaatgtcatcaaccacttctactgtgctgacccgccgctcattaagctttcttgttctgatacttatgtcaaagagcatgccatgttcatatctgctggcttcaacctctccagctccctcaccatcgtcttggtgtcctatgccttcattcttgctgccatcctccggatcaaatcagcagagggaaggcacaaggcattctccacctgtggttcccatatgatggctgtcaccctgttttatgggactctcttttgcatgtatataagaccaccaacagataagactgttgaggaatctaaaataatagctgtcttttacacctttgtgagtccggtacttaatccattgatctacagtctgaggaataaagatgtgaagcaggccttgaagaatgtcctgagatgaaatattgtcatgaccatggtgatgcctttgtttcctaataaacattaaatcgaaatctttggctcacatgtcctagcgttctgatggcaccatggctccaacatcctcatctatgggatatcttgctgacttttgtaggtagaagtaagcattttctgcattgtgtccataatctactttttaattagaaattttacttaatttcacactatattcatttctgtggt

SEQ ID NO: 468317 - DNA, 999 bp, Homo sapiens
ttgcattgggagatatacctaatgctagatgacgagttagtgggactgacagacgacccagtgctagagaagatcctgtttggggtgttcctggcgatctacctaatcacactggcaggcaacctgtgcatgatcctgctgatcaggaccaattcccaactgcaaacacccatgtatttcttccttggtcacctctcctttgtagacatttgctattcttccaatgttactccaaatatgctgcacaatttcctctcagaacagaagaccatctcctacgctggatgcttcacacagtgtcttctcttcatcgccctagtgatcactgagttttacttccttgcttcaatggcattggatcgctatgtagccatttgcagccctttacattacagttccaggatgtccaagaacatttgcatctctctggtcactgtgccttacatgtatggcttccttaatgggctctctcagacactgctgacctttcacttatccttctgtggctcccttgaaatcaatcatttctactgcgctgatcctcctcttatcatgctggcctgctctgacacccgtgtcaaaaagatggcaatgtttgtagttgcaggctttactctctcaagctctctcttcatcattcttctgtcctatcttttcatttttgcagcgatcttcaggatccgttctgctgaaggcaggcacaaagccttttctacgtgtgcttcccacctgacaatagtcactttgttttatggaaccctcttctgcatgtacgtaaggcctccatcagagaagtctgtagaggagtccaaaataattgcagtcttttatacttttttgagcccaatgctgaacccattgatctatagcctacggaacagagataaagcaagtggaggaatgcaccctctttaagtttttttaatggtcttttatctacgtacagactaaaagaaaaatgcccatgtgaaaattccgtaacccatgggtgaggtgggg

SEQ ID NO: 468318 - DNA, 862 bp, Homo sapiens
ggtctaagcacagaccaccctgatgcttcgtctgtccttctgtggacccaatgacatcaaccacttttactgtgcggacccacccctcttagtcctcgcctgctcagatacttatgtcaaagagaccgccatgttggtggtggctggttccaacctcatttgctctctcaccgtcatcctcatttcctacactttcatcttcactgccattctgcgtatccacactgctgaggggaggcgcaaggccttctccacctgcgggtctcatgtgaccgctgtcactgtcttctatgggacactgttctgcatgtacctgaggcccccttctgagacatctatacaacaggggaaaattgtagctgttttttatatctttgtgagtccgatgttaaacccattgatctacagcctgaggaataaagacgttaaaagaagtataaggaaagttattcaaaagaaactgtttgctaagtaaggtagatattttggtcataggtgttggaatctgttcttattatctgaccaattaatgaacatttaaaattaacaaatcaatctgtcattgagtgttttttgtcctttgtaatttgcatatgggacttaaaagtgtgttgtcagactttaaatgttttctaatctgatgggtaaacaatgaattctcatttggtgtttaaggttgaattgttattacaagtgaaactaagtatttttaagtatattgatgctaatctcatatttctctttcacttatatgtccatatactttgttaacttttcaggtagggtgatttgtctttatttcatacatttataatagttccttatgtaccaaatgctacatacaaatcttttggtgttatat

SEQ ID NO: 468319 - DNA, 1422 bp, Homo sapiens
aggaaaaaagttgatagccagaagcagctggcattgtcttgtcccaccatttgaatattttcagtgacagggaatttactacatccatcaaaaaactaaatccaggcacacatacacttgaagcaatggataaagaaaacagctcaatggtgactgagtttatcttcatgggcatcacccaggaccctcagatggagatcatcttcttcgtggtcttcctcatagtttacctggttaatgtagtggggaatattggtatgattatcctgattacaacagacactcagcttcacacacccatgtattttttcctctgcaacctctcctttgttgacctgggctactcctcagccattgcccccaggatgctggctgacttcctaacaaatcacaaagttatctccttctccagctgtgccacccagtttgctttttttgtaggttttgtggatgctgagtgctatgtcctggcagccatggcctatggtcgttttgtggccatttgtcgacccctccactatagcaccttcatgtccaagcaggtctgcttggctctcatgctgggctcttacctggctggtctagtgagtttagtagcccacactaccctcaccttcagcctgagttactgtggttccaatatcatcaatcatttcttctgcgaaatcccaccactcttggccctctcttgctcagacacctacatcagtgagatcttgctcttcagtctgtgtggcttcattgaattcagcaccatcctcatcatcttcatctcctatacctttatccttgttgcaatcatcagaatgcgttcagctgaaggccgccttaaggctttctccacctgcgggtctcaccttactggcatcaccctcttctatggcacagtcatgtttatgtacctgaggccaacatccagctactccctggaccaagacaagtgggcctctgtgttctacacggttatcatccccatgttaaatcccttgatctacagtttgcggaacaaggatgtgaaagctgctttcaaaaagctaattggaaaaaaatctcaataataacacaaaatgaaaatctgtttctgtcataggtaaatgacagtagtagaagggcatagaaaatgcaaataacttttcgataaacactacccaagttaccatctccttgctaagtgaatattaaattctgaagggtgggctctaatccttaactctgcaatctgaaagaaatataaactaaattagtatatttgaaagacatactgggcaaaatacattcatttcttatttaaagttggttcacatattaattagaaactgggacaggactcagtaagagaaagaaatagtcaataactctgaacaattttttttcccctggggtcatgaggaatgccaggtccaaatgttgaaatttttttta

SEQ ID NO: 468320 - DNA, 1152 bp, Homo sapiens
aaccgtgggcgagctctgggtgtgcgggcggcctggcgcggcgctccgctgtgtcagcgtgttatgatgccgtcccataccaacctggctactggaatccccagtagctacatcagcaaaggcggggcagaccgggccgttccagtcctgatcattggcattctggtattcctacccgtattttaccacctgcgcatcccttactatgcatccaaaggctaccccatgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttttcactggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataaatcaagatt

SEQ ID NO: 468321 - DNA, 715 bp, Homo sapiens
tgcaggtccttggtattctgagcgtggtatccataagccatgcagaggagcaatcacacagtgactgagttcatcctgctgggcttcaccacagatccagggatgcaactgggcctctttgtggtgttcctgggtgtgtactgtctgactgtggtaggaagtagcaccctcatcgtgttgatctgtaatgactcccacctacacacacccatgtattttgtcattggaaatctgtcatttctggatctctggtattcttctgtctacaccccaaagatcctagtgacctgcatctctgaagacaaaagcatctcctttgctggctgcctgtgtcagttcttctctgccaggctggcctatagtgagtgctacctactggctgccatggcttatgaccactacgtggccatctccaagcccctgctttatgctcagaccatgccaaggagattgtgcatctgtttggttttatattcctatactgggggttttgtcaatgcaataatattaaccagcaacacattcacattggatttttgtggtgacaatgtcattgatgactttttctgtgatgtcccacccctcgtgaagctggcatgcagtgtgagagctaccaggctgtgctgcacttccttctggcctccaatgtcatctcccctactgtgctcatccttgcctcttacctctccatcatcaccaccatcctgaggatcca

SEQ ID NO: 468322 - DNA, 1464 bp, Homo sapiens
agtgttaggagataaggttctttaggctttcacctccgtggacatggaagtgggaaattgcaccatcctgactgaattcatcttgttgggtttctcagcagattcccagtggcagccgattctatttggagtgtttctgatgctctatttgataaccttgtcaggaaacatgaccttggttatcttaatccgaactgattcccacttgcatacacctatgtactttttcattggcaatctgtcttttttggatttctggtatacctctgtgtatacccccaaaatcctggccagttgtgtctcagaagataagcgcatttccttggctggatgtggggctcagctgtttttttcctgtgttgtagcctacactgaatgctatctcctggcagccatggcatatgaccgccatgcagcaatttgtaacccattgctttattcaggtaccatgtccaccgccctctgtactgggcttgttgctggctcctacataggaggatttttgaatgccatagcccatactgccaatacattccgcctgcatttttgtggtaaaaatatcattgaccactttttctgtgatgcaccaccattggtaaaaatgtcctgtacaaacaccagggtctacgaaaaagtcctgcttggtgtggtgggcttcacagtactctccagcattcttgctatcctgatttcctatgtcaacatcctcctggctatcctgagaatccactcagcttcaggaagacacaaggcattctccacctgtgcttcccacctcatctcagtcatgctcttctatggatcattgttgtttatgtattcaaggcctagttccacctactccctagagagggacaaagtagctgctctgttctacaccgtgatcaacccactgctcaaccctctcatctatagcctgagaaacaaagatatcaaagaggccttcaggaaagcaacacagactatacaaccacaaacatgaaggttattctctttgcaaatgctgttattgaattttccagattattggcttataaatgtgttcatttgcatttctgtagttcaattaagttcaataagtcatatttaaaacattaaaatattgaccacatgactccttgttattcgtttgttatgatgtaaacaaaacaaagtaatatttaaaacttataatattgggttgtttggcattctgcaatatggtattttgccttggcagcattaaatctttcatagatttcattgtgtttgctccctttgggagatcttggggaacaaaataaattacgtgggttaatgaatatagtttgactttgaagtttggtaagcaatctttactaggtgacaagaatatctgaaagggtgaggcttctggaaatatgctcaagattttacaaatatttattttaagaaaatcatttcctcaaaatttcttcagaaagctctaattgagcatatagggag

SEQ ID NO: 468323 - DNA, 1081 bp, Homo sapiens
cctggatatttcagttgagggtgctgaattcatttgccgctttccttccgctctacttttggtagtcatgggtcgaggaaacagcactgaagtgactgaattccatcttctgggatttggtgtccaacacgaatttcagcatgtccttttcattgtacttcttcttatctatgtgacctccctgataggaaatattggaatgatcttactcatcaagaccgattccagacttcaaacacccatgtacttttttccacaacatttggcttttgttgatatctgttatacttctgctatcactcccaagatgctccaaagcttcacagaagaaaataatttgataacatttcggggctgtgtgatacaattcttagtttatgcaacatttgcaaccagtgactgttacctcctagctattatggcaatggattgttatgttgccatctgtaagccccttcgctatcccatgatcatgtcccaaacagtctacatccaactcgtagctggctcatatattataggctcaataaatgcctctgtacatacaggttttacattttcactgtccttctgcaagtctaataaaatcaatcactttttctgtgatggtctcccaattcttgccctttcatgctccaacattgacatcaacatcattctagatgttgtctttgtgggatttgacttgatgttcactgagttggtcatcatcttttcctacatctacattatggtcaccatcctgaagatgtcttctactgctgggaggaaaaaatccttctccacatgtgcctcccacctgacagcagtaaccattttctatgggacactctcttacatgtacttacagcctcagtctaataattctcaggagaatatgaaagtagcctctatattttatggcactgttattcccatgttgaatcctttaatctatagcttgagaaataaggaaggaaaataagctttaaaagtgataggaaaaaagttttgttaagttagacacagttgttaaaattcaacacaacaaagcatccagcacagctaatctgccaaaatttaaagtttctaaaatagggag

SEQ ID NO: 468324 - DNA, 655 bp, Homo sapiens
atccttagtttaaagttttacaatatgtcaatggccttcttctctgtgctccaactgaggaaatctctcaggagggcaatggcaaggctaaaagagcattgtaacactggggctgcaggcacccacccctggacactaccatggggctggagaccaaagcacacattctggctcctgcaactgctcatctccatgctcaccctcctggcattgcagaagagtaatgtgtggtcagagtccccacacagagtttctactggagcaccacctagtggagctgtgggaagagggccaccatcctccagaccccagaaaggtagatccactgacagcttgagctgtgcacctggaaaacccacagacactcaaggggatgtgaaaatgactgtgtgcagtatggattctaaggtagacccatatctgagaaacacaggactcctttgtcagcccattttggctcaaggatttctcatagcaattgcacatctggtacagtgactgagattggtgcttccatttggctaaggttgtggtagtcaattttctgccagtatctgtttggattttgtaggtcctggactggttgaactttattggtgtatgaaaatgctactaatttttgtatattgattttgtaacttaaaactttactaac

SEQ ID NO: 468325 - DNA, 600 bp, Homo sapiens
cagtacccagcatggttttaaggcttgagagaaagtatacaatcgtctcagaggggtgcaaacataaagtttccatcatgcttttgccatatcaatgcatggcaattgatgcatggagttgtcatacatattggcttcaggtcaacccaggaagttcacctgatcctgtggtgctcagggtttttatcagggctcgattgcatactgctcctgtaattgatggccagtataaccacaggggcccttataaacagaagaaagaggcagaagtgtggagtgagggtcttgaagatgctgtgatgctggctttgaagataggaaaggggctacagccaaggaatgccactgacttctacaaaccgaaacaggggaagaaaatggatcatttcctagagcctccagaaaggaacacagctctgctggtaacttgatttgagacctattttggacatctgatttccagaaccataatatgttaaatttgtgttgttttaagccatttatttttgttgtgatttgttatagcagcaatagaaaacagatacaccctattggtgacatatcatataatgatacatgtaggtttgaaataaaaggaag

SEQ ID NO: 468326 - DNA, 1520 bp, Homo sapiens
aagattctaagatggcccttgtggtagatagaatagtgggcccccaaaatatccattttctaatcctcaaaacccaggaaaatgtcgtcttaagggacatgagatgggaagattatcctagattgtgcaggttagttcacgttaatcgaaaggcaggctatctaggtgggccttacctaatcagcaagaaaatgggaacctcaattctacacccacaaggagctgaattctgccaacaacttgaacacgttcggaagatgattaagcccaagctccagcttggttttccaggcctttctgagggccccctgataaccaactgcatgtccccatattgggaaagaggtctcttcatatggaaccattaaacccaattcaaattcattcagtgtttctgtagcactctatacttcctctttcgcagtacttatcagacttgcaaatactgactcaacttctattttttccaatacactgaaaccacaacaaagctccaagaatctgcgattgttatgtaattcttaaagaaatgaataaaaccctttgcaaatacaacgcactttcagccccagctctatgctgttatgaacaggagctcaggggatattcattttggtgcaataaaagtcaacaacgaacaaagggcaaggcatctgaaatgccttgctaatcactttctcctccaactatctttgagatatgagcttgtcctatgaattaattcatggagcgatttgcttaacttgattcggctcctttcaggcctctagcccactttccttccttttgtggatgaggcccacttttccctcctccattttctgaatttccttcctatcttcttgctttccctaccttcctgaccagggtgtgtgtggacagacaggcaaagctcttcactgcccattggagcctggaagcgcaacacactaacattattttgaaaaattccaaggtcctctggatccttgggtgcctgtgctgggggtatggggaaggcagggaggcctgtgtttgtaaaaaaactattttattttaagcctgaattcctaggggttgcttctattttcttcatagtttaggagtcagctgatgtttggtcacaggttgtgatcaaacaccttgtattagtttttctattgctgacatgtaccacaagcttagtgtctaaacaaaataaacttactattttagtcctctttgggaatcattgggctaaaatcatggcattggcaaggctgtattcctcctcctcctccttgttctcctcctcctcctccttctcctcctcctcctccttctcctcctcctccttccttttcctcctcctccttcctattcctcctcctccttcctcttcctcctcctccttcttcttcttcttttcttctccttttccttcttcttctccttctccttctcttccctctccctccccctccccctccccctccccctcctcctcctcctcctcctcctccttctccttctccttcttcttcttcttcttgtcgtgctcc

SEQ ID NO: 468327 - DNA, 1055 bp, Homo sapiens
ttctctacagaatgtggatttttcccagaagagactttgtagggcaatttcaaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgagatacctaggcct

SEQ ID NO: 468328 - DNA, 624 bp, Homo sapiens
gcgcggcagggcgcatatatgcccccctttctgggaaaagacggggaggggggcttctcctgggagactccaggcttcgaaattcctcgttccctatcctccggcccccgcacccctcctcctccccgccacgcaccctctcccctccccagccatctgttccactccgcagcgccgcgacaaacacggctccagctcgcttccgcccctgcccagccccctccccaagccccggggagtgggggagtgagcagacgcccttctcctaggaggccggaatttctgcctccatctcccaccggggtccggctggccagaggcaagcttcgagaccccccaccaaccaccaccaccgttgcgagggccgccagccgcagccacgcagcgccgcctgccgggcacaccaaggacctggcgcgcacgtggcgcttacccccacccccgggtccgctcctggctcgcgctcagcctccccagactattcgcaaattgaggatcccggacacagagtgcagagaccccggcaagcctactgaaagccagccgaacccgctggtgggtgctagccaattctgattttgtactttacaaaaacaaaaaaagtcagtgttggaagtcgggagt

SEQ ID NO: 468329 - DNA, 632 bp, Homo sapiens
tcgataaccactctatcagatgtttaggtatctttccagacttaagtatgccctgacaggagatgaagtaaagatttgcatgcagccgttcattaagatcgatggcaaggtcagaactgatataacctaccctgctggattcatggatgtcatcagcattggcaagacaggagggaatttctgtctgatctatgacaccaagggttgctttgctgtacatcatattacacctgaggaggccaagtacaagtggtgcaaagtgagaaaaatctttgtggacaccaaaggaatccctcatctggggactcatgatgctcgcaccatctgctaccctgatcccctcatcaaggtgaatgataccattcagattgatttggagactggcaagattactgatttcatcaagttcaacactggtaacctgtgtatggtgactggaggtgctaacctgtgtatgaagaattggtgtgatcaccaacagagagaggcaccctggatcttttgacgtggttcatgtgaaagatgccagtggcaacagatttgccactcgacctttcaacatttttgttattgcttagcctcacaatggtcctggcaagcagataggagtttccgccgaccacccaaggcca

SEQ ID NO: 468330 - DNA, 644 bp, Homo sapiens
tgagataagctgggtacctcagttggaaatgcagaaatcacccgccttctgcgctgatgttgctgggagctgcagaccagagctaaaattatattggctctaccttgaaaagtctgacttcccaccctttgcaagacaccgtcatatcttgcttggaccattgcaattgctcttaactggtgtcctgcttcgttattgtgggcagagcagccagagtggttctgttaacacacaagtaaaagtcagaccctcacgatggccctcaaagccctgctctattcagttggccactaccccgttcctctcttctatctttgtctcttttcctactcttctcatgcttctcactctgtgttacctacacctgcttcctcattccactgaggacatgccagccccagcaacaaataggaaggtggaaggaccacctgactcaggactgggattcccccagaggaaccggctcctcttggacacagttcctcagtttatagccctctttgcactgtgtatgctgaggggaaagccacatgtacacaattactaagcattttagttcatcttcaaagatgttcatggactgttcactgactgctctttgtctttacctttggagtctgtttcctattgctgttgagtgcatc

SEQ ID NO: 468331 - DNA, 647 bp, Homo sapiens
gctccagggagggggcaccagtgcttatagagtattttgtttgctgtcattctaagaggccaaggtttcaacgccagtgctccagagctgttattatgagaaagctctatgcctgcagatctgtgatgtgctgccagatgaacgacacatgtgagatccaacctccggatggagatccttccacattttctcaggggttcccactctggcatctctgccttcatgactcttcctcttctgatgtctccagttcaccagagttgtgctcagatattctgtccaaatgtgcggcctcaccctggcagccccacagccaaagtcctcagagcagagctccttggagaagccattctcaagctcccaacatctctttccatcaagcagacattttcactcagtgtgattatcacatcccatggttaaatctaattcacacattactaaacactcgcaacttaccagacatcagtgatctctggtacatgccagctcacagatcacttcttagccatggggctgagagccgctcatgaatgtgacaaaggcaaaagggatgatgttagctgtttattcatgctctcaccagagaagaaatctctgttcaaattgttcccataattccaggaatctgaagggatcttaatttt

SEQ ID NO: 468332 - DNA, 613 bp, Homo sapiens
ttatctgctcactgttttggttcttcgtagtggaggagtcactgttatgggcaacctgggaatgatcactctgatccatgcagacccacagctccacacccccatgtatttcttcctgagcgtcctatccttgatagactcctcgttttccacagtggacatccccaggctgctggagagcttcctcatctcaagccaatccatctcctttgcaggctgtatggtccagatggccctcatgatcctccatggtactgctgagtgtctgctcctggccatcatggcctatgaccgattcaccgccatctgccaccctctcctctatcacactattatatcccaatgtctgtgtgccctgctggtggtgacctgctatactgtttctgttgccaattcagctttgctgactgggtgcatctttaagctgccctactgtggccccaatgtcattaaccactatttctgtgacatcccccctgtgctccaacttgccggtgcagatactacgaggttgagaccattatcttctcattgtgtgccttgctcatcctctttaccatcaccattatcccagtctcctatgcctacatcctcgtgaccatttgcaggatgc

SEQ ID NO: 468333 - DNA, 568 bp, Homo sapiens
gaggcacagcggggataggggggttaggatctccttgaggagatggacacaggaaatgctgatgggcataaggaggagccaagggatttgttaccaggagcgaacacacagactgatcatctcccagttgttgcttctctcctcctttcctccctctctgacagcgctttgtggtgggaggctaaagggaattacacagtatccagtccggcgggctctcagctgagatgtgacggtacagcagtgcctgaggcaggattggagtcccgaacatgggaagaccaagaacatgcttggggcaccagcaaacataagcccaaagaagccaatttatatggaagtgagagtaggtgggagagagcccaaggaggccgaaagagcatggcttttgcaattaaacagcttcttgtggtttgctggcagttttgggtgtttcttggcttatagaagcatcacctggatctctgccttcatcttaacatgatcttgtccctgtatgcatgtttatgtctgtctttgtgttcaaacttcccctttttataaggacactagtaatattggattagtg

SEQ ID NO: 468334 - DNA, 629 bp, Homo sapiens
cagggctggagaacatgaccactgcccacctgtctgccttcaaacttcctgatctaactgccacttaccaagcctacctggcagccaaagccctgtgggttgcctatcagaacttgatgtcctgctctgagagagagggaccattcctgggaggcacgtatgccaatgcatgggaagccaggctttctcaggtgagtggccaagaagcctttcccagtccctgtccattccagctttctgtgagctttagactagcagagaggcagtgtggtgtgacgctgctgctaataatggtgatgacatcaaaactgccaagggccttagaaatctgctggtccagcacgaagcagggagatcaccaaaaaggggaggcagagctggaagagaacacagctgtcctgccatccaggtcactacatgccaatgctgatatgcaacaaaaaccatatgagattcacagtaggaaagagttaaccacaaagttagaaaactggtaaatctgcaatgtaaaacatccaatccagcacagacacccattcttcatgggctgctcagggataaggacaggaagggaagggaggtggtgttttcctcgtagtcagagagggtacatgtgcacattgtgcagg

SEQ ID NO: 468335 - DNA, 783 bp, Homo sapiens
agctcactagcaatggatccgaacaaagaagaaatccctgatttacctgaaaaagaattcagaggagctggactggggatgcaagtatgccaaggcacagcagccatactgcagcaggaccacggtgaggtgggaggagcaggtggagaaggcctggtggcggccctcagcagaacggatgctcaggatggcacaggtgatgaacacgtaggagacgcagatgagcaagaaggggacggtcagcacgaggatgctcacgacatagaggacagcctggtgaacacggatggcagcgcaggccaggcgcaggacgggaggtacatcgcagaggaagtggttaatttcctggcggtagccgcagaagggcaagcggtcataggccacgatcgccaagaggaaacagtcagcaccaccaagtgtgagaaagaagaacatttgggccccacatccagccaatggaatgggcttctgggccccaaaaatgttggaaagcatcaagggcaccacaacggtggtgtagcagatctctacaaaggacaggttggacaagaagaaatacattggggttcggagaacgctgctatagactagagggttaagcatggggatgaccatggtgtagaacacagatgagattttgtctgtgtccatggaatgaccagaacttggctgtttagaatttctatgtgtttcctttttatcattactttttgttatattcttattttgttcctgtatcatttccctgattttcttttatcatctgtgttctaattcacttag

SEQ ID NO: 468336 - DNA, 996 bp, Homo sapiens
tccctgacactgtcatactcaggcctctgttagccctttgcttcatggaaacctgtctatgcacatccatgtactatttcctgggcagcctttctgggattgaaatatgctacactgcagtggtggtgccccatatcctggccaacaccctacagtcagagaagaccatcactctcctgggctgtgccacccagatggctttcttcattgcactgggcagtgctgattgcttcctcttggctgccatggcctatgaccgctatgtggccatttgccacccgttgcagtaccctctcctcatgacattgactctttgtgtccacttggttgtggcatcagtcatcagtggtctgttcctgtccttacaactggtggccttcatcttctctctgccattctgccaggctcagggcattgagcacttcttttgtgatgtgccaccagtcatgcatgttgtttgtgctcagagtcacattcatgagcagtcagtgctggtggcagccatactagccattgctgtgcctttcttcctcatcaccacctcctacaccttcatagtggctgctctgctcaagatccactcggctgctggccgccaccgggccttctccacctgctcttcccacctcactgtggtgctgctgcagtatggctgctgtgccttcatgtacctgtgccccagctccagctacaaccccaagcaagatcggttcatctcactggtgtacacattgggaaccccactgctcaacccacttatctatgccctgaggaacagtgagatgaaaggggccgtagggagagttcttaccaggaactgcctttcccagaacagctaggaaagacgaggggacagcctatcaggcaagtatttggttccagcccaccaaatctgtatgaaactgagatttctatcatttggtgttaaaactcatctaaaagatggtataaattatatggatactgtttatgtgtgccaaagatttttaaatattt

SEQ ID NO: 468337 - DNA, 1262 bp, Homo sapiens
agaaatggtttgaataagccaagaagagctcagcgcgtcctattcttttgcataagacatgcctgtggggaaacttgtcttcaaccagtctgagcccactgagtttgtgttccgtgcgttcaccacagccactgaattccaggttcttctcttccttctcttcctcctcctctacttgatgatcctctgtggcaacacagccatcatctgggtggtgtgcacacacagcaccctccgcaccccgatgtatttcttcctgtccaacctgtctttcctggaactctgctacaccaccgtggtagtacccttgatgctttccaacattttgggggcccagaagcccatttcgttggctggatgtggggcccaaatgttcttctttgtcaccctcggcagcacggactgtttcctcttggcgatcatggcctatgaccgctatgtggctatctgccacccgctgcactacaccctcatcatgacccgcgagctgtgcacgcagatgctgggtggggccctgggcctggccctcttcccctccctgcagctcaccgccttaatcttcaccctgcccttttgcggccaccaccaggaaatcaaccacttcctctgcgatgtgcctcccgtcctgcgcctggcctgcgctgacatccgcgtgcaccaggctgtcctctatgtcgtgagcatcctcgtgctgaccatccccttcctgctcatctgcgtctcctacgtgttcatcacctgtgccatcctgagcatccgttctgccgagggccgccgccgggccttctccacctgctccttccacctcaccgtggtcctgctgcagtatggctgctgcagcctcgtgtacctgcgtcctcggtccagcacctcagaggatgaggacagccaaatcgcgttggtctacacctttgtcacccccttactcaaccctttgctttacagccttaggaacaaggatgtcaaaggtgctctgaggagtgccattatccgtaaagcagcctctgacgccaactgaaggcttaggggcactgggctgggtgtctgtctgttgctgtgtcaaagaactctaaatgacacagaactgtagtactttctcacactgtgcacttgatgtttcttttttgccatatttgccccaagttcacaattcatgctcatttttctgaagtgctttgactaagatatgaaaatttggacagaacttacagcgtaggaatgctagtttacttagctctactttaaggatttgcagctcacct

SEQ ID NO: 468338 - DNA, 1231 bp, Homo sapiens
tgccaacttttttttaaaattccacatataaatcggcagaaatatgcatcaaggaaaccaaaccaccatcactgaattcattctcctgggatttttcaagcaggatgagcatcaaaacctcctctttgtgcttttcttgggtatgtacctggtcactgtgattgggaacgggctcatcattgtggctatcagcttggatacgtaccttcatacccccatgtatctcttccttgccaatctatcctttgctgatatttcctccatttccaactcagtccccaaaatgctggtgaatattcaaaccaagagtcaatccatctcttatgagagctgcatcacacagatgtacttttctattgtgtttgtcgtcattgacaatttgctcttggggaccatggcctatgaccactttgtggcgatctgccaccctctgaattatacaattctcatgcggcccaggttcggcattttgctcacagtcatctcatggttcctcagtaatattattgctctgacacacacccttctgctcattcaattgctcttctgtaaccacaacactctcccacacttcttctgtgacttggcccctctgctcaaactgtcctgttcagatacattgatcaatgagcttgtgttgtttattgtgggtttatcagttatcatcttcccctttacactcagcttcttttcctatgtctgcatcatcagagctgtcctgagagtatcttccacacagggaaagtggaaagccttctccacttgtggctctcacctgacagttgtattactgttctacggaaccattgtaggcgtgtactttttcccctcctccactcaccctgaggacactgataagattggtgctgtcctattcactgtggtgacacccatgataaaccccttcatctacagcttgaggaataaggatatgaaaggtgccctgagaaagctcatcaatagaaaaatttcttccctttgatgccctggacctctacattcttttagtccacataatcagataaatgattcagcccagagcgtatggcacagttgtgatggttcaacttttgatgaacttgcaggtatctgtctcctattccaacctctgaaggggttggagcttttccacttagctcttgtcttggaaacaaaacctgtaactgccatgaagttcacagttgatgtgcagatataatatgtgaacagaaagcaagagcttgtaggtacc

SEQ ID NO: 468339 - DNA, 950 bp, Homo sapiens
atgatcctcctgatccgtggcgatcgtcggctccacaccccgatgtacttcttcctcagccacctttccttggtggacatctgctactcgtccgccatcatccctcagatgctggctgtgctgtgggagcacggcacaaccatctcccaggctcgctgtgcagctcagttcttcctcttcaccttctttgcctccatcgactgctaccttctggccatcatggcctatgaccgctacacggccgtgtgccagcccctgctttatgtcaccatcataaccgagaaggcccgctggggcctagtcactggggcttacgttgctggttttttcagtgcctttgttcgaacggtcacagccttcactctctccttttgtggaaacaatgagatcaacttcattttctgtgacctccctcctctattaaaactctcctgtggggacagctacactcaggaagtggtgattattgtgtttgctcttttcgtcatgcctgcctgtatcttggtgatcttggtatcctacctgtttatcattgtggccatcctgcagatccactctgctggaggccgggccaagaccttctccacctgcgcctcccacctcactgccgtcgctcttttctttggcaccctcatcttcatgtacctgcgagacaacacaggccagtcctccgagggagaccgagtggtgtctgtgctctacacggtggtgaccccaatgctgaatccccttatctatagcctgagaaacaaggaggaatggatttaggattttctgcatctactgagctgataatctagttttgtttttgtttattaatatgatggatagcattttctgatttttgaatgttaaaccattcttgtaatttgggggataaactacacttggttacagtatattattcttttcattatcacaaatgtaatatgaatcattttatctcatga

SEQ ID NO: 468340 - DNA, 1489 bp, Homo sapiens
gtgagatgggtttcagggaccactggtgtcatggcagagatgaacctcaccttggtgaccgagttcctccttattgcattcactgaatatcctgaatgggcactccctctcttcctcttgtttttatttatgtatctcatcaccgtattggggaacttagagatgattattctgatcctcatggatcaccagctccacgctccaatgtatttccttctgagtcacctcgctttcatggacgtctgctactcatctatcactgtcccccagatgctggcagtgctgctggagcatggggcagctttatcttacacacgctgtgctgctcagttctttctgttcaccttctttggttccatcgactgctacctcttggccctcatggcctatgaccgctacttggctgtgtgccagcccctgctttatgtcaccatcctgacacagcaggcccgcttgagtcttgtggctggggcttacgttgctggtctcatcagtgccttggtgcggacagtctcagccttcactctctccttctgtggaaccagtgagattgactttattttctgtgacctccctcctctgttaaagttgacctgtggggagagctacactcaagaagtgctgattattatgtttgccatttttgtcatccctgcttccatggtggtgatcttggtgtcctacctgtttatcatcgtggccatcatggggatccctgctggaagccaggccaagaccttctccacctgcacctcccacctcactgctgtgtcactcttctttggtaccctcatcttcatgtacttgagaggtaactcagatcagtcttcggagaagaatcgggtagtgtctgtgctttacacagaggtcatccccatgttgaatcccctcatctacagcctgaggaacaaggaagtgaaggaggccctgagaaaaattctcaatagagccaagttgtcctaaccatctccaaacttggaaaatcccgagaaccacctactctgtagtgtcagaattctggacgctcattatttatagcatgctcaatgtttaaatgaatatattatggtactaggtataaaaaagaaccagaacttttagctccagggagaggaaggaagacaaggaaaagtcaacctgaaaagagattggagtgggagttttgattcccaggacaagtgacaaaaggatttgaaattaaagcctgtgcaatccaaatatggcacacttcacctgtctgtgattataagagtaattttttttgcaaaatttttaatgaaagattttcatcatatagaaatgttaaaaataatatgtaggaagtttcctatactcagtactgagattgtgtaattgctaatatttgctgtctttacttggttacatagatgtaatctatccgtgagtttattcatcaatcaattcactcatcaaaccacctttttttgattcatttcaagcaaagctgaccctactcaaggtatgcctt

SEQ ID NO: 468341 - DNA, 942 bp, Homo sapiens
gtgtggtgggtatatgagtaaccgaattcattctcatgggctttatggaccaccccaaattggagattcccctctttctggtgtttctgagtttctacctagtcacccttcttgggaatgtggggatgattatgttaatccaagtagatgtcaaactctacaccccaatgtacttcttcctgagccacctctccctgctggatgcctgttacacctcagtcatcacccctcagatcctagccacattggccacaggcaaaacggtcatctcctacggccactgtgctgcccagttctttttattcaccatctgtgcaggcacagagtgctttctgctggcagtgatggcctatgatcgctatgctgccattcgcaacccactgctctataccgtggccatgaatcccaggctctgctggagcctggtggtaggagcctatgtctgtggggtgtcaggagccatcctgcgtaccacttgcaccttcaccctctccttctgtaaggacaatcaaataaacttcttcttctgtgacctcccacccctgctgaagcttgcctgcagtgacacagcaaacatcgagattgtcatcatcttctttggcaattttgtgattttggccaatgcctccgtcatcctgatttcctatctgctcatcatcaagaccattttgaaagtgaagtcttcaggtggcagggccaagactttctccacatgtgcctctcacatcactgctgtggcccttttctttggagcccttatcttcatgtatctgcaaagtggctcaggcaaatctctggaggaagacaaagtcgtgtctgtcttctatacagtggtcatccccatgctgaaccctctgatctacagcttaagaaacaaagatgtaaaagacgccttcagaaaggtcgctaggagactccaggtgtccctgagcatgtagatct

SEQ ID NO: 468342 - DNA, 1314 bp, Homo sapiens
acaaatgatatggtcttctgctcccagaagaagtcacgagtgagctctcatgagatctgatggttttataaggggctcttcccgcttcgctgtctcactctctctctcctactgccatgtgaaggaggtccttgcttccccttcaccttccaccatgactgaaatacccactcttacaataacaaacaaaatctagctgaccacaggattcttaaagaagaaagtaaagactttatgcaggaagcaggcctatggctgtaggaaggaacaacacaattgtgacaaaattcattctcctgggactttcagaccatcctcaaatgaagattttccttttcatgttatttctggggctctacctcctgacgttggcctggaacttaagcctcattgccctcattaagatggactctcacctgcacatgcccatgtacttcttcctcagtaacctgtccttcctggacatctgctatgtgtcctccaccgcccctaagatgctgtctgacatcatcacagagcagaaaaccatttcctttgttggctgtgccactcagtactttgtcttctgtgggatggggctgactgaatgctttctcctggcagctatggcctatgaccggtatgctgcaatctgcaaccccttgctttacacagtcctcatatcccatacactttgtttaaagatggtggttggcgcctatgtgggtggattccttagttctttcattgaaacatactctgtctatcagcatgatttctgtgggccctatatgatcaaccactttttctgtgacctccctccagtcctggctctgtcctgctctgataccttcaccagcgaggtggtgaccttcatagtcagtgttgtcgttggaatagtgtctgtgctagtggtcctcatctcttatggttacattgttgctgctgttgtgaagatcagctcagctacaggtaggacaaaggccttcagcacttgtgcctctcacctgactgctgtgaccctcttctatggttctggattcttcatgtacatgcgacccagttccagctactccctaaacagggacaaggtggtgtccatattctatgccttggtgatccccgtggtgaatcccatcatctacagttttaggaataaggagattaaaaatgccatgaggaaagccatggaaagggaccccgggatttctcacggtggaccattcatttttatgaccttgggctaatgtttacaatgaagctgtgagctaggtgaattgtgcagacatttacataattttaaactagttgatctatagaatgaattgtgggaat

SEQ ID NO: 468343 - DNA, 1741 bp, Homo sapiens
gaaccgtcttgaattttcttttctctgagcacctcttgcatgggtatggtggaggcagggtgtttcagtaaggatgatgttgtcatttgcctctgtgtttccagtaaaaggaaactggtattggagtcccaggaaacagcagtcggggaaaatataaaacatcaagtccaagagagtgagaaaaaagaaaagacaaactttctggtggaggacgcaagaagtatctcctactacatcaacacagatctctgtctttattccaaagtcaatgccaagttctctgctgagttccagagaatgaaaacacttcaagtgaaggacaaagctataactacccgagttcaggtaagaaacctcgtctacacagtcaaaatcaacccaactttagagctaagctcaggttttaggaaggagctccttgacatctctgactgtctagagaacaaccagagaaggatggccacctacctggcagaactcctggtcctcaactatggcacccacgtcatcaccagtgtcgacgctggggctgctcttattcaggaggaccacatcaaggcctccttcttccaagacagccagagcagtcgtagtgctgtgaccgcctctgctggacttgccttccaaaacaccgtgaacttcacatttgaggaaaaccatacctcggagaatgtcctcaccaagagctacctctcaaaccgaaccaactccagggtgcagagcattggaggggttcctttttacccaggcatcaccctccaggcctggcagcagggtatcaccaaccacctggtggccatcgaccgctctggcctgccgctgcatttcttcatcaaccccaacatgctacctgacttgccaggccccctggtgaagaaggtgtcaaagacagtggaaacagctgtgaaacgctattacacattcaataccaaccctggctgcacagatctcaattctccctacttcaattttcaggccaacactgatgatgtctcctgcgaagggaaaatgaccaacttctctttcgttggggtttatcagaaatgcagccagttctcagggaataaaaatgttgttctctgcccaaagttggagcagaagaatccactcactggtgatttctcctgcccctctggctgctcctcagtgcaccttctatccaagacttgcgaggagtgttgcaaccatctggagtgtcataagaagtgcaccctccttgtcttctgcaagaccgtgtgtgaagatgtgttccaggcggcaaagggtgaatttagggctttttggtgtgtggccagtagccaagtacctgacaactcaggactgcttttcaggggcctcttcaacagcaagagcataaaccccatgacaaatgcacagtcatgcccaactggctactttccatggagactctttgaaaacctcaagctgcacagttgggaacccctggtggttccagccacatccaaagatttaggggcaccttccctgaaaaagtgtccgagaggcttcagccagcacctagccctcatcagcaatggatgccaagtgtcctactgtgtcaaggctgggctctttacagaaaagttccttccccctgctagtctcccgcctttcacccagccaccccttatgagtgaggctgatgccaacactgtcatagtgaccagttctgagaatgcgagatcctagattaaagattcccagacccaccagtggaggctgggagaacaattagagctgc

SEQ ID NO: 468344 - DNA, 992 bp, Homo sapiens
tctcccatttggcctgtgcagaagacagatggatcttgcagaatgacagtgggttatcataagcttagccaagtggtgacgccaattgcagctgctgtaccagatgtggtttcattgcttgagcaaattaacacatctcctggtacctggtatgcagccattgacttggcaaatgcctttttctctattcttgtccataaggcccaccagaagcaatctgtcttcagctggcaaggccagcaatatacctttactgtcctactcaaggtaaaatttctgggggtccagtggtgtggagcccgtggagatattccttctaagatgaaggataagttgctgcacttggctactcctacaaccaagaaagaggtacaaagcctagtgggacgatttggattttggaggcaatacatttctcatttgggtgtgttactctggcccatttatcaagtgacccaaaaggttgccagttttgagtcgggtcccagacaagagaaggctctgcaacaggtccaggctgctgtacaagctgctctgccacttgggtcatatgacccagcagatctaatggtgcttgaggtgtcagtagcagatagggttgctgtttggaggctttggcaggcccccataggtgaatcacagcagaggcctctaggattttggagcaaggccctgccatcttctgcagatactattctcctttggagagagttcttggcctgttactgggctttcatgaaaactgaacgtttgactgagggttatcaagtcatcatggaacctgaactgcctgtcataaactgggtgctttctaacccaactagccataaagtgggtcatgcacagcagcattccatcatcaaatggaagtggtatatatgtgatcgcgcatgagcaggtcccaagggcacaggtatgttacatgaagaagtggctcaaatgcccgtggtctccactcctgtcaccccgccttctctccccaagcctgagcc

SEQ ID NO: 468345 - DNA, 1050 bp, Homo sapiens
tgccctcactttaacagtagacacctggccaggttgtgcatgcaccttttgttgcagcacccactggaatgtcagctccaccagggcagggccttctttgtcccatccactggacaggacctggctgtgagtatggtgggatctgcgcatgggcctgctggctgacagcctgcccttctccgtgctggtgaaaaagagggtgttcctggcctcgcccactgaggtggctaaggtctgcctgcagacacagatgcagcagttgcggcccttggcctcggggcctttgtctgtgcccctcgtgtgtcctgtgtctcctgtatgttcagtgtccaagtaccatgggctgctgcactgcctggccatggtggcccatgaggaggggctgcacagcctctacaagagcagctcagccctgcttttctgggacagccactcctttgccacctacttcttctcctatgctgccctctgtgggtggctcggccccactggccatagccagccagagattactgggcctgcggcaaggcccagccagcgtggccctggggagaacacatcacatctgctggtgctgcaggcgggggctgggggccagaggcagacctgtttctccccgagcactatcctggagcggcaagctgttctgcagctgtccctgtgtgctcagccaccctctaccttggatccccgctcccctacccattgctcttcatacaccgtaccctttcagacaaagttggctggtctcccttccaggctggggaccacagggcagcaaggccaagcttggtcagtaccacatctgtctgacaagaggacattaccagctggagtaggagtgctcttccggcagagcctacggcaccatggtggtgctggcagccggcctcacacctcatctccaaatacctgcggggccactgctcctgtccgtcctaatccagatgtgcccttgtctctcagggaaaaattctctcggaaacccctggactttagcaaaatgggggaggtatgggaggtgtgcagccctcctctgccctgaccagc

SEQ ID NO: 468346 - DNA, 1656 bp, Homo sapiens
acacagcaggatctccaggatctttactttagaatgacaagggacatcgcccccaggatcggatatcctaaacccgtcctgctgcattcttccttcttctctgacctgcagggcatccagaacaaaatgagtgccagtgaccccagctcttttatcttcctcaccaacatggccatgcagatcaagaccaagatcagtaagcatgcattttctggagagagagacaccatcgaggagcacaggcactttgggggcaactgtgttgtggacgtgtctttcatgtacttgaccttcctcaaggatgaagacaagctcgagcagatgaggaaggatgacaccagcagagacatgctcactggtgacctcaagaagatgctcatagaggttctccagcccgtgattacagagcaccaagcccagtgcaaggaggtcatggacgagttagtgaaagagttcactaacgaatgagttcagtcgtgctcattttatatatgcttataaagagacgtgatttatcaataatcccagcccaatcaaagtaccgctacctgtagtcttccgtcacatgatcattactgggcttggtttctctaagcctgtgtatgttatcaatactgtttattcctctgagtttcattatttctgtctcttgagggcaaaacattgtgggtgattggtgctgacattgcatggtcagatagagaagtccagctgtgaatctctcccccaaagcagccccaaggcatggagcctttggctggaagtccatgggccaacctgttctgtccatagaagactcctagggctcccagtatactcttaaaacccactctattttaaaatatatattctatgtatgcatatatggaagtgaaatatcattattgtaacctaaaaagtgctttgaaatgttgatgtggggaagtttattgagcgcaagatgtatttcagcccatgactcaccacgaaaaaaattgataggtaaaagctttgctacacatttgactaagaaatcagccagctttaaagctgcttttaatcataaagagtgaacagagttgggcagtttttattaaattgagtcttgggggtgaaactttccggtttacttaactccagaccatgcatgtattctactccggaaatcatgctcatttcccttgactagtgttttcccgccaatggatcctagaccctccatcctgcagagtcagcggtgtcttttcccctgactgtgtcagatgctgagcagtcattacctctgcaaatgtttcattttgacaattgaccgcaatggaagtcagtacagagcaatgcactggctgtgtccgggatgggtggacgtagctaggaagaaagtcacacaagcagccctagaggccctcactggtgtctggacaggctgcatttaatcacatgccatgttcaggcttggaagagaaattccaaatttcaggggagcccctggtcgatatatctgggtctctcctcttgagcgctctgccttcctgccgccccttggagtaaataaacttctttggctcccgcacgaggtgctgtgctctgtctgggaggtctgaggagggaacaaagtcccctcccttcccctcttcatggatggccttgagtctgctggggtcaaaatctggggaaaac

SEQ ID NO: 468347 - DNA, 583 bp, Homo sapiens
gctgtgagggctgccagcacactgtcacctctcagtaagtcacgcttaactgagtactggctgtttggctttgtgctcatgtggccccaggccctgaagggctttgcatattattggggctctgatggtgataaaaatgaatgtgtaggatatcaagataaccaggagagctataaagatattgaagctcacaacataaataagaacaagctcgctaatatgtctatcagagcaagagagaaccatgactgctggaatatcacagaaaaagtgatggacttcattggacttacagaaagagagactaaatgtgtccccagtgtggatggaggcattcaggaaaccacagagagacaagttactgagaaaaaagtacatgggattgtggagacaggaatcccagaatatcaatacaataattcccaggtttccaaccagagtgataatatagatgaaggggaacgttataaagaggggaacctgcagttctgagtcattgttatttggaagagtgtgataataattgacgtttcctctttttaaaaatgtttggtaaatttcaccagagaagttatctggttcc

SEQ ID NO: 468348 - DNA, 1428 bp, Homo sapiens
gtcatcttaagtttctcagataatactgatggagaattgtacggaagtgacaaagttcattcttctaggactaaccagtgtcccagaactacagatccccctctttatcttgttcaccttcatctacctcctcactctgtgtgggaacctggggatgatgttgctgatcctgatggactcttgtctccacacccccatgtactttttcctcagtaacctgtctctggtggactttggatactcctcagctgtcactcccaaggtcatggctgggttccttagaggagacaaggtcatctcctacaatgcatgtgctgttcagatgttcttctttgtagccttggccacggtggaaaattacttgttggcctcaatggcctatgaccgctatgcagcagtgtgcaaacccctacactacaccaccaccatgacggccagtgtaggtgcctgtctggccctaggctcatatgtctgtggcttcctaaatgcctcattccacattgggggcatattcagtctctctttctgtaaatccaatctggtacatcactttttctgtgatgttccagcagtcatggctctgtcttgctctgataaacacactagtgaggtgattctggtttttatgtcaagctttaatatcttttttgttcttctagttatctttatctcctacttgttcatattcatcaccatcttgaagatgcattcagctaagggacaccaaaaagcattgtccacctgtgcctctcacttcactgcagtctccgtcttctatgggacagtaatcttcatctacttgcagcccagctccagccactccatggacacagacaaaatggcatctgtgttctatgctatgatcatccccatgctgaaccctgtggtctacagcctgaggaacagagaagtccagaatgcattcaagaaagtgttgagaaggcaaaaatttctataagtttggaattttaacattgttgtatacacaaaaatgttgtttccctcatctcagactttcctcatgcaatgagttacatttgaaaccccacaatacatttaagttcatgaggtgatattcttacctctttagaagtcaattttttaataaaaataaaatattatcagaaatgtaatacctgaatgaggaaggctaaatggaaatgttagaatttttggaacttgctggtcaaaacttactaatgacattcggtttactcacttgttccccttgcattttttctaccacattccagtgcaaacatacttgttaaacagggacaccaacaagcccacaaaaaagtacatgtttatgcctcttgtgggcacataggcattagaaggagaaatttactcagaagtaaatggagtgtggctagtttttatataaaggattgtacacatatattgaaatatcattctttacccctt

SEQ ID NO: 468349 - DNA, 1865 bp, Homo sapiens
cagtcacggtgtttggagtgtgtcccaggtcctgctggagcagtccacttctttcagaggggcagctacataattcccaatggagaacaacacagaggtgactgaattcatccttgtggggttaactgatgacccagaactgcagatcccactcttcatagtcttccttttcatctacctcatcactctggttgggaacctggggatgattgaattgattctactggactcctgtctccacacccccatgtacttcttcctcagtaacctctccctggtggactttggttattcctcagctgtcactcccaaggtgatggtggggtttctcacaggagacaaattcatattatataatgcttgtgccacacaattcttcttctttgtagcctttatcactgcagaaagtttcctcctggcatcaatggcctatgaccgctatgcagcattgtgtaaacccctgcattacaccaccaccatgacaacaaatgtatgtgcttgcctggccataggctcctacatctgtggtttcctgaatgcatccattcatactgggaacactttcaggctctccttctgtagatccaatgtagttgaacactttttctgtgatgctcctcctctcttgactctctcatgttcagacaactacatcagtgagatggttattttttttgtggtgggattcaatgacctcttttctatcctggtaatcttgatctcctacttatttatatttatcaccatcatgaagatgcgctcacctgaaggacgccagaaggccttttctacttgtgcttcccaccttactgcagtttccatcttttatgggacaggaatctttatgtacttacgacctaactccagccatttcatgggcacagacaaaatggcatctgtgttctatgccatagtcattcccatgttgaatccactggtctacagcctgaggaacaaagaggttaagagtgcctttaaaaagactgtagggaaggcaaaggcctctataggattcatattttaattataaagaattcacaataagataattttttccacctcatattaatctttgtctaccaagcccaatatttgggcttcctcatggacagtttctattgactgttttcttaaacatatgaattggccatactttcttcattctttaagtgacactttttttgttgttaaaatctggacattttaaataataaaaaatagcatattctaaaaatcagatctctcctcccatctaggctttgtttttgttggtggtacttttgtttgtttagtgattttcctgagttacttatgttaattctgcatttcttgttgtgtgtggccactgaaatttctactcagttaggaatatactgtatatttatttatagaaaacataaaaggaaaatgtgtaacaataatataaagtattagagtgcataattggcagtataagtttgcaacatccttaaactactcgtaaaatggcacagtattacaaagaagcatattttcatgaattctaaacatatattgtaaactctagggcaataactaaaacaatttttaagagaggtatttaataataagttaatagtggagatgaaacggaatcataaagatcgttaataatttaaaaaggaaaagaagacaaaagaaacaaagaaaagatggaaaaaatagaaaaaaaactaggaaaatttataataacctagtattatgaattggtatttaataagaaagcctgagaactgagccaaatatgctcctctttcatggcttttctttttattttctttcccagcgaattgagttggaattcctctactgaacatagctgataaaacatcatggccagtgcataa

SEQ ID NO: 468350 - DNA, 730 bp, Homo sapiens
ccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcatcgcattgtttcatctttacttgcaaggcctcagggagaggtgtgcttctcgggttggtggtatgtcccctaggagaacagtgaggcagaaaaggcagaagcctttggtatggggggaagaaatggtaaactacaagagaaatttcctgtgaagaaacagctacagatcctggggggcttcagatgtaaaat

SEQ ID NO: 468351 - DNA, 807 bp, Homo sapiens
tcagaaatctacaccacctcttgtatccatgcaagccgaggctcctatttctcataccacctcttccatgcagcccccagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctgtcggcaaagacatcgccccacaggagagctgttcgcaagcaccagccgaggtccgacacttcactgacaggcagcctgtcccgcgccaggcgttcagtccttgcaagcgtcgttcgtcccagcaacccaagcgtcacggggcccagacaagcaaggactcacccaaagacagggaagtggcagaaggaggccttccccgggcggagagcccctctccaggtgagccctcctgagagggaagcacagt

SEQ ID NO: 468352 - DNA, 1252 bp, Homo sapiens
catgagatttcagctcagaaaatgcaaaatgtctgacactgaaaatccatcttcgaatgaattggggagccagcagcagccagcatccaaggctggctctgaggagcaccgtccagtgcatctgtggttttccacactggcagggggaactcaggacacttgtgccctggccctaagaattatccttccattggcaccaacagctggtattcatcctccagttgcctcctcctcctccttctcttcactcagctggtattcatcctccagttgcctcctcctcctccttctcttcactcagctggtattcatcctccagttgcctcctcctcctcctcctcctccttctcctcctcctcactcagctggtattcatcctccagttgccacctcctcctcctcctccttctcctcctcctcctcctccttctcctcctcctcctcactcagctggtattcatcctccagttgccaccacctcttccttctcttcctcctcaatgcagtgaagtttacaccatgatgtgctgtggccctgctcaaatcttttgcctcctctccattggccctggggctgctgccttgacatgggtctttgttgctgtccctctccccagcgttctcccagctgcctccataattgtccacaattcccagcattcccagtgccttcaggacaaactgagactctccatgtggcacctaaggctctagtccctgccaatttctatttcctcttctccctctcccacctgaaaccctccttcatccagaattttcccagcctctgccaggaaacccttgttccctttctccttctggcaataccctggtctttctagttttggtttaaacaatgccctctttaggaagtcttccccagttgggtgacccttcctggggcttcccttttccttggtgcttatcaccctctactgcaatcagtgccagggacccagggcaccgaggcactggtgcctagagtgcaaggtacttttaggggctcatgaaaatgttttattttaaaattagatgaaaaaaatgtaagggtcaaagacaattttttttctcacatcaaaaaaataaatgcgtagggcccatgaaaatctactgaattatttaaatttttatttattttttaaatagaggaagatacctcatgaagacaaaagcacctaaggcctgagaaagtgagaatgtggccctgactcactgccattggtttccccttcccccagtggggttggggggt

SEQ ID NO: 468353 - DNA, 4393 bp, Homo sapiens
ggtaaacatgggttgtgacttgttacggagaaattgcccctgggcatttacgtgcacatgcatgcccacacgtcctcctgctgtggcccgaaagcatcctcggagcctgggctatgtcctccacacttgctgcctgaccagccccgtggggccggccccgctgggacaggttttcccgttaagcattaaccaccagcagataagggctctgagggaacgccctgacctgggatggctgctcctcgctatcacgggccagcagttccggccacaaggagagagttccccgtcaccagaggcagtgctgtccgagagctggacccgccttcgggtgtctgagaggaaggcctggtggctggccggccacaggaagtggtgggcgtcagcctgccagggagtggggcattgatgctgtgtgcgcgtgcgtgtgtgtgtgtgtgtgtgtgtgtgtgtgtgtgtgtgtgtgtgtgtgtctggagtcatggcagggtccctttctgtctgtctccttgctctgccccagactggggggctgcagaggtgagggtatctggcctcaacagctgcttattcccgatgggatggcctgggctgggcccctgaggccaggctgacttggacatggcaagaggggtcccaggctcttgtgggcaaagcaggggaggcgccaatgtggaggaacagagtctcctggctggctgctgctctctggagcgggtggagtcagggaagagctgagctggggagtcaccctgggcctggggtcaccgtaggccccatgtagcaccctggttcccctgcctgtaggtgacaggagccagcccagccaggtgtgctccctccccaggccctaggcaggcgggtacaggggccagcagctgcgcccgccccaccttccttcccacccacatgccgaagggtggccaggcaggcaggtggacgagtccaggcagcggctgagtcagtgtgtgtggaatgttctggccgctcccagctgcaccctgcccctacctgccaccacctcaccttcatcctcaggcgctgcggccctgagcccctgccaggaatgcacctttagcccaggcctgctcagtgagctccgccgacagccagccctgctcctcccgccatgaccctgcagacccctctgggcttccaagttcctgggggctgcagtgaacatgctccacctgcatggctggcaaaccatggtgggccccagctgtggtgcgtgctggggtagaggcaaggaagtgatgggaccgcagagatgagacccccagggatgagatgggacccccaggcagggcccagggtccagggcccaggagagagaagcagggagggagagagcttcctggtggaggacgcatcctacagtgggggcaagggtgctctgaggtccggtgaaggcagggactaggctgcccaggccctgcctgcttggctggggctgggggctgctgggaggtggctgggaggctgggcctgggcagctaagctggagctttggccagggtccagagcctccctcccttcagcttcctgctgcacagaaccctcgcccctggccaccccgtgctgcctccttgccctggcagacccagcactggctgctgctagtcagatggggtagcgggcaggggccggaggggccaccctcccagctgacccagcctcctgggccgcttcttccaaaccagcagggtagaaagatggggcacccaccagtctctcccagtgccccggccccagctggcaccacagctatacctgggcttattccagaccttgtcgccgggaccccctgtgagttgtgggattcccaagaggggtgtggggataacccagccaagtgggggctgcagctgtccacagatgcactcagcctggcctctaccccagggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgaggagcggctccttgctcactcagtccagagagggcttgaaatccaggctccagagcccagggcagcgaggcgagttcagccccagggatggtttaacccccacagaggcagggcgttgaggaccttcctggcagggaaagtgggtgaacagaggtgagaaggaggccatgcaacaggggctgccccatgggcccgagggagccacagcgggttcttgaggaaggcagggggtaccccagatgccacgttttgggtgggtttggccggtctcacagagcgaagccgacgatttgtgcctgttgggtggcctggcctggaggcggggggtcttgacccatgtcatgcaagggctgcccgggagcccagggctctgatgaggcatgatgtcagcaccacctgccccttgtcccaactcactccaggtgcaacctgatgtggatggcctggagtccagcccgggggatgctcagcaatgggggtgcctgcagctctccctggagttcgactttggaagccaggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacgtgagtcagggatggtcggctgggtgggcctggacggctggatgggcctgggctgggtgggcctgggcagctgggtgggcctgggcagctgggtgggcctgagctagggcagcagggcctggctcacgccgctgcctcagatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcaggtgaggtgctggtcaccaggccacagcccaaggcagagctggcagggaccctgccctatgggccatcggaaagacaggcctgatgggcagcattttcgggggtctgagccccaactcggccagaatcaccctcccgggctgaagcccctcttgctgcccacagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgccactgtgtgtccggctggagcctggaggggatgcagaaatagggcccgggcccgctcaccagggtcccctgacaaggacgggggaggggctcctctccagactcagccaggccctgaggcctctgaccggtccctgcttgaccctcgggtaggggtggggaacctccccggggagcacagatctcccctctccgggccgcctgggaagaccggggaggtgggggccagagagtcgggaccacatgggatggggcgggctagagccagccctgtagggacagagtgggcaatggtgtctgggggctggtggcgccattctccttaggttgaaggatgtgttccaagtcgcccggcaaggggactgcagcagggcgttctgggcaggcgggaggggcccagaggcacgtgcggcgtgcccctcactcctggtcctgctccccaggcaggaagatagcatcac

SEQ ID NO: 468354 - DNA, 1102 bp, Homo sapiens
ataactacaatttaataagacatcctgctctctgcatcttgtcctatcaccctgactctcctacactctggccctaacaaccagttacttacccggtctcaatccccgaggaatgtcagtccaatattcgctcagtcctcaattcatgctgctatccaacattactcagtttagccccatattctatctcaccagctttcctggattggaaggcatcaaacactggattttcatcccctttttctttatgtacatggttgccatctcaggcaattgtttcattctgatcattattaagaccaaccctcgtctgcacacacccatgtactatctactatccttgctggccctcactgacctggggctgtgtgtgtccacgttgcccaccactatggggatcttctggtttaactcccagagtatctactttggagcgtgtcaaatccagatgttctgcatccactctttttccttcatggagtcctcagtgctcctcatgatgtcctttgaccgctttgtggccatctgccaccctctgaggtattcggtcattatcactggccagcaagtggtcagagcaggcctaattgtcatcttccggggacctgtggccactatccctattgtcctcctcctgaaggcttttccctactgtggatctgtggtcctctcccactcattttgcctgcaccaggaagtgatacagctggcctgcacagataccaccttcaataatctgtatggactgatggtggtagttttcactgtgatgctggacctggtgctcatcgcactgtcctatggactcatcctgcacacagtagcaggcctggcctcccaagaggagcagcgccgtgcctttcagacatgcaccgctcatctctgtgctgtgctagtattctttgtgcccatgatggggctgtccctggtgcaccgttttgggaagcatgccccacctgctattcatcttcttatggccaatgtctacctttttgtgcctcccatgcttaacccaatcatatacagcattaagaccaaggagatccaccgtgccattatcaaactcctaggtcttaaaaaggccagtaaatgagtcctgggg

SEQ ID NO: 468355 - DNA, 1240 bp, Homo sapiens
ggtccggtcttgctttgttagaggttggagaggaaagagaaaggaaaaacagcgggcccctctgcgtgatgtatgctgtggcccttgggggaaatacagtgatcctgcaggctgtgcgagtggagcccagcctccatgagcccatgtactacttcctgtccatgttgtccttcagtgatgtggccatatccatggccacactgcccactgtactccgaaccttctgcctcaatgcccgcaacatcacttttgatgcctgtctaattcagatgtttcttattcacttcttctccatgatggaatcaggtattctgctggccatgagttttgaccgctatgtggccatttgtgaccccttgcgctatgcaactgtgctcaccactgaagtcattgctgcaatgggtttaggtgcagctgctcgaagcttcatcacccttttccctcttccctttcttattaagaggctgcctatctgcagatccaatgttctttctcactcctactgcctgcacccagacatgatgaggcttgcctgtgctgatatcagtatcaacagcatctatggactctttgttcttgtatccacctttggcatggacctgttttttatcttcctctcctatgtgctcattctgcgttctgtcatggccactgcttcccgtgaggaacgcctcaaagctctcaacacatgtgtgtcacatatcctggctgtacttgcattttatgtgccaatgattggggtctccacagtgcaccgctttgggaagcatgtcccatgctacatacatgtcctcatgtcaaatgtgtacctatttgtgcctcctgtgctcaaccctctcatttatagcgccaagacaaaggaaatccgccgagccattttccgcattcctcctctggacatcagatgtgcctgctccatcttcaccttccacagtgattttaagtttcctgaggccttcccagaagccgagcctatgccagcatcatgcttcccgtaagcctgcagaaccattatttctttacagcaatgtgaaaatgaattaatacagcatagtaccccaaaggaatattggcctgctagtttcatcaggaatatattgtatctctgccaggttttgttatcaggatgacactggcctcatagaatgacttttgtcagatgtatgctttgcagatattttcttctgtgctaaacaaatctacaagaaaataaaaaccattaaaaagtgggcaaaagaca

SEQ ID NO: 468356 - DNA, 541 bp, Homo sapiens
ctgcaaggatctatctgcaaaagtgttccgagggcgggggttgctagcaaaagagctatggcagcagccactggcaagcattttggcaggacagctgagactgcactgcaagctggtaaggccaggtggagaccctgggagaggctggcagactggggctcattcagatcagacttgccctgtcccgtgggcaagagagctctgctctctccaggtaggatcctgaaggtctgtggcaagagtgggtcactacatgcctatgtttctcatcccgtccctaccagcactcagggccagaaaggagtcctggtgctcgactaccccatacaggctttccagcttctgcctgtttcagcatcctcctgtatccactctggatgccttctttccgaagatctgttcagtgtgtgttggtctcttgatgatctggtctcttcatgggagaagctcctcctggctgtggctagttaaccatcatggctctctccccaatcaaagaaaatttgtacttctattttttaggctcgttaggccttcctct

SEQ ID NO: 468357 - DNA, 1013 bp, Homo sapiens
gagctaccctgaggagaaaccctgatggggggctttgggactaacatctcaagtactaccagcttcactctaacaggcttccctgagatgaagggtctggagcactggctggctgcccttctgctgctgctttgtgctatttccttcctgggcaacatcctcatcctctttatcataaaggaagagcagagcttgcaccagccaatgtactacttcctgtctcttttttctgttaatgacctgggtgtgtccttttctacattgcccactgtactggctgctgtgtgttttcatgccccagagacaacttttgatgcctgcctggcccagacgttcttcatccacttttcctcctggacagagtttggcatcctactggccatgagttttgaccactatgtggccatctgtaacccgctgcgctatgccacagtgctcactgatgtccgtgtggcccacaatggcatatccattgtcatccgcagcttctgcatggtattcccacttcccttcctcctgaagagactgcctttctgtaaggccagtgtggtactggcccattcctactgtctgcatgcagacctgattcggctgccctgtggagacactaccatcaacagcatgtatggcctgttcattgtcatctctgcctttggtgtagattcactgctcatcctcctctcctatgtgctcattctacattctgtgctggccattgcctccaggggtgagaggcttaagacactcaacacatgtgtgtcacatatctatgcagtgctgatcttctatgtgcctatggtgggaactgaacaatgagatcacatggacacaggaaggggaatatcacactctggggactatggtggggtgggtgggggggagggatagcattgggagatatacctaacgctagatgacgagttagtgggtgcagcgcaccagcatggcacatgtatacatatgtaactaacctgcacaacgtgcacatgtaccctaaaacttaaagtataatt

SEQ ID NO: 468358 - DNA, 858 bp, Homo sapiens
tcgatcggcttccctgcctgcttccttcagatgttcatcatgaacagtttcctccccatggagtcctgcacattcatggtcaaggactatgatcattatgtggccatctgccacccactgcagtacctgtccatcatcactcatcaatttgtggccaaagctagtgtcttcattgtggtgcagaatgctttgctgctttcacctgttcctattctctctgcccagctccattactgtaggaaaaatgtgattgagaactgcatctgtgccaacctgtctgtgtccaggctctcctgtgataatttcacccttaacagactctaccaatttgtggctggttggaccttcctgggctcggatttcatcctcatcttcctctcctacaccttcattctaagagctgtgcttagattcaaggtggagggggtggcagtgaaggccctgagcacatgtggctcccactttatcctcatcctcttcttcagcacctgctggttgtggtgttgacaaatgtggccagaaagaaggtccccatggacatcctgatcctgtttaatgtccttcatccctttagtcctcctgcattaaaccctatcatatgtggatttcaaactaaagagttaaagaaggaattttagaagttgctgcagaggggcctttgaaaacacggaagggactctccatagaagcacctattactgtttctatttcagaagctgtgattccagaaaataaactaatgcttaaatactgagtatttcctacccatttctctctctccagtatcaggaattagtgagggctccttagtacctgacataaattcatttgcctagctcatgtaactaacattcttag

SEQ ID NO: 468359 - DNA, 1041 bp, Homo sapiens
ctcatgattcagcctatggcgtcacccagcaacagctccactgtcccagtctctgaattcctcctcacctgcttccccaacttccagagttggcagcactggctctccctgcccctcagccttctcttcctcctggccatgggagctaacaccaccctcctgatcaccatccagctggaggcctctctgcaccagcccctgtactacctgctcagcctcctctccctgctggacatcgtgctctgcctcaccgtcatccccaaggtcctggccatcttctggtatgatcttaggtcgatcagcttccctgcctgcttcctccagatgttcatcatgaacagtttcctccccatggagtcctgcacgtttatggtcatggcctatgaccgttatgtggccatctgccacccactgcggtacccatccatcatcactaatcaatttgtggccaaagctagtgtcttcattgtggtgcggaatgcgcttcttactgcacccattcctatcctcacttccctgctccattactgtggggaaaatgtcattgagaactgcatctgtgccaacttgtctgtgtccaggctctcctgtgataatttcacccttaacagaatctaccaatttgtggctggttggaccttgctgggctcagatttattcctcatcttcctctcttacaccttcattctaagagctgtgcttagattcaaagcagagggggcggcagtgaaggccctgagcacatgtggctcccacttcatcctcattcttttcttcagcaccatactgctggttgtggtgttgacaaacgtggccagaaagaaggtccccatggacatcctgatcctgctgaacgtccttcatcaccttattcctcctgcgttgaaccctattgtgtatggggttcggaccaaagagataaaacagggaattcagaagttactgcagagagggaggtgaatatgtaaagcatttctaatacctcctgttcttcctcttcagtgattttacctaggcagcgaagtagagaaatgtcagtta

SEQ ID NO: 468360 - DNA, 1451 bp, Homo sapiens
ccctctccactgaagcttcagacttcctcttgaattgttttgtcagatcccccagctggcagcactggctgggccaacaccaccctcctgatgaccatctggctggaggcctctctgcaccagcccctgtactacctgctcagcctcctctccctgctggacatcgtgctctgcctcactgtcatccccaaggtcctgaccatcttctggtttgacctcaggcccatcagcttccctgcctgcttcctccagatgtacatcatgaattgtttcctagccatggagtcttgcacattcatggtcatggcctatgatcgttatgtagccatctgccacccactgagatatccatcaatcatcactgatcactttgtagtcaaggctgccatgtttattttgaccagaaatgtgcttatgactctgcccatccccatcctttcagcacaactccgttattgtggaagaaatgtcattgagaactgcatctgtgccaatatgtctgtttccagactctcctgcgatgatgtcaccatcaatcacctttaccaatttgctggaggctggactctgctaggatctgacctcatccttatcttcctctcctacaccttcattctgcgagctgtgctgagactcaaggcagagggtgccgtggcaaaggccctaagcacatgtggctcccacttcatgctcatcctcttcttcagcaccatccttctggtttttgtcctcacacatgtggctaagaagaaagtctcccctgatgtgccagtcttgctcaatgttctccaccatgtcattcctgcagcccttaaccccatcatttacggggtgagaacccaagaaattaagcagggaatgcagaggttgttgaagaaagggtgctaacaaggaccactggatctctgaatatctaaaataagataatttattaatcacttaatgaaaatattcttggccctctctcgttttattccatgcttataatcatattttgtccaaaacactgacattccttaaagcagattttaaagtgaaaaatgtatgtttctgaacacacaactcaatatgtcatgaattttgtatcattaaaaatacaactgcggttattttgttgtgtctgttatgtgtaatgtccttttattcttattttcagaaaagggaatacattggagaaaaaaacacagtagttgaaatttcagtcctcagtggtggaaagttgctactggtctacaagtaaatttttgtaatgtgcattgcaagagggcaagggttttgccttgattcctcatgagtaacaattatcaatgagttttactggatatatgagattcttgaatcctcctccccaatgtgtctgtgcttagaacatttatctttcagatccaatatatcacaggttttgatatgcaaacaaatctttattaatgagtcaaaagattgctggtatt

SEQ ID NO: 468361 - DNA, 1345 bp, Homo sapiens
cggctttgcatgtggcccaacacaaatttacaacccaaggcacttcctctgcctgaggtgctgaccttgcctctttccctgacagtaagaacgagtctgaaaaacaaattgagaatctgacttccaatcaataatctttctccatgaccacagttggggacttctgcccacacttatagctacaggaaactggacaagaataagtgagtttatcctcatgagcttctcttccctgcctactgaaatacagtcattactctttctgacatttctaaccatctacctggtcaccctgatgggaaactgcctcatcattctggttaccctagctgaccccatgctacacagccccatgtacttcttcctcagaaacttatctttcctggagattggcttcaacctagtcattgtgcccaaaatgctggggaccctgcttgcccaggacacaaccatctccttccttggctgtgccactcagatgtatttcttcttcttctttggagtggctgaatgcttcctcctggctaccatggcatatgaccgctatgtggccatctgcagtcccttgcactacccagtcatcatgaaccaaaggactcgtgccaaactggctgctacctcctggttcccaggctttcctgtagctactgtgcagaccacatggctcttcagttttccattctgtggcaccaacaaggtgaaccacttcttctgtgacagcccacctgtgctgaggctggtctgtgcagacacagcactctttgagatctacgccatcgtcggaaccattctggtggtcatgatcccctgcttgctgatcttgtgttcctatactcacattgctgctgccatcctcaagatcccatcagctaaagggaagaataaagccttttctacatgttcctcacacctccttgttgtctctcttttctatatatcattaagcctcacctacttccggcctaaatcaaataattcacctgagggcaagaagctgctatcattgtcctacactgttatgactcccatgttgaaccccattatctacagcctgagaaataacgaggtgaagaatgccctcagcaggacggtctctaaggccctagccctcagaaactgtatcccatagaccttaggaaaagataggtctagcattatatcaataattataatggttaacattcatggaacatgtacagtatagcagacaacatgctaagtgcttcagattttattcctccatatgtttatagtcatcacaaagaatttcagggtcccaattttgaagcttcgttattaatgcaatgatgaaatcttttgtttccttttcatgggatttcatatt

SEQ ID NO: 468362 - DNA, 2981 bp, Homo sapiens
ccgcctgaaaactgctttgcaggtgcaacagctgctctcactggtgctccaggttatcagtatctgtctctccacttctccctagcaaagttcaagaaatattagtaagaggcctgaatatttggacaagatggcagattcatcatcatcttctttctttcctgattttgggctgctattgtatttggaggagctaaacaaagaggaattaaatacattcaagttattcctaaaggagaccatggaacctgagcatggcctgacaccctggaatgaagtgaagaaggccaggcgggaggacctggccaatttgatgaagaaatattatccaggagagaaagcctggagtgtgtctctcaaaatctttggcaagatgaacctgaaggatctgtgtgagagagcgaaagaagagatcaacttcatagttaacacaggggtccccaactcctgggccacagacccctactggtcggcggcccctcgggaatcaggtcgcatagcaggaggtgatggaacagaatacagaaatagaataaaggaaaaattttgcatcacttgggacaagaagtctttggctggaaagcctgaagatttccatcatggaattgcagagaaagatagaaaactgttggaacacttgttcgatgtggatgtcaaaaccggtgcacagccacagatcgtggtgcttcagggagctgctggagttgggaaaacaaccttggtgagaaaggcaatgttagattgggcagagggcagtctctaccagcagaggtttaagtatgttttttatctcaatgggagagaaattaaccagctgaaagagagaagctttgctcaattgatatcaaaggactggcccagcacagaaggccccattgaagaaatcatgtaccagccaagtagcctcttgtttattattgacagtttcgatgaactgaactttgcctttgaagaacctgagtttgcactgtgcgaagactggacccaagaacacccagtgtccttcctcatgagtagtttgctgaggaaagtgatgctccctgaggcatccttattggtgacaacaagactcacaacttctaagagactaaagcagttgttgaagaatcaccattatgtagagctactaggaatgtctgaggatgcaagagaggagtatatttaccagttttttgaagataagaggtgggccatgaaagtattcagttcactaaaaagcaatgagatgctgtttagcatgtgccaagtccccctagtgtgctgggccgcttgtacttgtctgaagcagcaaatggagaagggtggtgatgtcacattgacctgccaaacaaccacagctctgtttacctgctatatttctagcttgttcacaccagtagatggaggctctcctagtctacccaaccaagcccagctgagaagactgtgccaagtcgctgccaaaggaatatggactatgacttacgtgttttacagagaaaatctcagaaggcttgggttaactcaatctgatgtctctagttttatggacagcaatattattcagaaggacgcagagtatgaaaactgctatgtgttcacccaccttcatgttcaggagttttttgcagctatgttctatatgttgaaaggcagttgggaagctgggaacccttcctgccagccttttgaagatttgaagtcattacttcaaagcacaagttataaagacccccatttgacacagatgaagtgctttttgtttggccttttgaatgaagatcgagtaaaacaactggagaggacttttaactaccctgattttgatgacgagaaacaattcttgagtgactcaagttgcttagaaagctgtggtctcacagaggctggctgtgagtatctttctttggctctcatcagcaataaaagactgacacatttgtgcttggcagacaatgtcttgggtgatggtggagtaaagcttatgagtgatgccctgcaacatgcacaatgtactctgaagagccttgtgttgtgcaaagaggcatttgatgaggaagcccagaagctgctggaagctgtgggagttagcaatccacacttaatcattaagccagattgtaactatcataatgaagaagatgtgtcttggtggtggtgtttctgatttgaagaaactgacattcctttaaaaatataaatataaatacatacatacatagatatatacccagacttgggtgcttagcttcagatactctatgcccagagatagtgcacttggcagctgtcagataccattcatctacttctctgtaaaatgtctgttctacttcacacagtggtcgagaggctaaaataaaatgaaaagcataaaactctctgaaaagtatgtttttaattggatacagagcttaagaatgcaggtaagggaagcctggatatgaggctggaggatgcagacagggaagatcagttaaaatgccttgttttttccttacttccactgacatggcttagttcacagccctgctatctctggcacgttttattaaaatgtgtctccatatgtgttcttgggatcaccagtgtcaagatcacttgggtatccgtcttaaaatggagattcctgaaccccacactagacttaccaaatcagaatgtctgctaccagctagcaaccagcatttttgagaatttcccaggcaaattcttaagtatactaatagttgagagtcactagtttcaatagaaatgggagtctacttctacaatgaatactttctatagcttattgtaaagataaggaggattaatttcctttaagggaatataaggttatttgggctagagctagaaacagattctttcatttggcaagagcgtgacacaataaattttgtgtgtgtgtgtgaaagactgttctggttatttattgatcgtgtaacaaactatcccaaaacttggtggcttaaaacaataatgattttattaaatctcat

SEQ ID NO: 468363 - DNA, 910 bp, Homo sapiens
agggcctctaacctaggctctggactccatttagctctgctctctctctatgcagcatggggctgtgcaacgtaatctttgaggttcatccctctcccacattcttggaaactatttctgtctatccaagcactcaatgcacctgcaacccagaacgcagaggccttggaggaaagcagcaagcctgctggaaggggctctcgtgccaggccagggagatagacctttaccctggaggcaaccaggaaatgtcaaaactttccatcatgaccataaaggagaccagtcttaagacgaagatggcaccaaggaaggcggaatggaggaatggaaaaatctatgtcctcaatggcttcattaaactgctggtgctgtccccgaacaatgcgggcccttatcagctggggcagcagccctggcccgctcgctccggctccctccgcccagaggagcacgcagcctctcggtaattgatacacggcgcagctttgtctgaggctgtttgctctgctggtatttaaggcagcgcgggccccctgattgattgccattggccaagtttctgctgtcagtgaaggaccagccaatggcagcggttaacactcttgatggcccagtcttctgggcgccacgagaggcccaacatgcaggaacaaggcccgcttcggactgaggactgcactcagagatgacatgttcatgcttcttcctgtttctggtgtatatatatttatatatatataaatatatatattatatataatattatatatataatattatatataatatatattatataatatatatattatatatattatatattatatattatatataatatatataaaaatatataatatatataatataatatttatatatctatatatttatttgtgattaa

SEQ ID NO: 468364 - DNA, 2402 bp, Homo sapiens
tttgggagcctaaagaatgcaacacttcactgtgacagccaacagaacctgggaggaggccaccctacactggctgcttgctgccaatgagagaccagggaaggggcttccaggggaccccgtggagcccaggaagcacaggagacctgaagacaagacgtctcctgggcttcgtgttcgcttcatctctacaagcactgaaatcactttacaaaagcattttaagcgaggccgcatctgcggctgtcttgcatttcttgtggctgccttcttcagtccctgctataatcagctcaactctgtgcttgctggatcctggacctcctcctccaaacatgcatcaggtcctgtcctggcccagagaatgggactagagacgccgtgcagaccctgtctccgtccaggcttctgctggttcctctccgaactagatcctgtggcatcttcacaccataaccagggcattgatacaggggccatagaagtctccctgccctttgggaccaaaacctccctgtaggcaaaatcctgaagccaggctattctttaggaaagctcagtcagcacaaaaagttgtctccatccccaggagcaattgcaaggctggaggagtcagcattcccatgtgactgaagggtggggcgggtggggtggaagatggagagcaactgaccccctcactggaccctgaggaagatgcccttgcagggaggtggcagctgatatttcctggtccaaacactggcttccacttagttactagaatcaaagtctttttgcaagctggactttgagctataatagtggatgggatccattttaactaaaaccccctttcagagtcatgatgtaacagcagcaacagttacagagcacttatacatgccagacaccattctaagcacgttacgtgtatcagttctttccattcttaccacggcctgtgaagttgataccattattatctctacagagaaatgaattaaggcacagagagattaagaaccaaggtcttaatgtccaaggtcttgtgtccaaggtcacacagctaagaagtagcagaacgtaaactggaacctggccagtgtgctcaagtatcactgttgtactatatgcctctcaagatgttcgtgtttttgctcccctactctttaggcctaagctaccgtgaagtttgatcccagagtttcaaaaggccgagcaactcacaaacacctctgtctccagcaggagcctagagtgataattttgacaagtttgggcttgaggtttcagaagggagtggaattattttgcatgttgacgaatttggtcgagactcaagcactatatcagggaaagctgcattctgaaggactttgcgtgataaaagatttagggggccacaggaagaaacccttttattctaaatgcactgggaagccattgagggctcgacgtctgattatgtgtttaaaggatccgtttgtcttctgtgtaaatgaattatgcaaagtggaacaaaagtggaaccagggagattagttagaggacattgaataagatggtggcagagaagatggagagaaatggattgatatgaaatatgttttggaaatcaaattgataggattcagtgatggattagaggtgatggttgaagaagaatggtgcagaagctgcacccacagccagctccagtgagctcccacctctgatgacacgttcctggggttgggggctccctacctcccaaggcagatgaattccactctggaaacacctaagtgtgagaaaattcttcctatcatctgacacctgctgctcactggcccttctggagctctttaaaggcctctccagctgccacatccagccccttgggtttgaagttcatctgggtctttttccaaaattgaagtcagacctccaagtgtggcccgtcacccccagtcctcggaacactgtgcgtctgtcactgcagtccattgtgttcctgttaacagggattcgtggacaatctagtttgagtttaccaggacaggctttaatgacaatgtgtccctgaagcatggttattttcctatcagtgtccttgtggtggactttcagtgactgctaaagaggctttttgcagtgtgttgcctgtggggagcaacagagagtgtgttgagtcagcgctctggggttgggtctgagtcacagagccctgagattatccaggaagacacactcattttccttaagtatcggtcttgctaattatccactgagatatatggggagggaagaaggcacaaaccgaattacaggcctgcttgccagaggatgccttagtggcttagctcctgctggggtggcggtgggaaacaggagaggtttggcaacctcacacaggacctgtcctggaccctccaaacagg

SEQ ID NO: 468365 - DNA, 874 bp, Homo sapiens
tcctatatcagccggaaatgctctagcagacaagacaaattcccgtcatgcatataattacccattttggattcccaacatccatccagtccaataacgggccctcctttagcagccaaattacccaagacttctctacatccttgggaataaaatgggttctccacacaccctacaggcttcaatcttcaggtaatgttgaaaaagtcaactctgtctttaaagccaaactcaccaagctggctctagaaacccaccaatcatggacaggaaatcttcctttcacccttatgagactctgtgcaacacaaaatgcaccctctatttatagtccctttgaaatcatgtatggccaaacttttgtcttagggcctccacccttaccaaactctgaaccagtcagtaattacctccctgtcttaatccagacatggtctttcattcatgaagcagcaaatgaggccatgcctctccctatagtcatctctttgtcctctatacataactgtcttgcaggcacagacatgtttatctgccaacccgaccctcatgaaaagctacaaccaaagtgggcaggcccctacactttgatactctgcatgcccaatgcagtgagagtccaaggactcccccactggatccatcacaccagggtcaatctcacccccaaggctacttcttcctccaaaacattaatagctgagttgtcatctaggccaatttctcctaccaagcttaaattaacaaaaaattttttttcttagaaccaaaacacaaggcagactaatcacctgctttcagaaatggcctgtatctgcccaaccgtttgctgtacctgacttccaaccaaaagtcttagtacaggaatatccct

SEQ ID NO: 468366 - DNA, 2115 bp, Homo sapiens
tagtttacagctcctcatgccatagagactttgctgcaaggtgcttctggcaaatggatatccagaattcaccacacctatccatgactgccaggaactgttagagacaacagaaactggctgacctgatctccaagatgtgcctttaaaggaggtggatgccaccatgtttacagacggtagcagcttccttgagcagggagttcaaaagactggtgcggccatcactatggagactgatattctgtgggcccaagctctaccagtggtcacttcagctcagagagctgagttggttgccttcacacaggctctccgatggggcaaggacaaacatattaacatttacactgacagtaggtatgcttttgctactgtgcatgtgcacagagccatctatcaagagcatgggctacttaccttagcaggaaagactatcaaaaacaaagaagaaattctagccctgcttgaagccacagggattcctcagcaggtggctgtaattcactgcaaaggacatcaaagggaagacatggccattgcccgtggtaatcagagggcagattctgcagcccaggaggcagcacggcttccagtcgcacctctaatcttactgcctgcagtgtcttttccacagtctaacctacaagatcatccaatatactcagcagaggaagtaaaactggtttcggatccccaggccagtaaaaatcaggaaagttggtggattcttcctgactcaagaatcttcataccccaaactcttggagaaattttaattggtcgcctgcattctaccacccatttgggaggagtaaaactgacccagctcctaagaagctgtttcaagatcccccaccttcagaacttagcgaaccaagcatctctccagtgcaaggcttgtgctcaggtaaacgccaagcaaggtcctaaaccgagctcaagcaaccgcctctggggagacttgccaggagaaagtgaaatcatccctccacatgggctgcctgctgccatagggtctgataatggaccggccttcacctcatccatagctcaatcagtcaataaggcattaaacattcaacggaagttccattgtgcctatcgaccccagagctctgggcagaatgaaatgagaggggtatttaaaatatttgaacaaataatggtggaaaatttcccaaatttagcaaaagttaaactacacattcaagaatctgagctaacatcaaataagataatttcaaataaatccatggtggaggcaaatcataaataaatttttgaaaactaaagacaaaacaaaatcttcagagtagcccgagataaacaacacattccctacaaaaaaagaattgcggatttctcatctgaattcatggtggccagaaggaggtaggacattttctcaagtactgaaagaaaaaaactataaaaaaatctctgtcttttgaaactatattcatcaacaaagggaaatgaaaagcttatcagacagaaaaactaagagaaaatgttgctagcaaatctaagtttaaaaagattgctagagaaacttctctaactagaaagaatataacacaagaaggcttagaacacaggaaagaaaatattggaagttggcaaaaacagtcataaatgtaatagaatctgtttctcaggagtttttgaaatcatatttgatgtttggaaaaaaatgctctgtatttagaggaaatacttaacataattctatttaaaaatgggggatggtaaagggatctaagtagaatgaaagtttctacatttcacttgaaatggtaaaatgctgactaatagactgtgagaagttacatatgtacactttaatatctagaactaccactaagaaaatgataaaaagtagtgtgcttagaaacactataaataaaccaagatggaatctaaaaaatgtaaaatataaccaataagaaaatggtaatagattaatgaaaaactgagaaaacaaaacaaataaaatagcagcctaacatagcaatatttatcttaaatgtaaataatcaaagtacatgaatttaaatgcaaattgacagagtggaaagaacaagaaacatgatgctaaaatttgttatttat

SEQ ID NO: 468367 - DNA, 702 bp, Homo sapiens
tgcaacacgatgcacttccacagaggtctcctgctccgccaagccgcagggacccgtcgccaggcaacagtggctttcattgtgaagcgagcagtagctctctgcttgcgcctgacgccctgtgactggcgcatgcgcattcgcgaggcaggctcgggcgcctggctgaccttaatactctcgaccatagctcctcctcgggcatactccgtggtcgggtcccactggaggaggaggcgcttggactgtgagttgggcgctggatactgctcttctgattcctttcgggaaaaaggctgtgtgcaggcatcgggtctcatgggtctcgggatacagtctgcacgtctgtgtgggaaaggcaagaatcatgacaaagtcaagtccaaggtgaagcagaggtctcacacctggaactctcatcccacgggagcagatgaggttgagagggcggcttagaggccgtcaacaacctatcttctctgaagcctagtacctgaaggcttcctctacaaataagaactttggtctcacaattctttatgttaatgcagacattcctttttgtttattccaggtctttaaataaactcaaccaatcgtcattttgaaaatctttaaatctacctataagctggaagcccctgcttcaagttatatcacttttctggaccaaacaaatgatttcttgaaggaatttgattg

SEQ ID NO: 468368 - DNA, 525 bp, Homo sapiens
tcctagaaaagaaccaagtaacgtgttgaaatgggatgcggaacaagtgccaagctggtgcctggacctgctccctggtctcactgcagctgctctccaatccagattcagagaaccagcagacatggcgggtcaactttctagtcccggagcaggaggagatggatctggcagaggctgggaagggcagcgggggtagtgctatagcgctgctacaggcggggctggctgatgctggcagagcccaaattcagagatccaaccaggcccttggtggtgggcacgtggcactgtgggtgggtaccagcttgctgagatggctgctggtgagtagggggactcagcctggagcccccagcccccatactgcctgttggttacactgtggctgctgctgccaccactggcatacgttcagatggttccctgagttccacatcagggattcagacaaaaggagcttgcaactgaaagggtgagtcttataacaaaattatcagcctgctgtcaaccaggcgctctgcc

SEQ ID NO: 468369 - DNA, 635 bp, Homo sapiens
ctccatctgctccgccctctcgtatgctgcagctgggccagcatttggctctcacagcccagagtcatcatgaggacctaagacacagagatggagccctggggcaggttgtggggaagctgaaatcagaaaatcttaagtccaagatcttcagagacctgctttctgccaagagggttggggcccaggcccaggagcttcaaggagtacagcgtggaccgagagccattttcccccgcaccaagtttcaaatcaacaccccgcctcgaaaggagccagcaatagaaggaaccagtggagttggggccaaaaaaaaattccaaaaatatgcctatggattgagggctccaggtctaattggggacccgataaatggaaatgaaacaacatccctattgctcattttacctactgtcaccaaggtcagcagtgaggacgtaagcactgaatcccacagtgctctctcagctcccacctgtctgcagcccacagcccttatcccacagccttccttcgttcaaagctccacttctttgaatggcagacactatcctaaatgagtccccatactgctgtgaccattcttgtgtctcctcagatggctcctgtttattctcccaacacggaagtgtggg

SEQ ID NO: 468370 - DNA, 3303 bp, Homo sapiens
accccctctccatctccaccactatgggcctgggccaagtcaccatcatctcccccatggacaactgcagtagcctcctacctggtcttccttgcatctttcccccctctacaaagtattttaaacacagaagccagaaggtagttcatgcctctgctcagggctctcaggtggccttcacaacatttagagtggcgtttgaaaactttagtgtggatcagaatcacctaaaggtcttgttaaaacagatctctggccccacttccagagtttctaattcagtagcccccagagagcatcatggcatactcttcacctccttcaattctttgctcaacagactcctggtccatgaggacttccctagcatcttctttaaaactgtgtacagtacctgatcccttcctagcatccttcctcccatcccacgatcagttttttccatagcactatcaccaactgacatgctactctatttgacttatttgcttatccattttttatcgactcacccaccggctggtacaacaccagagccctgacaggacaggaagctcctctgttatcttccagtgctttgttgaataagagtgatgaaagtggaaataagaaaggaaaaatattcagctttctaccatgactaagatgttagctgtagactttttgtggatgttctttatgaggttgaggaagttccctccattcctagtatactaaaagtttttattgtaaatggatgttgaattttgtcaattgctttttttacatcaaatgatataatcatatgatttttcttctctagattgttgatagggtggattacactgattttcaagtattgaaacaggattgcataccttgaataaatttcatttggttgtagtgtattattctttttatacattgcaggatttgatttgctagaattttgttgagaatttttgcatttatgttcaagggatattagtgtatagatttattttttgtgtgccatctttggttttgatatcaagtcttactagagttttatcaattttattgattattttgaagaactggctttttgtttctgtctactctatttcattctatttctattgttttcttgtttaaaattttatttttgctcttgtcttttattttggtaaaatatacataacataaaatatctcattttaagcacttttaagtgtgcagttgatttttaagtgtacagtgacagtccagtaagtgttcagtgaatgtacagagtatacagtgagtgtacagtgagtgtacagtgagtgtacagagagtgtacagtgagtgtacagagagggtccagtgagtgtccagtgtccagtgagtgtccaatgactgtccagtgagtgtacagtgtccagtgagtgtccagtgagtgtacagagagtgtccagtgagtgtccagggagtgtccagtgagtgtacagtgtccagtaagtgtccagtgtccagtgagtgtccagtgagtgtacagagagtgtccagtgtctagtgactgtccagtgagtgtacagtgtccagtgagtttccagtgagtgtacagagtatacagtgagtgtccagtgagtgtatattgagtgtacagtgtccagtgagtgtccagtgagtgtacagagagggtccagtgagtgtccagggagtgtccagtgagtgtacagtgtccagtgagtgtccagtgagtgtccagtgagtgtacagtgtccagtgagtgtccagtgactgtccagtgagtgtacagtgtccagtgactgtccattgagtgtccagagtatacagtgagtgtccagtgagtgtagagtgtccagtgagtgtagagagtgtccagtgagtgtccagggagtgtccagtgagtgtacagtgtccagggagtgtccagtgactgtacagtgagtgtacagtgtccagtgagtgtccagtgagtgtacagagattatacagtgagtgtacagagtgtaaagtgagtgtccagtgagtgtacagagaatgtccagtgagtgtacagtgtccagtgagtgtacagagtgtccagtgagtgtccagtgagtgtacagagtgtacagtgtccagtgagtgttcagagtgtccagtgagtttacagagtgtacggcgagtgtccagcgagtgtccagtgagtgtacagtgtccagtgagtgtacagagtgtacaatgagtgtccagagtgtccagtgagtgtccagtgagcatacagagagtatacagtgagtgtccagtgagtgtacagagtatacagtgtccagtgagtgtacagtgtccagtgagtgtccagtgagtgtccagagagtgtaaagtgagtgtccaatgagtgtccacagagtgtccagagagtgtccagtgagtgtccagagagtatacagtgggtgtccagtgagtgtacagtgtacaatgagtatctagtgagtgtccagtgtccagtgagtgtatagtgagtgttcagtgagtgtccagtgagtgtccagtgtccagtgagtgtacagaaagtatacagtgaatgtccagtgagtgtatagtgagtgtccagtgtccagtgagtgtccagtgagtgtacagagagcatacagtgagtacccagtgagtgtacagtgagcatacagagtgtacagtgagtgtacagtgtccagggagtgtccagtgagtatccagtgagtgtacagtgtccagggagtgtccagggagtgtccagtgagtgtctagtgagcgtacagagagtgtccagtgagtgtccagtgagtgtacagagagtatacaatgaaaaatcatctgtcattctaattggtgggtttttatagataatgtgtcatttctctctggctgtttttaagatttttttctttgccattagatttcagaagtttaattatgatgtttcttgatatggatttcttttggtttattctatttggagttcacctagcctttggatctataaatttttgtcttttgccaatttggaaagttttcaaccattacttattctgagactccaatgatatgaatgttaggtatttgttacataaatccttaagaccatgcctttcttccgtctattttctctctattgttcagattgaataaattctattgatttgtcaagttcatagattctatgctctgtcatctccactctgttgattctatctggcatgtgtttttcatttaagttattgtatttttggggtctacgatttctgtttggctctttttttaaataacttctgttgctttgctaagatttttctatcttttcattgtttcaaaaaaatc

SEQ ID NO: 468371 - DNA, 1330 bp, Homo sapiens
agattgccttgcctctctgagcctctgcttctttctttgtaaaagaagtcggttcccagttccagtgtgagtctcctacatactatgattctcaaaggtttcaaagggcatccggagatgggggccctccccctggctctgaggacagcaggtaggtgtgtggagcctctgtgtgtaggtgtgcgtatgaattcgtttgtcccctgggagcagctggagactaagtttccctgcaataaaagtgagttagttgcttctttcctgataaccataatccattccacttcttccaaggaaatgacaggcccccaggtgatgcatccccatgactgggagaaattggctattttagtcctcttcgaacatggagcaagttcttggagctgtcctgcggcagcctgccaggcctttctgctattaagaacaccctattctagtttattccctggtttctgggctccccacaatgatctatatgagtttcagagctcaggagacaccctgcactgctctgcctgcaagctgggccattcttggaggtgggatataccagagcttttcaaacgtctccacccagcaaagttccctctggcagaggagcctgagagtgtcctccagggaggctgggggcagcgcctgaagcagccccaccacagcacatctctttgaagtcttatgttttatctcaggaattcacgtgaattctgcattctattccataatacatatgtttgttttaatataaaaatgttttaaccccaaatcttcaaataaaatcaatgccccaggaagatataacttgtttattctatacctttaaactgcctagtttgccactgcatgcccccaggggtacaagtactctagttagagaagcagttgcaataagggcgacaaccaaaaaagtgtaagtcttcacaacttcccctccccagtcttctggaaaagatctaagtctacctgcttagttgtcatgtctgttgttctggacactagaagaatggggagagatgaagaactgaggaagatgcagaggcaatactgatccacaatgtctggaagcttcaaaatgcttgttgaatgaatatttttccttcctgctttagctcagtctcatcatcgagaatcaagtcctaatcaggcagtctttgtctcagttcctaaccctactccagcaggttatgaaggttaacagcatgaacatctttattatttatctgtatattatttgtaccagcctcggagaatgaaaggtaccttccttctgagataggttgttcttagccgatgtgaccctgagaaatttgggagaaaacaacagttttgtttc

SEQ ID NO: 468372 - DNA, 736 bp, Homo sapiens
agctcttttgcaggcgaatagaagtgtgcagtatttggagtattgctttagctctgagaacaatgtggctaagtcaccagggagctgacttagacctccttccctttcttcctttgattttcccctcctctttctcaagcgctaaacagagacttagtccaaagagaaccaacccatgcttgatgataaaaggaacaatgggatttctgggtcatcctctgggcccacagacaggagggctgcagtccaggatgccagacaaaccaggttattttggagcaagccagcagcagaactgtaggctgagaacaaaggatttggcccatgtccatatccctgcaggggtcacgtaccagctgaacacatcagcctttagttatgttcccattttaggaaaaccagaaatagggaatctcaacataatttcccactctgaaaaccacagttggtgggagaaacatggttcctggtcatggctgatagatagggtgtttccatataaaccagtggcccaaatccaggtcctcatgctattagaacattccagcatcgcagcaactgtcctcagtcagaccacaggctcatgtattttcaaccaggcaacttggactgaaagaagctttcaatggagcccaacaaaatcatcacagccttagactggatctagatgatgcccaagaataaaaagtaaaggcaatgttctgaatattttaaacttttacacttttaaaatgtc

SEQ ID NO: 468373 - DNA, 621 bp, Homo sapiens
aatctatattaagctcccaggggatgccaatgctgccggtccaggaaccaggtctgcgcacaactagagatggaagaatcagcaccacactgatgcaagggactcattatgcagcctcagtgtgtccaactcgaaaggcactgtctgaacagggaatgcagctgtggcgagctgctcggggatctgcattcctagcctggctcttcaatgtacatccacctccccaactaagagaaaaacatggaccatttgctgtcgcagaaatagtcctggtcagggagttgaatgacttgagtcttctggacactcacagcttctgccagccatgggtcacttgtctctacacaagaatagccagcaaattctctgtccaccttatgaggttgctagaaagctcaaacaggataacatgggaaagaactttagaaggtagaagaagccattcaaaagctaatacaaaggactgtaaataaaatcattattagggtattacaatactcagcgaaacctgtggaccttatactgctccatgagctgttcagctgcctctctgataagagtatatgtaagctgacataggcaggcttaaagtggtcatctttgtgaaaaactaagaaaagc

SEQ ID NO: 468374 - DNA, 2310 bp, Homo sapiens
aaagatgattgaggggtgcctgctttatcccagactagggtataatggcttcaacaggaccaatctggcacctgccttgggttcattcgggggatgtgccttctgtgtcttgtcttcctccctcctcattcacacacctcttggcattatggtatgaagagagcacagggttaggaaatagagaactcacctcacctgccattgatgtggaacaaggcaaggaagatgcagctttgaggcagcaaccaattgatcatttgacaaaatttactgagcacttacatgtgctggaagctgtgctgggagctgtgctgaaccccacagggctgaagacaccatgggctctggtctccagaggtttgcagattgagaaagttcagggcatagaactgagtgaacggcaagctgggctcaatgtctgccaacccccaaggcctggcaccataggacacagaagtgtaaaagtttgaggttttatacttaggtctattatccttttgagttgatttttgtatgtggtgcacagaatggatcaaaatatgtagttttgcatgtgaatatacaattgttctaataccattaattgaaaagatttaaacttcttcccctggattgcttttataagcttgtcaaaacttagctatctctatatatgtttgtgtctatttctggcctctaatcagttacattgatctttacacaaatacctcactattctgattactacaactttacaactcttgaaaacagataatgctaatcctctaactttgctcttctttttcaaagttttgctgtctatttcaggttctttgcatttctagaaatattttagaattagtttaaaactttctactaaaaagcatgctgagatgttaaatgggatggcattgaatctattgatgaatttgcaaggaattgacattttacttttaacaattttgagtcttccaattcatgaacatagtatgtatatttccatttatttgggtgtttaaaaatgtctttaagcaatattttagggtctttggtgtacatgtctttcacaacttttgcagatcttgccttaaatattttatattttctgatgttctcataaataatattgttttctcaatttttgtttttgatttattgttagtatagtgttagtatattaaaatttaatttttgtatatttatcttgtgtctttcaaccttgataaactcatttgttagttctagtggcttttcatagatttcattggaatttctacataaaccatcatgctggctgtacatgaagaaagtttttctcctttttcaatcttggttccttttattttattttattttttcctattcttattacactggctagaacttcagcacaatgttgaatggaagagaacatccttttgctattcttggtcttggtgatgggtatgtgtgaagcattaatcttttttatagatgtcctttatcaggttgaggaagctgcttctattcttattttgctgtgaatttttgtcctgaatgaatgttggattttgttacattctttatttgcatctatttagatgatacagcttttcttcaaaatgcgtttctatggtgaattacattaaaaaacatattacattttagatgttaaaccaactttgaattcctggattaaattccacttagtcgtaattattatcttttaaatatattgttgaattcagctttccaaaaatttgtttaaaatttgtttaatttgtgatattgatctgaagctttcttttcttgtaatatctttgtctgattttggtaactgggtaacattgaccttatagaatgagttgagaagtatattctcctcttcaattatctagaagaaggtataaaatttgtattatttttctttaaatatttggtagaagtcaccaatgaacctatctggtgctgaatttttatttgtcagaagattctaactacaagttcaatttcttgaatagattgaaattcaggttatctatttcttcttcttcttcttcttcttcttcttcttcttcttcttcttcttcttcttcctcttcttcttcctcctcctcttcttcctcctcctcttcttcctcctcttctacttcctcctctccttcctcctctccttcctcctcttcttcttcttcctcctctccttcctcctcttcttcttcctcctctccttcttcctcctctccttcctctccttcctctccttcccctccttcccttcctttccctccttcctctcctcctcctcctcttcttcttcctcttcctcctcctcctcctccttcttctttt

SEQ ID NO: 468375 - DNA, 719 bp, Homo sapiens
cactcttttgcagggctgaaggaatgcatgttcatttaggatggtgtggagggacactgatggagattatgaatacctccatctgccaacagatgttaaccaaaatgttaatagtgattatctcttagagattttccccttggattctgattctaccactgagctctcatcagacaccgaagtccctgcgatcaattctgctcccgacctcaactctgttaatcctgacaatacccaacctggcatctggccttttaatgctttgtcttctgaccctgaccaggaggccaacggccaaggacagcagcagtgcagaatgagcttcagcccaacaaaagagggacacatagcttgggagcattttccagatgctgataccactgtctacatggacacacctttgtttgaacaccatcctcaactgtccacattggcaggcacactggtagtgtgcacccaccctcgacaatcacaatcctacacatatgctcacgactgtccatttccacatgcatactctccaccacttacataccccaataaccaaagcctccttgcacacttccagtgcacatgcaccctcacaggccacgcacacctcccggatacactcagcctcaacaagccatgtctgcaatgcacactctggcatacacatccaccgtaggcagcctatgtctgcatgcatactcccaacatacatattccctatgtatatt

SEQ ID NO: 468376 - DNA, 547 bp, Homo sapiens
aggcactctttggtcacaggagatggcagggaagtgggggaaatggagggatgattggctggggcatgggggttgacttgggagagtgttggatgtcacatcagttccttcaggctcaggggtgggtccagaaaataatgtatgcaaaatatcctggtaaactaaagagtgatttttatatgccagttgttattactcttattattattattaccgtcctgggaaagaaaggacctttactttcagtctggaacatggatgaagatgaagccctcccagacctctcccatccacatctgactcagataatccctgagtgtgttctacacaatgtagtagtccgtgattctggtcccctggctattggctgctgttttatgtatagcccaggtatcagctgaggcctctctctcccaccccaccaccccagatgttggtaagcttgacccaagttgccagtgctcagcctgcaggagtccagagtctcccccaatttgcacaagtttctaccactggttgctgtatgttcccgtggtctttgctcctg

SEQ ID NO: 468377 - DNA, 1340 bp, Homo sapiens
gaaaagtgaaaagctctgaaggtcccacaattcatggtatgtacaggggctcggaggagggaaactgcccagctttcccccggcacagctgcagggtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcttcacgtgactctcgggcagaagcagtggtggggcagccagggcagcgtcaagagtctgagccaggtgaggtgcggtcaggacccccacagggctgggagtcagggcaggggcagaacaaaccttggaggggaggatgtgtgcatagtgggcctggagggcggctgtggcctagtggacaggaagaagcagtgggcctggaagagctgcatgatcagggccggcactggtccagggtggatcgggggaccctgggggctcaggatccagcaaggggcggcaggagtaaaggaggaaggaatgacaggtgcaaataccttcccaccaaagcccttgttgccctctggctcctccccagagctgtccccactctcagtcggtcacccactccttgaacttgagatcggtgtcggtggtgctaaagccatcatcagcaatgacatcatcaccccctcctcctcatggatgaccgtgtgctcttccccctggcttgtgggcttggcctctgagctggacttctttcggtccttgttgcaagtgggccaccttcacctggaaggccaggttgtatttctgcatctcattgggccccagggtgtaccaccgctcgctcagcatctggctgacggtccggttatcctggttggggtgaccctggtgcgccccgccagggcctggtgccgcctgctgaagatcatgagcgccactcatgggccaccggatgtgctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaa

SEQ ID NO: 468378 - DNA, 503 bp, Homo sapiens
ttccctcaagtttgagaagaaatactcctgacacagctgccttgctgggggcatagtgggagatgagtcagagaggcagtccgcacactaccaggaacagccttacagacactggtaaggggcttcaccatcatgctaaaagcaaagcaaagccattagaaagttttgatcagagcagcaacatgatgtgtttgggtttttttaaagagcattctggctcctgtatggagaatagatgcaggaataccagtcaggaggctactgcagcagtcaaggaaaaagaagaggccaggactggccagaggacacaggcattgaccatggaggagacagaacacgtcagtgcagagctggcgctgactctgagtgcagggccctgcaatatgttaccgaaaaccagagatccttcctttagcctacgtgattattccttgttcacagctaaagtcgagaggagcaaaacacatcagctatattcagtaatttctgtcataggataaatt

SEQ ID NO: 468379 - DNA, 723 bp, Homo sapiens
cagcactcacaaatacataggcccagttaaaagttatacaatgataggcctgcctctttctgttgctcagaacaagtcacagagccagcccagattgaaagagagaggaaacagacccctctctcagtggaagcagtggcaaagcttcattgcagaagagcacaagggaggaggacctattgctgaggccatctttggaaatataactgatcacaactttaaaaacactttccagattagtctgatgtgctcaaggtctgtgaaccacgtcccgggaagtctggtcccaccaccccctttctccttgctgtcagatgatgagcagcaccaggctgcccccaaggctgatgggggactaattattgatgcatcttggttttctctgtctatatcattcctatcttttgcattcaacaaatattcatcatacacccattatattgacatggggggaggggagggagagggttaaaaacaccagccagacagctttcccatcctcaggttacttgccatctaaaagtaaacaacttagccaactcttggggctgagtcattacatcccttctcctgattcctaattagaaagttccaagctaaacttaagaagataactgcgcattctctttttaataatgtgccgggaagatgtggaagatgtgttttagggctctataaatgtttaataataaataataagtggctggaatagtcagtgtttta

SEQ ID NO: 468380 - DNA, 593 bp, Homo sapiens
caaccactaccatatggctgacaaatgaatatgccctgccctcagaggtggaatatagagaggcagtaggccttgctgagctgtggtgggctccgcccagtttgagcctccctgcagctctatttacactatgagcatagaactgcctattcaagcctcagcaatggcagacgcccctacccctgccaagctccagagtcccaggtctaagagatttggcaaaggtataagcaacaaaataaactctgtggtagcaagagaagaaagcggtagggtccctatcgaaagtggcagattaggatttaactctgcagccaccattgacatcagtggcagtcaggtggctaaactgtttgcacattacgttgaaaatataccccgagaaaaatggacatttatcagtattgccttaggttttggttgtgatcatcagcagtccaggtttcgaatgctggctagccatattttaataaagagcttggtggagacattgggagtcttgagccagcctcaagaagtctggctacaactgaagccaccatgttatggagatcatatggagacactataaagacacagagagaagatgtgca

SEQ ID NO: 468381 - DNA, 689 bp, Homo sapiens
ttgtttgataagtgtctggtgttttctccttctgtctctctcccctgctgacttgtgaagaaggtgcttgcttctcctttgccttctgccatgattgtaactttcctgaggcctccgcagccatgtggaactgggcatggccattcctggctgtgctctcctacagatgcttctgcaccaaaccctctgggctccatatcagctgtcttcctgctgctaccacttctctatgcagctctccctgccaactggaggtctgccagggttccagaggcctgtggcaagagcaggttgctcattgccagttcaactcatttgttctcccagaggcatttggggccaggaatcagtccagaacttaacctccacaacggggagcttgtggtaaaaccagaaatgctgacatcctgctcttcctggcaatctaaccctctgggagatggtgaaagagaaagcaacaaatttggcaaagcaagaatcacaggctcttctgcaggagagagagaagaggttagatgcctctacccttcctgtcctgcacaggctattaggttagaaggtgttcacctggtgtcagttaaggagacctttccctattgaatgcaacgtgggcagtctttcctgtaccgtgagcaaggatagaactcttaatccatctcctaggatgatacatgaaagtcttctgtcct

SEQ ID NO: 468382 - DNA, 1139 bp, Homo sapiens
cctttgacctcacttggagagatatcatgctactgttagatcaaacgctggcctttaatgaaaagaatgtggctttagctgtagcctgtgagtttggagatacctggtatcttagtcaagtaaatgacagaatgacaactgaagaaagggacaaattcccttctggtcagcaagctctccctagtatggatccccactgggacctcaactcagatcatggggaatggagttgtaaatatctattgacctgtgttctagaaggactaaggcgaattatgaaaaagcccatgaattattcagtgatgtccaccataactcagggaaaggaagaaaatccttctgccttcctcaagtggctacaggaggccttgagaaaatatactcccctgtcacccaaattgcttgagggtcaattgattctaaaagataagtttattacccaatcagccgcagctatcaggagaaagctccaaaagcaaaccctgggccctgaacaaaatttggaggcactattaaacttggcaatcttggtgttctatgatagggaacaaaaggaacaggcccaaaaggaaaagcaaaatcagagaaaggctgcagccttagtcatggttctcagatgaacaaaccttggtggttcagagaggacagaaaatggagcaggccaatcacccagtagtgcttgttatcagtgtggtttacaaggacactttaaaaatgattgtccaaagagaaacaagctgcccccttgtccatgtccactatgctgaggcaatcactggaaggtgctgccccagaagagaaaggttctctgggtcagaagcctccaaccagatgatccaacaacaggactgagggtgcctggggcaagtgccagctcatgtcttcaccctcactgagccctggctaccttgggttacacttacaaggggaattgtgtcagaaagtctaatttcttttaagaccaggttgggtcattttctttattcctctctggtttatcaaaatccatcaaatgtgtcataactttgtcagtgcttatttagagttctgtttatgagcacacaactccaaagaggtgctttatctttttaaaacacgtggttatctctgaaatgtttaacctttgtacctggcaatgc

SEQ ID NO: 468383 - DNA, 556 bp, Homo sapiens
aaagagtttgaatttgctttaagcccaagtcatgtgaaaagtggacgccctcgtaagacgcctagaatatgcagatcaatggtaataagccttcgaaggccaccagtgaaacccagaatgagaccccaaacccaatcacccctctcaaggcaacttcttcacagaccctgattgtaaaggggtcagttggtcctagaaggtccggctgtgccaggggccctgaaggatttggtggaacagggcaggaggcagcaaggttctccttcaccaggaaaaggtgcctgcatcctccttcaatgctcttcttgagataccaccctttggctgtcttctggaagctctctagaaagctggacctgagcttgcagagagcgtacggccagcgtactctgcgtatgatctgcagcagtagcagatcggggttggagtgttcagatcaccttctgaatgcacgacaggacacgtgtgagcttcgagtgctagctggtgccacgtagaagcagtgtaaacttgagctccattttccccatttggagaaggggaaggtaaaacaata

SEQ ID NO: 468384 - DNA, 726 bp, Homo sapiens
tcctgcggctcctctgttcagaatcctccagtgcattcccatctcaatccggtcataaaacaggcactcagtacgtgtttccagaatgaatgcacgaagaaatttcccaaaactctacggcagttttgtccccatttcactcacgaggaaactgcaacccagaaaagtctgatcccagctggaaattcaccttcttcaggaagccttcccagattaaacccactcccatttctgagtgtttctgcacctggcaaacctcttgtcctgctaatcactatttctactacaaccatgattctacttatgggtatatatccaaaagaactgaaagcagggagagagatatttgcacacccaagttcatagcagcgttattcacaatagccaaaaaggtggaagaaaccaaactgtccatcaacagacaaatggataaacgacatgtgatatatacatacaatggaatattattcagtcttgaaaaagatggaaatttgggcacgtgcttcaacatggatgcgtcttgaggacattatcctaagtgaaataagccaactgcaaaaaggcaaatatggcatgattctactttacttataggaagtattggagttgtcaagctcatagagacagaaagtagaatggtggttgctaggggctagagggagggaaaagggggagttgtttaatgcaggggttcccaaccttggggccgtggaccagtacctgttc

SEQ ID NO: 468385 - DNA, 2784 bp, Homo sapiens
acgcaggggaattcttcggtaaaattccttcctcttacaaaatccagctcaccctgcacagtcaacctaattgtcaccgaatataggagaatggggaaactaggatttgcgtgttcaagggcggacaagccagtccaaacaggcattccagtcattgggtgggtgacagccaaagaagatccacctggtcacatcccaatttccccagggcatccgaagcaggtctgagcagccaaggataactacttagtctcctgctagaaaatatctcagttgttatccccactttatagatggtcaacttactttatctatctgatgattggctcctacagccagtaagtggtgaagctgagatgtaattccaaggctgctgatctccaaagccagttgtctttccaaatattagaatatactagtgtctgtggtctgttaaaaaaaatgatgacagtgcctttttaaataaaatttaaagcatccgcagaccctcgcggtgagtgtcacagttcttaaaggcggcgtgtccagagtttcttccttctggtgggttgacggtctcgctggcttcaggagtgaagctgcaggcctttgccatgagtgttacagctcttaaggcagcacgcctggacttattcgttcctcccggtggattcctggtctcgctggcttcaggagtgaagctgcagaccttcgcatccccaatagacgcaggaacccagctggcttcacctagtggatactccactgcatccgcagggggagctgcccaccagtcctgcgccctgtgcccccactcctcagcccttgggcggtccatgggaccaggcgctgcggagcagggggcggcactcgtcgggggaggctggggctgcccaggagcacacggcggcgacggggaggctcaggcatcgcagactgcagctgcagctgcagaccgagccttgccccacagggaggcagctgaggcccggggagaattgaagtgcagcgccggcgggccggcactgctgggggacctggcgcaccctcctccgctgctggcccgagtgctaagcccctcactgcccggggcgggaggcgccggccggctgctctgagtctaacatttaagtctttaatccatcttgaattaatttttgcataaggtgtaaggaagggatccagtttcagctttctatgtatggctagccagtcttcccagcactatttattaaatagggaatctttccccatttcttgtttttgtcagattagactttgtaacctccttttacaaatgaggaaactggctgggtgtggtggctcacacctgtaatcccagcactttgggaggtcaaggcaggagaatcacttgaactcaggagttcaagaccagcctgggcaacaaagtgagaccctgtctctacaaaaaatttaaagattagccgagcatggtggtacatgcctgtagtcccagctactcaggagactgaggtgggaggatcacttgaacccaggaagtcaaggctgcagtgagctgtgatcatgccactgcactccagcttggataacagagtgagaccctgtctccaaaaaaaaaaagaaagaaaaagaaaacaagtcatggagctagtaagtgcccaagagaacaagaataaacctagatccgtgggactccaagcctgtgcgcgctccatgcttgctttttccaccacaccacgttaacacaatttcctccttccatgagaccccaggggaaaggggcacctgagaagccctcgtggcaccctcccaggttgtttccacggctactacagtaagaaagtgttgctgggggaaggtcagctctctggcccacgccttccacctgtttctgctgtgttctttcctcagggatcccaacggcttcaatgactggaccttctccactgtgcgatgctggggggagagagcccgagggacctacaggcttgtcatcagggatgtcggggatgagtcattccaggtcggcatcctccggcaatggcagctgaccctatatggctctgtgtggagtgcagtagacatcagggacagacaaaggtgggtaaagccgcatgtgtcagagggaaggccagtcacaggggaagggccgcctagggagcccatcgccctctgaaccccagctgtgcttcccagttccagcgtcaagccggtagatggagccccgggctgggaactcacagtctgggcctctcctttttgctgtggggcttccctgtcttcacctgtaaggcaggaaaatgggtgagggcagatggtataggaaccatagtcagtggggcatcctcacctcttttcttctccacaggctgttagagagtgccatgagtggaaaatacctgcacgatgacttcgccctgccctgcccaccggggctgaaaattcctgaggaagatggttacaccatcacccccaacaccctcaaggtactagggccaagactcaagctgcgggtagatgggactgtcctgtctgggggatggagttcttagtgtgtttctcagggtgacctgcggggtgaaggactgggaagacctgggtcccagcagtggtttcatagcattgctcctaccctgctagcctaactcttacaggacaggccttgtcgggggagggggcagagggaacagtttgggtgaaaaaggcagtccctagaaggaaaaagactttctgagctcattgtcctggactgagaaaggctgtaggcttcgggaaacagtgcctcacaacaacaaatatttactgagcacctacaggtatgcc

SEQ ID NO: 468386 - DNA, 802 bp, Homo sapiens
ctgagtcatctaaacagcaaagatggtggcccactcctcccccggagggttccgtcctgtcccagacaggttctgccctgttactggtggctggctggaattccaagtcagtgggtcttgtgagctgccacataagtggggcctgcagaccaacacagctcagatgcctgtattcagcccccttcctagggttcggtacagacctctggccttgcctgagttgcagtcacctttgtcagggaacactggggttggagtatataaagttcctgggtctctgtgtgtgtcagcagctgctctactgagattccacaccgctctgtgtgccagtcccaaaaccctggtggagtgggctcacaaagggatctcctgttccaaggattgcaaagattccagggagatgtgtagtttcccagggccacacattcatttaccgcttcccttggctgggggtggggtttcccttggccctgtgtcactcttgggcgagctgtcgccctgtcctgcttttcttcattctccatgtgtcaagttgtttctctgatcagtcctaatgccttttcagtggacacagctagaaaaccggtcatttttaagaaaaaattaattatgaattcatactgacatttctaaatcaaagcttctaggtttttatttaacttaaaaaattttacatacgcatctcttttactctgaaaatttactcttttaatactttaaagttttatatttatatattttattagtccaataataatagtaattgtcatgctactcacaagaagaccaatgaatgtaattt

SEQ ID NO: 468387 - DNA, 913 bp, Homo sapiens
tcagaggaggccagcagatcaaggggtgttcaggtctgaccaaacctgtctgatgagcaagacaccctgcagatatcaggctaaagtctcctatggaagcaagtcgcatctaggggtatggccattgctggctttgctctgctacagacactcccatacccaaccctctgggctccacatcagctggcttggtgcccctaccacttctctaagcagctctctctgccaactcgaatgttcatggtggtcaaggagtctccccctgccagagttccagaggcatgtggtgagaacagggtgctccttgccagttcaactcacctattcccggagagctgttgtgggccaggaatgcttcctggtgtgtggtagccctgtgctgggttcccagcttttttccatttcagcttctgtatcttctttccagcttctgtatcttccctccatccactctcaggactttccctctgaagatctgtcagggacatgccagtcatcttggtccctcgatgggtggtgttccacctggctgcatctagttggccatcttaccctccactccgatgtcactctttttaccgtgtaaatgttcagttttctcagaatcatttattgaggattatcctttccctattttgtattcttggcagcattgttgaagattagttgaccctatatgtgtgtatatttatggcctatctattctgttttactggtatatgtgtcttttcttatgccagtatcacactgttttgatttctgtagctttgtacctaaagacttttgttgttctttatgaggtcctgtagttccacattgtaatgtttgagggctaaattttctcattattgtcctatacccttcaaagctggtcatttatgctcaatatgtcttctatttgaatcaaggcact

SEQ ID NO: 468388 - DNA, 730 bp, Homo sapiens
gaggccactgacaaccttcacacccggaagctgactggtccacgcatggccgaagcatgaggaaactcatcacggaactcattttccttaacatttggaattttacagtaaggacttcaactgtccttcctcagattgaggactgttcccagtgtatacatcaagtcactgagaatgtactacattcagcacaagtgtactacatgaatcactatcgatctgtcatgcaggaagacataggtagtgaggatgaagaaatgttactgcaatggataggtaaggagcatttagttcagagagaatataaaacaataattggggaaacttttgaattttgtgaaaatggaaaaaaggtattgagaaagactgtaccaacactagtgagaccttcctggacaattaaaaggcaaattatgtataatcagactgtcctgatgttaatttcaagttccctttcatcaccacagggctaactatgcttaactaaagtggttgtagttggttaaacaaagaagatagagctaatcctagttattccttcatggttctattttcactatcaaggtatatgtttaatgaacaattaaaattgctctaataatggattattcatcacctattatcagaaaaatatacaatgatatctgacagtattatagacatcatatttattgactcagtataattgaaattttaatgaactataaaaatctaaaatttttaattttaa

SEQ ID NO: 468389 - DNA, 587 bp, Homo sapiens
gcacacggtgcacgcaaccactgacctgtgcccactgtctggcactccctagtgagatgaacccgatcctttacgcatcaattccatcacttacttcccatgttgtgcttctacaaatagccatgtggcaaaatcacagcctccgattaagccagctgtccacgccgctgcaaggatgtgggcagctggacactgctggggaaaatcacaccaccaggctgaccaatgtcacatcatcagacacagctccccagtcctatctaggccctcaaggctgccgagatgcctaccaacaacctaaaatacacaaagcagttggcattgacttaatggtcagagtgtggctagtgaggaaattgctatcaaaggctggaaacatggcaatccattcatgtaatggcaaaacattcagtgaaattaatgcccatggttttttggggaagatctttgtacctaacaaacttgttgcaatagaagagaggtgaaggtgaatttttggtattattttttaatttcttgtttgttatattttatgtattcattgtgtgttttttttatttgagggtaccataaagcttgcaaatact

SEQ ID NO: 468390 - DNA, 480 bp, Homo sapiens
aaggattgaaatactacttatcagtagtatgctgattacctagatgataaaatcatctagctatggagttcatggagcagacccatgtcttagagatgctgacggctgcttgtggtggttcctgggtccagcagctttcctaggacatggctgcaagtccaagagcttcttcaggaacaccagcagggctggggaagcagccagaactaaggcagttgaggatactgcccaagttgccctccaaaaaaatacaccatttataaacacagtaattgaatatatcaaatttaaaatccacctacctttcaataccacagtaaaacaggaggatgcccaatcttctccatttgtctgggaccgaggggtttcctggggtgcagaactttcatgcaaaaccaagaaagtcattagcaaattgagacaagtcggttatcctacaggcaaggagaagacaagttaatgcaacaaatatttattaaa

SEQ ID NO: 468391 - DNA, 2636 bp, Homo sapiens
gaggacaagtcgacgagagatcccgagtacgtctacagtcagccttacgtttctgatgcccctggaagctgtttaatagattgtaatgaaaagacaaggaaaaaatcccagaaagaaacggaaggtttacattgtgaatatgtagcagagccggtaatggctcagtcaacgcaaaatgttgactataatcaattacaggaggtgatatatcctgaaacgttaaaattagaaggaaaaggtccagaattagttaaagaaaataagacccaaccgccagtagcttatcaatactggccgccggctgaacttcagtatcggccacccccagaaagtcagtatggatatccaggaatgcccccagcaccacagggcagggcgccataccctcagccacccactaggagacttaatcctacggcaccacctagtagacagggtagtgaattacatgaaattattgataaatcaagaaaggaaggagatactgaggcatggcaattcccagtaacgttagaaccgaagccacctggagaaggagcccaagagggagagcctcccacagttgaggccagatacaagtctttttcgataaaaatgctaaaagatatgaaagaaggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgggagcccccacaaaaaatccccacaggggtatatggccccctgcctgaggggactgtaggactaatcttgggaagatcaagtctaaatctaaaaggagttcaaattcatactagtgtggttgattcagactataaaggcaaaattcaattggttattagctcttcaattccttggagtgccattccaggagacaggattgctcaattattactcctgccatatattaagggtggaaatagtgaaataaaaagaataggagggcttgtaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcgtaggcacagcctcagaagtgtatcaaagtactgagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagatgggatatataccaggaaagggactagggaaaaatgaagatggcattaaaattccagttgaggctaaaataaatcaaaaaagagaaggaatagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgcc

SEQ ID NO: 468392 - DNA, 2061 bp, Homo sapiens
cagggccgaaagaacgaacatttgaagttctacaatgaacccatcagagatgcaaagaaaagcacctccgcggagacggagacaccgcaatcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcggccttgatgattgtatcaatggtggtaagtctccctatgcctgcaggagcagctgcagctaactatacctactgggcctatgtgcctttcccgcccttaattcgggcagtcacatggatggataatcctatagaagtatatgttaatgatagtgtatgggtacctggccccatagatgatcgctgccctgccaaacctgaggaagaagggatgatgataaatatttccattgggtatcgttatcctcctatttgcttagggacagcaccaggatgtttaatgcctgcagtccaaaactggttggtagaagtacctattgtcagtcccatcagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaatttggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaatagtaagtcctgtttctggtcctgaacatccagaattatggaggcttactgtggcctcacaccacattagaatttggtctggaaatcaaactttagaaacaagagatcgtaagccattttatactgtcgacctaaattccagtctaacagttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccgtgggaggcctcaccatccatccatattttgactgaagtattaaaaggtgttttaaatagatccaaaagattcatttttactttaattgcagtgattatgggattaattgcagtcacagctacgggtgctgtagcaggagttgcattgcactcttctgttcagtcagtaaactttgttaatgattggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcaaagcatcaaaagcccatttaaatttggtgccaggaactgaggcaattgcaggagttgctgatggcctcgcaaatcttaaccctgtcacttgggttaagaccattggaagtactacaattataaatctcatattaatccttgtgtgcctgttttgtctgttgttagtctgcaggtgtacccaacagctctgaagagacagcaaccatcgagaacgggccatgatgacgatggc

SEQ ID NO: 468393 - DNA, 723 bp, Homo sapiens
ctcatggctttctggctccctgatgtccacctgcaaggcggctggctgtctctttgtccgcctgcaaggcggctggctccattatgtggcttcttatttccctttctgtaaaatcccaagtcattgtaaggactgcttccatcaccaactccctgacttcgtcttctacctctctactcttcagtcactcaactctggtcacactggtctcctgctttctgaggactgcagcagggatttatcattctcaggaccttcatttttctttttcacgtgtatgacttgctccctcatattttatgggtctctgctcaaaatgtcaccttatcagagaggtcttcccttactacccaatgtaaataccataactcacgcaatcttccaaaactctctatctcccttacttggctttatttttcttttattcacttattctctgaggtattatatttccaactattcacttgttttctgtcttcttccgctggaaggtagtgagcattgtatccaataggtaggttttcaacccatgtgatatggtttggctgtgtccctactcaaatctcatcttgaaatgtaactcccacacttcccacatgtgggagggacctagtgggagagaaccctgactaatacaatgttctagaaaatattggcaatagcggtcaatgtaaatcctgtcccatcttttactagtaagcacttgaatatggttgttgtatt

SEQ ID NO: 468394 - DNA, 531 bp, Homo sapiens
ctataccctgcaaagccatagtgttggagctgcccaagaccataggaacccacctcttgcattagcatggcctggatgtgtatttattccgatgcctgtacccccactgtatcaaggagtctgtggccgaagggccaagagcccctggcaaaccactggtgtaaggccaaaagtccagaagctgaagaacttggagttcgagggcaggaagcatccagcacaggagaaaaatgaaggccggaagactcagcaagtctgcactttccaacttcttctgcctgctttattctatcggcactggcagctgattagatgctgcccacccacactgagggtgaagactagcctccatgagattccacaggaagctctggaacataaattgtactgcagagcctatttcaccctaaagcaaaggatcagagcttttgtacccactccccagtctgactttgaactaccaggcacaactgaagcagatgctggcaccatgcttcctgtacagcctgcagaaccatgagccaaattaaa

SEQ ID NO: 468395 - DNA, 1996 bp, Homo sapiens
gtggagaagcctcaaccggtcaccgcgcccgagggtgtgttgctgcctgtggctcaccgggctccagtgcttcgctttctaatcgagtgcccccaccctccgtcctaccccaacgacctccaatgctaaaccctggcagagcctggccgagggttcctcccctgcccgggccaggcccaggtgtctgggaggaggcagagagccggcagagggtggcagagctctagcctggtggctaagaggcgaaaacgcgtcctgtgctcatcgcaggggacaaagccgtgttccgagcccgggtgcaggggaacgccaaaccccacatctcctggaagagggagagcggcatccccatcaaggagtccgccaagatattctacgacagcattaacaaggaacacgtgctgaaggtgcgggggccaagcccaagtccagttaccgagaaggccagaggcagggacccccagggcgggccgccagtcttctcaccgatgagagccttaacggcggcccgagagccgggcagtgggaaaagcagctgtcattgcccgagaggcgcggcaggataagagaggccgagtcaggaaccgggatattgccggaatgagcagaggacccaaagtacccccggggcagagcagagcaggggcagagccagaacgtggcggggcgggacgcaatggaagcgaaggggcgtgtccacaaggcgagtgagccaaaaggaacgcgggaccaagacgaaagtctccctgtggttccttttccttcccccactaatggccggactttgatccagctggagccactgacttcggatgactctgacaactataagtgcattgcaagcaatgaccatgcagatgccatctataccgtatctctgctggtaacagaaggtcaagagaaaatggacttcaaaaagatgctgaagaagagggcaccccctgctcccaagaagaagcagaagaaggtggcaaatgagaaagagatgctggagattttgtccaaagtgcccaagaaagactttgagaaggtgtgcatggagtatggtttcaccgactttcgggggctgctcaggaagctcaaagagatgaagaagaaagtagaggtggaggccatccggattctgaagcccctggaagacaaagagaccaaggttgacaccacagtggtctttgactgcataatggaactgaaagaccccaaatgtcagatgatatggatcaagagggttggacatgcaccctccagcttaggctggcgctggggaatggagacctctggaagcttcctcctaaagcccttcatcagctttcctacctgttccatgaggcagggtactgagccactgaggatccagtactccctgggcaagtacgatgtgaagcagatgggcaccaagtacatgctggttattagcaacgtgaacatgaacgatgctggcatctacagcctgtccgtgggcgataagcggatgagtgcagagctcacagtgctggatgagccactgaagttcctgggagagatgaagcctgtgaaggtgacagagcgccagacagctgtgtttgagatccgcctctccaagaaagagcccaactttgtgtggaagttcaatgggaaggagctgaagagggatgacaagtatgaaatcacggtgtccgaagatggtctgacgcacacgcttaagattaaggatgccagactcagtgacagcggcgagttctctgctgaggcggggaacctggtacaaaaggcccagctcactattgaccaaggccagagtgaccggcatcaactggctgcatcggacatgatatagtgagatgatgtccgagctttaccaagaactaaaaggagttccgctttcaaagaatgagggagagtagagaacatccccagcagaggtaatactgctttcaaagaatgagggagagtagagaacatccccagcagaggtaatagcatgtataaatgtccagacattagaaagacaatgcag

SEQ ID NO: 468396 - DNA, 846 bp, Homo sapiens
cttatagtgccttttccaggcctgtccatggctacctgtgggccaatcagcatgcacttccttccttctcagcccataaagaccccaagctcagccagactcagacactccacaggacaaccagctgtggagaggagctgcccactccaaggtctcctctctgctaaaagctgggaagatgaccctccagacccactggatagcaggactgaaagagctgtaacacaaactggactgaaacatccctcttgttcgccacactgtgggcaacatgaaggagagaagagaggagagaagagctgtgacccttcagggagcccagacctaggagttccccaagctaggggcgtgacaccctctttgaggttccgtggttcctggcatctccaagcttccaggtaccaccgtgttccctggtaccctcagtggaagccatttgcagtggaagcccatgctggtgcctggagctgcctgccccactgcagccagtaggcctggctgtcccctcgctcattcatgcatcccttgccactctgtgcctggttttggatttctccctggttcaatattggtaggttatgtatgagtctaggaatttgtccatttcttctagattttcaaatttattggcatatagttgctcatgatagccactaatgatcttttgagtttctgcagggccaaaggatgctattcatatttatttcatatttatttggtgccaaattattattattttcaaatccttacatctgcaccttgaaagtaaactgcaatatccagcacagcattgtcagacagagctgctgtatggctattaagttcattactgcctggctaatactt

SEQ ID NO: 468397 - DNA, 745 bp, Homo sapiens
catcaccgtgggcctcgaacccgaaatggctctgctgaccgaacacctgctgaagccgctgcccgcggacaagcagatcgagactgggcccttcctcgaggcggtgtcccacctgccgcccttcttcgattgccttgggtccccagtgtttactcccatcaaggcagacataagcagcaacatcacaaaaatcaaagctgtgtacgacaccaacccagccaagttccggaccctgcagaacatcctggaggtggagaaagaaatgtatggagcagagcggctcaaagtaggggccacgctggcgctgatgtggctgaaaagaggcctccgcttcatccaggtcttcctccagagcatctgcaacgaggagccggacgagaaccacctcaacctcatccgcgtcaacgccaccaaggcctacgaaatggccctcatgaagtaccacggctggatcgtgcagatcttccaggcagcactgtacgcagcctcctgggcagaatgtgacggaggaggagtgcctggaaaagatccgcctcttcctagtcaactacatggcgaccatcgatgtcatctacgagacgtatacccagatgaacgctgagcttaactacaaggtctgaaaccaaccagcaagtctttgatgaccaagaggcatttctttcaaagctatagggcacaaacaattgaccatagaagactctgtttgcattcttctgcagaattatttccttcagggacagatttt

SEQ ID NO: 468398 - DNA, 495 bp, Homo sapiens
cagggcgagtccacagtgcaaagatgaagctctccactggcatcattttctgctccctggtcctgggtgtcagcagccaaggatggttaacattcctcaaggcagctggccaaggaatgagtgagcagagcttgactgccttggacagtcaggagagaggtaagctccttgcagagaagttagaggctgcagcccctcctcctcttgccctctctctgcctgtgtgcttagtgcgagggtctgagtggatggtagaaagtcctcccttggaaagcagagaatgggaaggtgggctgttgctcactggcctggtgattaatctccttgcttgcctggactacagcgatgccagagagaacgtccagagactcacaggagaccatgcagaggattcgctggctggccaggctaccaacaaatggggccagagtggcaaagaccccaatcacttccgacctgctggcctgccagagaaatactgagcttccttttcaa

SEQ ID NO: 468399 - DNA, 563 bp, Homo sapiens
aggaaaattatagtaaagactgagcttcaaatgggcttttggctccatgtaaagtttctaggggtagaaatggcctctaggaatactcagaagctgggccctggtatcttcacccccagtgggcacggcagcatcacagacacccatggcgggcagcaggagctccgctgccaggagactgtctccctggattctgactctctgaggtggcaacaatgtggaggaaggagggtgctgcccaccccctcccagagctggggatggttggtgctgggctactggaagtgggataaaggccctctgccaggactggtcactagggaccaactgctatacagtgaccccttcctggccctgttgttcagagaggcactgaagggcagcaccggaggcttctggcttgaggactggcaagatgagaggcatcttcccagaagagatgagcagggcggcagcaaggcaccggctcaggcgaagaagccctggggcaggtgcagaaggtggtagttcaaagaggcttctggagtcaggatggttggattgaagcccagttgcttaccagc

SEQ ID NO: 468400 - DNA, 1320 bp, Homo sapiens
gcgggcgatgctggcggtggcagtaggcgtgcggccggggcccgtgaccatgggcatcgccgagtccacgccggatgagctgccgtcggacgcagaggagcactgccagcggcgaccagcagctggagctgagcgggcggcggtttttgcggctgcccaagcagtgtgcgcgctgagccgcctgcagaagctgtatctgccggaggagatcgaggagctgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcaccgggcccccgcgcgtcgcggacaccgtgttcctcgtgggcgagggcgccgcggcgctggttcccgggctctgggcgcccccgggggcagcttccgcgccctggaagccgctccaggactgggcacctgagcctatgttctggctgatgggcttcagccactctgagaggaggggctctaggaagctttggctggccttcagctggtgccactgggccacgggctgccggggacgggcaatcatgtccttccagtgcttcacctcccctggcccgctcttccaggacagcctgatctattttcctggttgtctacccccacacccccaagcctgggcacgccaggcctctcggaattagactgccaacctattttgcagtggggtctggaaggtggggttggaggcagcttgtctccatggccttccctgccctatctgttgggtgatgtccagcccccctgaattataatcattcccaactcctgggcacttgctacatgtgagtactgagctagggacttcatacacatagatcatcaaatcctacaactgtgaggtaggattatatgattatctccatttttcagatggggaaactaaggtacgaagagttaagagacttacccacagtcacagggtttataagtggtgcagagggattgaaatccaggtctttggagctctatgctaccggcc

SEQ ID NO: 468401 - DNA, 620 bp, Homo sapiens
ctgtcccggttccgcgatccctggctctgggctcaggaggatgacgggaggggccccagcactccgagagctgggcgagttcaggtggccaggccctctccctcaccaaggcctctgggggagctgctgggctccttggttctgccagcctgagcgccagaatccaatcctgctctataataatcatcagagcagccggcagcacttactgagctccgagggactgccaggcccgggtgccaagtgcataacacgcattatcccgcttaatagtcacagaagtcccgttgtgatccccttaggaagcccccgggccttcgatggctccccatgcctgcagaaggagcagattgagcatcccgaacccccaaatctgaaatccaaaatgctccaaaattcaaaactttttgagtacccacatgactgacgctaaaaggaaatgctcgttggagcctttcggatttcagatttgggatgctcaacagataagaataacataaatattccccaaaaaatctgaaatccaaaacttgttttcgtttttgtttttgttttttctctgagacggagtttgctgttattgcctgggctggagtgcaatggtgcgacctcggcttacc

SEQ ID NO: 468402 - DNA, 563 bp, Homo sapiens
gtgtaaccacaacccagacccagcaaaagagcatgtcaggtctttttatgatgcttccagcacaaccccctgaagcctctctgtcttcctggctccatcatgaagtgtcagctgctggggtcactatgttgggtgccatccaagtggatgtggtcattttcatccctgccctggcgttctaaccccagtaatgtgaaggaaaaagaccagcaaagagaagcagctccacaaaacctgtttcagtgggttatgtttttattctacgttattggcttaagccacaggggccaggccgacctggttgtttgccctgtcgaagacggtaaagtactggcggatgaagacatcacccaggatccaaagctctccagattcggtggggacgttcatgccctggaagccactgatgcagctcccctcgctctggagaaaaggagaataaaagtggagctgggacaccgattcagccgtgataggcgctgggtgataaacatccagggagccctggtccagctgtaaggcacgtgcaaggaggagcttcctggctcagtgtccagggattc

SEQ ID NO: 468403 - DNA, 1402 bp, Homo sapiens
ggtatttacctcatagggttggaatgaggacaaaatcaggaggcatgggcaccaccacaggagtccagccctggcagacaagtgcaccccagaacacgacccagcccaagctcctggctccacaccagcacgagaagtcccagaagaagagcagccttcttaaggagctgggggccttccacatcaccatcgctctgctgcacctggtctttgggggctacctggcctctatagtcaagaaccttcacctggtggtgctgaagtcttggtatccattctggggggctgcctctaagatgttgtgcctgatgacaaacctcatcagcctcttttgcgtgctgtctggcctcttcgtcatctccaaggatctctttctggagagcccatttgagtccccgatctggagaatgtaccccaactccacggtccacatccagaggctggagctggccttgctctgcttcactgtcctagagctcttcctgccagtgcccacagctgtcacagcctggagaggggactgcccatctgcaaaggctccagtatttgaggaacttcttgcccgtttaatcctgcccttcacctttcccacagtgagtcccctgccctgctctggccagcagttctcgccctcagagaggtcaagtgccttgcctaaggtggcacagcagtcattgttgcgttctgcctggctccaatgggttctacggaaactccagggctttgtccttataatagtggggaggaggaaggaccacatccatggtgggctctgttgcccttttggctacacaatgctgctgaccaccctgggcctcattgccaccaaaaatcctgcaagactcctccaagaggagctcccagagaacaacagatcccctaccccccatctgtgggagaatgtggcttcgcgggctctgaagagaggaagggaaggaagaagggagccagggctcctcggcagcctcatttatctcggagtctgactcccctgtgagtccagagagccgtacgcgatgcagccaacccacctgccccagaggcatggctgctttctgggtggggcaaagagaaaagcctggaagagcatgtgtattatccatgtgtaccttcagtagtggcctctgcagccagtagagaaccccaccagcctcctctccttttcagaaatctcttgctccagccacacccaaaacctggcatccaccccgcaccgccacctccaaatgtcctaggtctccactcccctctgtctggttcttctgcttggaaatctggaagcccccatcccgccccatccccctcctcatccttccttcttatcctcaatacacaccttgttgtgtgtgtggtgccttgttgtggcctggctgtcatgtgtgctgtccaggtttttgttgtt

SEQ ID NO: 468404 - DNA, 621 bp, Homo sapiens
agggtgcgtctttttctccctttttcttattccaaggtgtagcctgtactcctagttcatcatcaggtcagcaagtcccacctgggtcccaaagactatcgttggggagtgggatgcttcctgtaaacagccacacactttacagctgcttcttctctccccgagcttcagagagtagagccgttcgaatgctgcactcctactgtggaatgctgagagtccccactggggcactgcccactagacccgtgagaagagggccaccattctccagacccaagaatggtaaatccactgacagcctctacaacgcacctggaaaagctgcaggcactcagcatcagcctatgaaaacagctgcagaggctttaccctgcagagccacaggggtggagctgcccaaggccttgggagcccacctcttgcatctgtgtaccccagatgtgagacatggagccaaaggagatcattttgaagctttagaatttaataacagccctactgggtttcagacttgcatgggacctgtggcccctttgttttggccaatttgtcccatttggaatgggaacatttacctaatgcttgtacccccattgtaccttggaagtaactaacttg

SEQ ID NO: 468405 - DNA, 659 bp, Homo sapiens
ttagaatcctctgcaagatgtgatgttgctcatagtagtgatgtactgggtgtatgagcaggcttattgtctcctttgggatcagacagggacctcgtccatctgcagaaatgctgatgtttcttgtatagagggagtgggactccactcctcatgcaatcctgaacccagagggcacacctcctatggtgatgctgtcacctcagaatgttccataaaagccttctacaggtgcacccttgccaagctcccatgggagaagctctggtggtgtcttcagtggtgggtgagagagataaaaagtccctttatgcaaaatggtgagagaaagctgaaacagccagctgagttccagacagttcatgctcagaatgcaaaacttcccaaccaagacagaaacagaaggatgtggcctgaaagccacatccttcccaatatgacctgcaaaacaggggcgcctaattttggacctgtagcaagagcatgctttcttcttgcctcttgaaagccagtcttcaagctctaagattctttcctctgctcggtttattttgttattaatacttgtgtttacattatgaaattcttgtagtgtctattttgtctgtcagctcttgcaatgttttattatgatttttagcttccttgcattgagttat

SEQ ID NO: 468406 - DNA, 696 bp, Homo sapiens
ttatcaactctctcccattggcggtagcgccagtgcctcggaaggcacccgttacttagcagacctggaaagggagtctccctttcccggggggagttaaagaagactctgctccaccatctcttggggaaggcctgacatgagtcaggcctgcccacagccatgcggaggcctaaccgtctccctgtgatgctgtgcttcagcggtcacgctcctggtccactttcatgttccaccctgtacacctggctctgccttctagatagcagtagcattattagtgaaagtattaaagtctttgatctttctgagaagagcatagaagaaataatgactggtttggaaaacactgtgactatggggtcgtggggaacacctgaccctcagcaggtgctagttttattcccagcgccagtgcaaatccaaccagggatccctacactcacgcgtgggccaacagagtgtgatctggcagtcaacttcctcaatttggggcctggcagccccgggagcccggtgggcgcttcctcggtggcgcccctcaccctgcctcgcggggttctaacgtccaagagcggggctgtccgagagacccgcgcggacacctgaggcgcggtggggctcccatggctccgcggagcctgcaggctcccaagacgagggtggggtggcggctgacaacaatgctgccctttg

SEQ ID NO: 468407 - DNA, 1506 bp, Homo sapiens
gcagggctcctgcctgctgtgtggagcacacagccctagttgtgcctccttgctgcagccgggatgatggcaggcgaactggagtggctgccaccatcaattgtaccacaatatagtcaaagaatggatatggcaaaatttcccagacatcagcatcatcttttaaatgcagttgaaatgagagatggggaaactgacaatgttaatgaatgggagatagaggtgaggatacacattgcgaatgaagacatgggcagtaacttctgcaacacaatcttggaactacttcagccccttgattattctggcttagagcaggagtcccagattaagcttccctacctgctgttgaagatgattctgaactgtttcctaagacagaaatgtactgatgtgttcttgttggatctttcagactttgacatatactgtactcttgattcacttcatgtcaaaattaaagcactgacagttgatgattgttcaaggtgggttgtgaaccaaaagcatgatagcaatagcagtttccttggctgaggacatttgcctcagggagtcatggctaagttaatcacagtccactgtatctttcttatgcctttgcgtcctcatagctcagttcccacatataagtgagaacatacaatgtttggtttgccattcctaagttagttcacttagaataatagtttccaatctcatccaagtcactgtgaatagtgttaattcattccttcttatggctgagtagtattccattatatatatatataacagtttctttatccactcgttgattgatgggcatttgggtttgttccgtgattttgtaattgcgaattgtgcggctataaacatgagtgtgcaagtatctttttcatataacagatcatctaattttaaaaacaaatatgcctttctgttcacttttacctaaatttgttccttttaaaaactttgaatgcttctttgaattctgtaaaaatttaactgtaatgtaattgatgaatctacttaaaatttattttgtaccctcaggttttaaaagtgaaggttatttttagatatctgctaatatttatctcaagaacattaccaaggcgatgactcatgcatatttcatgtgctgttgagcgagatgatagatcttcatcacaccctgcaatttcatttatccatccaaggtacttgtgtttggagagaacattaaatgtcatcctggaatgtctgtttaatgatgatactggtttctgttttaaaatgtgtcatcatacgtgttcattggatcttcaaccacctattttccaataaaattctgaaaacgagctgaaggggcactttcttaagcactaagttctgactagagctggatgcttttcattccacattctgtattgtttagtagaacaataatttatctctgcaaatattaggagatgcctgctatccttagacaaatagatcattattcatgtattaataattcttttaatatactgttgatat

SEQ ID NO: 468408 - DNA, 1547 bp, Homo sapiens
tgcctaagagaggaggttacctaggtctacatttctggccgtggggtgttctgatcagttaaactgctgaacattatgctaaggttggacattggatcaaatctgatctatggtgttctgttggtcataaggtttccaataatcttagtaatgagagggagagagaatgatagccgtcgtgaatgcagaaggtcagtgggacagcaccgctcactatcacatgaacttgaagacttggaaatccgtccaagagtgtcctatgttcagagggaggaagctctgcctcagagtttagaagatgtaaagggcctggggccaggaagatttccagaacagcaaaaatccaggactgaaaaagtcggctctagacacaaggtgctcaaggtcagtgacatgcatttgctctatcagagtgttacagaggcaagctccctggccagagctgcagctcaccagttcatgtggtatactgccacggaatttgtacagaagatgtttgtagagtgtactgaatcttggcttctggttgaaattagaggagcacctcttgtggaaaacctgcaacctaagcataatgagctgtctctaggaaatgggtgtcctgtaaccaggatgacgaatgatatctttgagttcacttatgctcttgagttttctggcatcatgaaatatgaatgcccatggggcattcttgttgagagtttcgtcaaatatcaaccagcgtttttgaatttcagaacttacatcccagtaagatgcgcccttgaaagaaagccttcctcatttgaacaaaatgtaatacagaataatactgataaatctaagaaaatagtccaaactcagtattatcaagcaggaaattggggtatcgaggaatgttacttaggtattccagaagaagacattgttatcacaggagatgacaactccttgtgtgttattgcccacgaagaccttccagtgggacaatatgtggagagggaagacggtgagattgaggatcctgaccctgcataggcctagactagtgcgtatatttgtttcttactgtttaagaaaaaagtttaaagagtaaaaaatgaaaagttttaaatatagaaaaaagcttatagaataaggatagaaagagtttttgtacagctgtacagtgtatgtgttttaagctaagctagctgttattacaaaatggtcaaaaagtaaaaaaaaataattttataaagtaataaagttaagctaaggttaattattgaagaaaaaattttaaaatgaatttacagtagcctaagtaatatatccttaagtaatgcatgtgtgtaagaggaaaattttaacacacctttcacagtaaatgatacagtgatacgttcacaattctttgggattttggcaatttggatgacacagttaacaaaattgacctagtgacatctatagatgaccatatcctgagtgtagaatatataatcttttaaatcttacatagatttacaaaaagttgacaagttttgtttcaaaggattgaaataatatactgtatgttttctgat

SEQ ID NO: 468409 - DNA, 768 bp, Homo sapiens
gggctcacaactctaacggggtgcgcctgagagggtcatgatcgattgagcaagcagcggctatgcttttcttttcgcgggaagcatagacagggaagctcaggagttcacctgtccttatgggcagtaagaagaaagatggtttaatagtgccaataacacaactacctgccgactcgtcagatgtccagactccaagtgcccgttccttcccggtgttcagccactgcattgatcctccacggggacctgccacacattgctctgacgaggcgtcccaccggggcagatgcctacccaagggtactctcaggatccacgtagctcgggctggagaattgacttacatgatcacaagggcagcctgcaagctgaggagccaggaagccagtccgggtcccaaaatctcagaagtagggaagctgataatgcgatttcagtctttggccgaaggcctgcgagcccctggcaaatcactagtgttaagtctaagaatccaaaaactgaagaacttggagtctgatgttcgagggcaggaagtatccaacaaaagaatttgagtccctctttcaaaatagcctccttttcctatgagaaagtacaaaatgaacttttcaggatgattctgtcatctccaagttcaatggatagcatgtctctaaggataagtgaatacagcaaaatttagttcagagaaccctgagggtccccaagaccttttcatggtccatgatatcaaaactattttcacaataatgctaaaacatt

SEQ ID NO: 468410 - DNA, 701 bp, Homo sapiens
catccagccacaactgggatcaaagaatatcacatatagctatgggagtggagccacttctaagagcctctattagggcaaagctgagtgggaatgcggagtcagagccaacacagagagtcccaattagggatatgcctagtggagccttgggagtggggctacctttgagatctcagaactataaggccactagcatgcaactccaacctaacagagctgaagcacggactgagtccagcaaagatatgggagcaggaaaggatcagctttataaaaaggatgaagcaccacacacaaggcctgaacgatcaaaggctgaagagatgctagactctggagtggagcacattggtggagggactggctgtcctgagcctccaagggccaccggctccctaggcctacatagcagctttggttcaccctttctctcagagctaatgtataaaaccaagctgcaccctgaccaccttgggcacatgttccgaggatctcctgatggctgtgtcacaggccatggtcactcatatttggctgtgacagtttttcgtaccttctttgtgttttataactttgagagttctgaggagtactggtgacgtgttttgtagaaactccctcaactggaagttacctgatatttttctcatgattagactgatgtttgggttttgtggaaggagatcacagatataaag

SEQ ID NO: 468411 - DNA, 805 bp, Homo sapiens
ggcttgccaccgagcttcccgctgctgcagctgaggcaagcggggagccgccgccaacacagcgtgctaccgcccggaagcgcttccacacgcgcctcaagctgcctcccggaagtccccgcgcccgcgcttcggctgcttcacggaagtccttgctcctttggctgcctgcggatgtcctcgcgcttgccagcctttgtcacccaagcagtgccttctagccccttttctgtagggctgctgcaatttactgggggtctgctccagaccctagtcaccttggtttttccagtacctggaggtatcaccagtgaaggctatgaaaccattgaggatctgtttaaagaagcagtctggctgcattttggtagaacagttgtgctgtgttgggggatcccttcagccgctgatcagtttgggctctctaagaactgcaggctggatcagctgaggtgtatagcagcaaaggtaatggccctccttgccctccaggcactccatcccagggagaaattaaaacctctgttcactgtagaacactggtgggggatagctggaggccccagctgggaggacctgcccagtgaggaagaatggatcagggttttacttaaagaaccagtctggccatgcactgaaaaaacagctgtgctgtgctggggaaccacctatgcctcagttgacttggaccctccaaatcctgcaggctggaatagccaagttgcccaaacagctaaggtggcagcctgccccgcctcccaggtactccgtcccagggagaaatcaaaactctgtccatagaata

SEQ ID NO: 468412 - DNA, 520 bp, Homo sapiens
gcggggtttcatgtggtcatcacatcctccagggccactgcgtgtcttcgagcaccagcattctgaagtcagggatggggtcttcctcatgggctgtcagcgacttactaggaaggctcaaggtctcattaacttagagccagatctggatgaggtgaccctgtgtacttctggcttacagcagcaccaccatggggcaggcagacgcccaagactgtggcagatgcagcccatggccaagggtgacagtggccagcctggagctggtggcttcacctccttgactttccacttcggcgtctgtaagctggggatactgataaccacaggcttgccggcagtgcgggggatgcaatccgtgcccaccaacagccagcgcttgcaaagtctgttggcccactggggacttatggcagctcatgcagcggaaactgctctggtcatcgccatttatagatgaggaaactgaggcacggccagttgcacaaacctgctcaagggctcctggatggtggggcct

SEQ ID NO: 468413 - DNA, 567 bp, Homo sapiens
tgatggtgatggtaatgctgatgaaggacgtgatgatgatgatgacagagatgattatgatgatgatggtgatgatagtgatgatgatggtgatggcgattatgatggtgatggtgataaaaacaatgatggttgatgatgatggtggtggtgatgacagtgatgatggtgatgtgatgatgatggtgatgatgataatgatgatgatgaaggtggtgatggtgcttatgatggtgatgaaagcaatgatggttgatgatggtgatgatgatagtgatgcaatgatggctggcgatgatggtgatggtgattatgatggtgatagtgatgatggtgacgatgatgaaggtggtgatggtgatcatgatggtgatggtgatgaaagcaatgatggttgatgatggtggtgatgatggtgatggtgcagattgtgacgatgatgatgatgatggtggtggtggtgacagtgattatgatgatgaaagctatgatggttgatgatggtaatgatggtggtggtggtgataatgatggtggtggttgaggtgacaatggcagtagaggaat

SEQ ID NO: 468414 - DNA, 1068 bp, Homo sapiens
aggtcgtagttccgcccaacacggtgcaactgtcacagacaggcaccacagacagacagacaggcaccaatcctttccccaggactcagctttcaggattttggcattcagattttaatctgacgattatgattgacaccaaatacaacaatacctcaaaaaaggcatatgaatggaatgctgaaaaaaggatccaggccccctcaaaaaaggcatatgaatggaatggcgaaaaaaggatccaggcccgagcgcggctcatgctcaaatcctgtctaatgcacaaaccacatttgcttgctttcgaatcgttgcttattacttatatgtggggggggaaaagaaagcagcaggcattgaaaacactccagaggttccagaggtggctgtttccagagacacttctggtcctgacatgctggggtctcgtcaccagggctgtgctgggggccccaagctctctgaaggtgtgctttctgggtcatgaggtgggggccccacagatattggtcatctgtggagggtagcagagcagccccagggcgccatcgatgctggcaggggaggactgcccgagggcctctacaggccaggccagggtgcagccacttcaaaatccctgaaagcaaatgtggaaccttgagtgagtgtccggttggaaaatgaccacagccttgtcctgagctgggcccttctcctatcactgccacactggggacccaatttcaagacgagttttggtggagacagaccacatccaaaccaccctctctgaccctctcctggtgccaagctctctggccagggagtaaaggggcccccactcttgcacttgccaagggtggagacaagggtaggctggcaagagcagtttagcgaggacagagtgagggaaggggtaattatttcctaccttggaaactctgtgtcccaccccagctgcaccacggccgggccaggccgggcctgcagcttctggtccttgccttgacctcctcaggatgggaggtggactccagagaaggccttgcccagtgcccatccccgtccttcttccttcctagtgga

SEQ ID NO: 468415 - DNA, 1087 bp, Homo sapiens
tccgttatcagagtctttcgtgagcacgaaggagtcaagattaaagaatgtgtttgtttaccctggactgcattactatggaaaatgaaccaaggcctggatagtgacaatgacagtgattacaagagggatgtagtagaaggttcaaaggagcggcacatgattggccatctgctgccagaaacttcctatggcattaaaatgcagtgcttcagtgaaggagaagaaagtgagtttatcaatgtggtgatctgcgagagtaaagtaaaacgtgttcctggagcttctgagtatcctaaaggcttgagtatccctctgaattcttcaggaagtgaaggaaatgtgaggccagcaaccagccctgccagaagcagtgacatattgaccctctggaatgtgttaactgtcaaaattgttgaaacaacaatagctgtttcatcaaaaccaacggcactttcagcagtagcccttttcctgtggtctctagggtggcactttgtcctcagtatggtgtgggaatcaggccctcagtcaaatgaagatgcccatatgcctggcttctgcatccccgattgtggccagttgcctcacgagaaaatcaagaacaatgtggaaccaatctctactcagcatacttgctgtcaggataatagaaacaatgtcagctctaatacacagaagatccagaagagttcagcagaggagacagctgtgtctcttcagaaatggacagcaacattttacattggaatcctcttatttttgccacctatctcagaggactgtgctgaaaagacaacatggcctccgcctggtgttcctttagacagcccctcagaggtcctccagcagccccaggaaactggaggatgtgcaaaaaaccagtcacgttctgacttcaagtctgtaaccaactgcacaaaacaggcctgtgaatgaactatgtgaaggactttaattccaattagagaaaatcattatttatttctttgtagtataatgtcatatgaatgcatcttgaaatgtgtgcccttttatattatttatgccttaaaagttttcttacccattcctttcttcctctcag

SEQ ID NO: 468416 - DNA, 1222 bp, Homo sapiens
agtgaatttttaatgtcattcaaagggtacatctttctatacttctgctgctcctgggagctttgctccatctctcatccagctcagactgttgctgggcctgatagtctttgcatagtcaaggtggttcttgaagaactcttgtctgcacgaggatttgggagacatggtggcaagaaacttaaccaactcaacctgcttccttgcaggagtgaatccgtgctgctgcacatgccccagcctgtgaatccagagctcactatagggcccatcacaggaccggtggacaggctcaaccacttccgagactttccaaagaggccccttactgcttataatcgcttcttcgtggagagttggctccagtactcccaaatgtaccctgggatgagaagccaggaactgaccaaaatcctgtcaaagaaatacaaggaactcccagagcagatgaaacagaaatatattcaggatttccagaaggcaaagcaagaatttgaggaaaaacttgctcgattcagtgaagaacaccctgatttagtccagaaggccaagaaatctggtgtctccaagaggactcaaaacaaagtgcaaaagaaggttcagaaaaatattgaagaagtgaggtctcttccaaaaacggatcgatttttcaagaaggtaaaatttcatggagagcctcagaaaccccccatgaatggataccacaagtttcaccaagattcctggtcaagtaaagagctgcaacatttgtcagtgagggagcgcatggtagagattggcagacgctggcaacgcatcccgcagagccagaaggatcattttaagagccaggctgaggagctgcagaagcaatacaaggtgaaattggatctctggctcaagactttgtcacctgaaaattatgctgcatacaaagaatcgacctatgctaaggtatacagaaaggcctctaggccagatggcggtgtttctacattatgaatgtggcatgataagctttgtttatatggccaacaattttctcatttgtagcctgttctttcccttacactcttacacctttcttttgctttggactcacggaatcagagatagaaaatacagaatactcagaagcctcattgcattttaataaaattccaaatttatttagttcttagaaagttttaaaatacatgtgcattaaaatatccttattatcagaaatacctatattttgatc

SEQ ID NO: 468417 - DNA, 1019 bp, Homo sapiens
caagaatcttaacctgacaaacatgaattctggaatcttacaggtctttcagagggaactcatctgccccatctgcatgaactacttcatagacccggtcaccatagactgtgggcacagcttttgcaggccttgtttctacctcaactggaaagacagcccatttcttgtccagtgctctgaatgcacaaagtcaacagggcagataaacctcaaaaccaacattcatttcaagaagatggcttctcttgctagaaaagtcagtctctggctattcctgagctctgaggagcaaatgtgtggcactcacagggagacaaagaagatgttctgtgaagtggacaggagcctgctctgtttgctgtgctccagctctcaggagcaccgggatcacagacactgtcccattgagtcggctgctgaggaacaccaggagaagcttttacagaaaatgcagtctttgtgggaaaaagcttgtgaaaatcacagaaacctgaatgtggaaaccaccagaaccagatgctggaagaagatgcctgcatttcaccatgaagaagaaaaacataatttggagatgctgaaaaagaaggggaaagatatttttcatcgacttcatttaagtaaagccaaaatggctcataggagggagattttaagaggaatgtatgaggagctgaacgaaatgtgccataaaccagatgtggagctacttcaggccaaaggtccctcctactttatccaccagccacaaaactttgtggaatggtcaaggagtgagtccgtgctgctgcacatgccccagcctctgaatccagagctcagtgcagggcccatcactggactgagggacaggctcaaccaattccgagaagttacaagcaaaactttttatgactttacatttgctggtaaagtaacttcttgatagacaattatttttttcttatttacacgtctatgcatgttttctcttttttttgcagtgcatattactctgcatcatgaagaagccaacagtg

SEQ ID NO: 468418 - DNA, 1744 bp, Homo sapiens
tctggaaaattctgcttgattggtcgctgcaagggggtatgaaattatcaggatgtggacactgcattatttgaaacttttcatcaacccagaccccaaaatgacatgttgctctttcttcctcagaaacatgaattctggaatcttgcaagaattccagatggaactcacctgccccatctgcatgaaatacttcatagacccggtcaccgtagactgtgggcacagcttttgcaggccctgtttctacttcaagtggcaagacatcccaatttttactcagtgctttgaatgcatgaagacaacatggcagagaaacctcaaaactaacattcatttgaagaagatggcttcccttgccagaaaagtcagtctctggctattcctgagctctgaggagcaaatgtgtggcactcacagggagacaaagaagatgttctgtgaagtggacaagagtctgctctgtctgctgtgctccagctctcaggagcaccggtatcacagacaccgtcccgttgagtgggctgctgaggaacaccggtatagccccgccaagggattctaccaggccaaaggtccctcctactttatccaccagccacaaaactctgtggaatggtcaagaaacatgaattctggaatcttgcaagtcttccagagggaactcatctgtcccatctgcatgaactacttcatagacccagtcaccatagactgtgggcacagcttttgccggccctgtttctacctcaactggcaagacatggcagttcttgctcagtgctctaaatgcaagaagacaacacggcagagaaacctcaaaactaacatttgtttgaagaacatggcttccattgccagaaaagccagcctccggcaattccttagctctgaggagcaaatatgtgggacgcacagagagacaaaggagatgttctgtgaagtggacaagagcctgctctgtttgctgtgctccaactctcaggagcaccggaatcacagacactgtcccactgagtgggctgctgaggaacgccgggattatgtgagtttaaggatagaagcaatcagagctgaatatcataagatggttgcatttttccatgaagaagagcaacgtcacttggagaggctgcaaaaggagggcgaggacatttttcagcaactcaatgaaagcaaagccagaatggaacattccagggagcttttaagaggaatgtatgaggatctgaggcaaatgtgccataaagcagttgtggagctattccagaccgaaggtccctcctactttatccaccagcaacaaaactatgtggaatggccaaggtatgagtccctgctgctgcaagtgtctgagcctgtgaatccagagttcagtgcagggcccatcattggactgatggacaggctcaagggattcagagagtggcctagaataaacttggatggcagagtcaatgatgagattagctgtggaaatgggaaaccgttttttggaggacagtagtaatgctgtgaacttgtgaaaacaaccaagtattcagtagcaactataatgtgtctccataacgttattttacagatgcgcatctgaaatctgaaatttgggagaacatactactagtgttcgctagtgagaaaatacagctggaaggaagaagggagggaagacgaaggagagagaaacagaacgcatttgagagaaaatgctatttagactaaaatagaatactgcagatagcac

SEQ ID NO: 468419 - DNA, 574 bp, Homo sapiens
gcagcagggatagccggcttggaaagtcatgcctgggagaccatgtgacactgcctggctgggtcctgggctgacagagccccttcctgggagcattctagaaagacagcgtggaaacgcgcgcggcctggtggtcccggtagcggccatggtgctcagccccgcggcctcaccctgccctctaactccggcggcaggcgcttttcctgcaccttggcctggcgcttcttctcggcctcctccgcctccggtttctcctccttggccaccttgtaaggccacttgggtgtccgcaggtggccggtgtccgcaggtggccactgtccttggtgctgcccttccgcgccggcctctggggctggaaggatattatgaattttgtgacagggtgtatatgccctgtgacattcagagtaacgttttcctacaatattacaaaggatattaaagggtgtacaggacctgtgatttacgagtaagatttccatagaatattacactgtgtgtacaccccgtgtgacattaggagtaacatcccacaaaacgataacgaataatttcacaaggtgtacac

SEQ ID NO: 468420 - DNA, 1046 bp, Homo sapiens
gggcggtgcaagatgcgctttgttaaacagatgcttgaaggcagcatgctcctaaagaacaccaaaagctcaattccaagagtcccccacgtgaacctcccaataatatttgccagatgtgaaagcctgagccccccatacaagaaaacattcagattttgcagtgatatcgggatcttcttgagggtcacatccaacattcatgcttctcaaatctccatgcaggaagatatgactattggctctttcaggctgcacatgaagggagaggaggcctacagagtctatgctctgagaggcattacttacccggcgttcctctgcagcccactcaatgggacagtgtctgtgattccggtgctcctgagagttggagcacagcaaacagagcaggctcttgtccacttcacagaacattttctttgtctctccgtgcatcccacttatttgctcctcagatctaaggaattgccagaggctagcttttctaacaaaggaagccatattcttcaaacaaatgtcagttttgaggtttctctgccgtgttgtcttcttgcatatagagcgctgagcaagaactgccatgtcttgccagttgaggtagaaacagggccggcaaaagctgtgcccacattctatggtgactgggtctatgaagtagttcatgcagatgggacaggatctgcaagtggatatttggagcgctttgtggcctctgttagaaaagcaagtattttcacaaaagatatagacggaagcattctcagaaacttctttgtgataattgcattcaactcacagagttgacttgaatctatttggaaatgattgtgtgtgttctgaggtaggaatcaatatttagttatttttaaaaattcaattaatccagcattgttctgagcaccttgtgtatttcaatgtagaagagcacactaataatgcaggattatttatctatgtggtgagaattccaaaatgaagcccagcatggaaggtcaaataatattaactcacaggatagattagtaaaatgaaatgtgatgggt

SEQ ID NO: 468421 - DNA, 620 bp, Homo sapiens
tggctgggtcccagccagcagcaccatgctggtggctggaggcttgcgcggggggccgaggctctgtctgggaaagtctgttgcgctatatttcccaaaaacaatacaagattatctaatatacctacaggttgtacatcagattcatttattctacattactgcacctttacaacttttgcccttcatttacctattttcttcccaccaatgtaaccacctttttgaatgcatgaaacttataaaaatagatttcaaatatgagtgggaccatgagatgcagcagtctccccagaaccctgctatttcagacaaagatgtcaggggagtctgccaagaagtggaactcagaatttcatttccaaatattctcaaggccataaggctaaggaaccttacacatgtggggcagaaaaaaagaaagatcagactgaattctgactcagactctcccactatgctttaaaatttggaaactgtaaatagaaattaattccgaaaaggaagtaataatttttgaataatcaaatttgtggattcaaaggattctcatgaactgtcttttaaataggaatagtgatttttatttattttatggctgtaggtgttataactgcagg

SEQ ID NO: 468422 - DNA, 1892 bp, Homo sapiens
tgccaaggacctacgtcttggaaattccatgaggtgatctgcaggcgacatcaaggccggtctagccattgtggtcagctcctacgtcttctcaatgctcaccccctgccgcaccaaagtctgcagcagccccatgcctccaatacgacctcctctaggacgccctcctccagtacgctctccacgccctggacgccgtgctcctcctcctcctggaaagtgtagaaagagtcgtcccaggtgatgctgcgggtgtcgggcagactggagaagtcctggaactctttgcagtcagcgcggtcctcctcgacctgtgtgcctaggagtggggacggcggtggcagggtcacgcagcgctccccgccaccctgtggctgggtcccagccagcagcaccatgccgggggcctgaggcgtgggcggggggcttaggctctgtcaggagggaaagtctgatctacaaaaagagtatttcaaaactgctctatcaacaagaaagttcaactatgtgagttgaatgtactcatcacaaagaagtttctgaaaatgcttctgtctagcttttatgtgaagatattcctgtttccaacgaatgcctcaaaacggtcccaatatccacttgcagattctacaaaaagagtgtttcaaaactgctctatcaaagggaacgttcaactctattccacaaaaagcgtttcaaaactgctctatgtaaagtttttatatgaagatattcccgtttccaccgaaggcctccaagctgtccaaatatccacttgcagattctacagaaagagtgtttcaaaactcctctatgaaaaggtgaagatattcctttttccaccaaaggcctcaaagaacttcaaatatcctcttgcagattgtacaaaaagagtgtttcaaaactgctctatgaaaaagtgtgttcaactcagggagttgaatacaatcttcagaaagaagtttctgagaatgcttctgtctagtttttatgtgaagatacttccttttcgaccatagccctcaaagcactcaaaatgtccacttgcagattccacaaaagagtgtttcaaaactgctctatcaaagaaaaattcaactctgtgagttgaatgaacacaccacaaagaagttcctgagaatgcttctgtctagtttttatgtgaagatatccccgtttcaaacataggcctcaaagcgttccaaatatccacttgctgattctagaaaaagagtgttttaaaatagctctattaaaacgaaggttcaactctgtgagttcaatgcacacatcacaaaaatgtttctgagaatgcttctgtcaaattttcatctgaagatattccagtttccaacgaaggcctcaaagcagtcctaatatccactttcagaatctacaaaaagagtgtttcaaaactgctctatgaaaaacaagtttcaacccagtgagttgaatgcacacatattaaagaatttcctgagaatgcctttttctactttttatgtgaagatattccatttctagtgaaggcctcatagcagtccaaatatccacttggagattctacaaaaagagtgtttcaaaaatgctctgtcaaaaggaagcttcaactccgtgagttgaatgcatacataacaaaaaagtttctgagaatgcttctttctaattttcatgtgaagatattcccgtttcaaacgcaggcctcaaagttctccaaatatcaccttgcagattctacaaaaagagtgtctcaaagctgctttatgaaaaggtaggttcaactctgtgagttgaatgcaatcatcccaaagaagtttctgagaaagcttctgtctagtttttatgtgaagatatccctctttcaatcgaaggcctcaaagcattccaaatat

SEQ ID NO: 468423 - DNA, 1954 bp, Homo sapiens
gtcacttaccccttctttggcacctttttggtgggtcagaggtctttctcctgttggtgatggcctatgaccgctatgtggccatctgtaagcccttgcattatttggttatcatgagacaatgggtgtgtgttttgctgctggtagtgtcctgggttggaggatttctgcaatcagtatttcaacttagcattatttatgggctcccattctgtggccccaatgtcattgatcattttttctgtgacatgtatcccttattgaaactggcctgcactgacacccatgttattggcctcttagtggtggccaatggaggactgtcttgcactattgcgtttctgctcttactcatctcttatggtgtcatcctgcactctctaaagaaacttagtcagaaagggaggcaaaaagcccactcaacctgcagttcccacatcactgtggttgtcttcttctttgttccttgtatttttatgtgtgctagacctgctaggaccttctccattgacaaatcagtgagtgtgttttatacagtcataaccccaatgctgaaccccttaatctacactctgagaaattctgagatgacaagtgctatgaagaagctttagagcagagacctcatatcaagtagtacataagtgagttacccaccaggaagagagccatttgactttacagccctctccttgggacccaggagttttttaaaatctgatgccatattccctttcttcaaagcatttacaattattattaaagaatgaacaatatgattgtgttaatagtaacagtctacctctctgctagaatgtaagatctgtaatgtcttgttttccattttatctgtaaagacgtaatgcataaaacaaggagtcaataatatgtagtgaattagttaagaaattttagagttacaatgatttttaatcaagttattcctgtatgtttttgcctttctttctgagacttaatttcatttttagttagattcttgtcctttaagttcattcttcttcttatactatttaaaatagttaatggtataatttatatcaatgcagtccttttcatccaattgaacttgtactgtatacagatttttaatgtaatatttctaccttttaaaagaaaaattgaaagccaaatggataatcataaatagcaaaaatggaaactgtacaaaataatataaaatgagaaataaatctcttgtccatatctgagtgcagtctcctagttctcttcatcagaggaagtcactattatctgtttcttaagatgtttcaggtaataatcttcaaatgtaaatatatgtgtgtgattttatctatgtacagaagcttgctacttcacatagaagggagctagggcctaggatgtgggcttcataactcttcccagtcccctatcctactgtggtcagttagttgcatccaggatgcaagacaaagccctctttactcttcacaattcactctcctctcctcaagcagaaggaaggagtcacttttgttgctgcaagctgcactgcctggggtcaggggaggggtggcacaagcacttccttggcagccctggctggtgtctccataggtcatgtgctcccctattgcactggctctaagtccaacccagcactaggacttgcctaggaattgcaggccttgtgtcctaggctgcctttgaagtttacctaagagcccagagcactttagcccacagtggtgagacttgccaagaaattctagttttgacttctgtgatgagtgattcccctctgtctagagctggtccaaatgcagtctccatgggtgggtgacagttgagctcagcatggctttgctctctgctgtgacaagctttcttgcaatttctaaatatttatttttcctaataaaccttaggactgttttgtaaagcttgaatacttttcataaaattatattta

SEQ ID NO: 468424 - DNA, 6418 bp, Homo sapiens
ggggtgtacaaacaaggaatacagatcataggcacgtgtatatgcctataatgaaaaagaaaatatcttcagatacaaaccagaaagaagctttcagttttgaaactctgtttttgtacattctgcaaatggaaatttggaagctcattgatgccattggtgaaaaagcaaatatccacagagaaaaactaaaaggaatctatcagagaaaccagtctgtgatgtgtgcattccctggcagaggccattggagaaaaagcgaattgaggccattggagaaaaagcgaatttcccaggataaaaacttgaaggaagcaatcgagaaactgctttgtgatgtgtgctttcatctcacagagaatgaacgagccttcattgccatggcacatttatataaaaagaaagggagagatgttgtgggaattaagggacaccgagtggagggaccagcggaagccatggcagaagaacttaaattgtgaagattccatggacagattttagttccccaaattaatacttttataattttttatgcctgtctttactgcaatcgctgaacataaattgtgaagatttcatggacacttatcacttccccaatcacttggaaatagagttttgatagaatctgcaaagggatatttgggaatgcattatgcctatggtgaaaaataatatattttcaggtaataacaagaaagatgtttactgagaaactgctttgtgatgtgtgctttcatctcacagagttaaacaattcttttgattcagccaagtgaaaacaccatttttgtagaatctgtgaaggggcatttgcaagcacatttaaaccttttgtgaaaaataaaatatattctgataaaaactggaaagaaactttctgagaaacggctttgtgatgtgtgcattcatctcacagagttaaatctttctttggattcagcagtttggaaaaactgtttttgtccattttgtgaaaggacatttggaactcattgacgaaatggagaaaaagcaaatatcccatggtaaaagctagaagaaaactatctgagaaactgctttgtgatgtgtgcatttatctgacagagttaaacctttctcttcattcagcagtttagaaacactgtttttgtacaatgtgggaagggacagttgggaatgcattgaggtcaacggtgaaaaagaaaatttcttcagataaaaaatagaaagaagcattctgagaaactgctttgtgatgtgtgctttcatctgacagagtgaaacctttcttttgattcagcagtttggaaacacggtttttgtagaatctccaaaggtgaatttggcaggtcattcacaccaatggcaaaaaagggaatatcctgagatataaactataacaaaactgtctgacaaactgcattgtaatgtgtgcattcatctcacagagttaaagctttcttttgtttcagtagtttggaaacactgtttttgtacattctgtgaatggacatttgggagcgtgttgaggcctacaatgagaaggaagataacttctgataaaactagaaagaagctttctgagaaagtgttttctgatgtgtgcattcaactcacaggttttaaactttctcttgattcagcaataaggaaaagctgattttgtagaatctccaaagggatatttgggagcgcattgtggcccatggtgaaaaagaaaatatcttcagataaaaactacagagaagttttctgagaaactgctttgtcatgcgtgtattcatctctcagttttaaaccttttttgattcagcattttggaaacacttcttttgtccattctgcgaatggacatttgaaagagcattgaggacattggccaaaaagtgaatatcccaggataaaaacaaaagtaatctatcagagaaaatgctttgttatgtgtgcattcctcttgcggagttaaaccttttttttcattcagcagggtggaaacactgtttttctagattctgtgaaaggataattttgagtgcattgaggcctatcttgaaaaaggaagtagcttcaggtaatgctagaaagaagctttctgaagaactgttttgtgatgtgtgccttcatctcacagatttaaaactttctttttattcagcagtttggaaacactatttttattcattgttggaaaggacaactgggaactcattgaggccaaatgcgaaaaagagaacatccatggaaaaaaactagaaggaagctatctgagaaaccactttgtaatgtgtgcaatcatctcacagaatgaaacctttcttgtcattcagcagtttggaaaaaatgtttttgaagaatctgtgaatggacatttgggagtgcattgaaacctatggtgaaaaagaaagtatcttttgataaaaactagaaagaagccttctgagaaactgatctgtgatgtgtgcattcctctcacttagttaaaacacacttttattcagctatttggaaacactgtttttgtagaatttgtgaagggatatttgagagtgcattgagggctatggtgaaaaataaaatatctttagataaaaacaagaaagaagctttctgagaaactgctttgtgaagtgtgcactcacctcaccgagttaaacctttctttggattcagcagtttggaaacaatgtttttgtccatcctccaaaaagacatttgggagctcgttgaggacaaaggcaaaaaagcaaatatcccagtgtaaaaactagaaagaagctatctgagaaactgcctggtcatgtgtgcattcatctcacagatttaacgttacttttctttcagcagttttgaaacaccatttttgtagaatctgtgaagggatttttgggagcacattgaggcctatggtgaaaaagcaaatatctcctgataaaaaccataaagaaagtttctaaataaatgctttgtgatgtgtgcattcatcccaaaaataaacatttctttttattcagcagtttggaaacactgtttttgtccattatatgaacaggtatttgggagctcattctagccaatggcaacaaagtgaatatccctggataaaacctagaaggaagctatctgagaaaccgttttgtgatgcgggcattcaccccacagagtgaaatcattcttttcattcagcagtttggaaacactgtttttgtaggatctgtgaagtgatattttgtagctcactgatgcttatggtgaaaaagaaaatatctcctgataaaaactagaaagaagccttctgagaaactgatctgtgatgtgcgcattcatctcacttagttaaaacacacttttattcagctgtttggaaacactgtttttgtagaatttgtgaagggatatttgagagtgcattgagggctatggtgaaaaataaaatatctgtagataaaaacaagaaagaagctttctgagaaactgctttgtgacgtgtgcactcacctcaccgagttaaacctttctttggattcagcagtttggaaacaatgtttttgtccatcctccaaaaagacatttgggagctcattgaggacaaaggcaaaaaagaaaatatcccagtattttaacctttctttgtgttcaagaatttggaaacactgtttttgtacattctgtgaagggacattttggaggttattgaggccaaaggagaaatagcgaatatcccaggagaaaaactagtaggaagctatctggaaatcactttgcaatgcgtgcatttatgtcacagagttaaacttttcttttcattcagcagcttgaaaatgctgttttggtagaatctgtaaaggtatatttggaagcacattgtgactttggtgaacaatgaaatatcttcagataaagactaacaagaagcttactgagaaacagctttgttgtatgtgcattaatctcacagagttaaatatttttgttcattcagcagtttggaaacactgttttagtggaatctgtgaagttatacttcggagcacattgaggcctatggtcaaagaggaaatatattcagataaaaactagaaagaagatttctgagaaacttctttgtgatgtgtgcattcatctcatagagttaaaccttttattggattcagcagtttggaaacattgtttttctccattctgcgaatggacattttagagttcatagaggccaatggtgaaaaagtgaatattccaggacaataactagaaggaagttacctgaaaaaccactttgtgatatgtgcattcattatgcagggttaagcctttcttttcattcagcagtttggaaacactgtttctgtagaatctgcaaagggatatttgggaatgcattgagtcctacggtgaaaaattatcttcagataaaaacgagaaggaagctttctgagaaactgctttgtgatgtgtgcattcatctcacagcgttaaaactttccttggattcaccagtttggaaacactgtttttgtagaatctatgaaggggtatttggcagctcattgaggtcaaaggcaaaaaagtgacatccgaggataaaaactagaaagaagctttctgagcaacagctttgtgatgtgtgcattcatctaatagtgttaaacgtttcattggattcatcagtttggagacacttttttaaccattctgagaatggacatttgggagctcattgaggccaattgtgaaaaaacgaatatcccacattaaaaactagaaggaagctatttgagaaactggtatgtgttgtgtgcattcgtctcatagagttaagcttgtattttcattcagcagtttggaaacactgtttttgagaatctgcggatggatattttggagcaatttgaagcctatgttgaaaaagaaaatatcttcaaataaaaactggaaagaaactttctgagaaattgctttgtgatgtgtgcattcatctcatagtattagacctttcttttgattcagcagtttggaaacactgtttttgtagaatctgcaattgaatattgggtagctcattgagaccaaaggggaagaagtgaatatctgactgaaaaaactagaaggaagctatctgagaaacaactttgtgatgtgtgcattcgtctcacagagttaaaactttcttttcattcagcagtttggaaacactgtttttgtagaatctgtgaatggatatttgagagcgcattgattcatatagtgaaaaaggaaatattttcagataaaaactagaaagaagctttctgagaaactgctttgtgatgtgtgcattcatctcacagagttaaacctttctttggattcagcagtttggaatcacagttttttccatttgttgaatggacatttggaaggaatttgaggccagtggtgaaaaagcaaatatcccaatagaaaaactagaagagagctatctgagaaactgcatggtgatgtgtgaattcatctcggtgagttaaacctttctttttattcagcagtttgcaaacagtgttttgtagaaactgtaaagggatatttgggagcgtattgaagcctaaggtgaaaaagtaaatatcttcagataaaaactggaatgaaggtttctgagaaagtgctttgtgatatgtgcattcatctcacagagttaaaactttcttttgattcagcagtttcaaaactcctttttgtaggatctgtaaaagggatattcgggggcttactgagtccaaaggtgtaaaagcaaatatcccaggataaaaactagaaggaagctaactgacaaacagctttttgatgtgcacattcatcatgcagacttaaacatttcttttcattcagcagatttgaaacactgttttggtagaatccgtgaagggatacttgggagctcattgaggcctatggtgaaaaaggaaatattttcagttagaaactagtataaagctttcagagaaaatgctttgtgatgcttgcattcatctcacagagttaaaaatttctctggattcagcagtttggaaatactgtttttttccattatgctaatggacatttcagagctccttgacaccaatggcgaaaaagcaaatatcccagggtaaaaatgagaaggaagctatctgagaaactgccttgtaatgtaagcattcttctcacagatttaaaacttccttttcattcagtagttgggaaatactgttttggtggaatctgtgaagggatatttgggagtgcattgggtcctatggttaaaaaggaaatatattcagaaaaaaactgggaagaagctacctgagaaactgttttgtgatgtgtgcattcgtctcacaaagttaagcctttctttcaattcaacagtttggaaacactgtttttatacaatctgtgaagggatatttgggagctc

SEQ ID NO: 468425 - DNA, 2424 bp, Homo sapiens
cgtgggaggcggaggttgcacatcctggtgttgctgtgccgtgggtcctgtgcggtcacttagccaagatgcctgaggaaacccagacccaagaccaaccgatggaggaggaggaggttgagacattcgcctttcaggcagaaattgcccagttgatgtcattgatcatcaatactttctactcgaacaaagagatctttctgagagagctcatttcaaattcatcagatgcattggacaaaatctggtatgaaagcttgacagatcccagtaaattagactctgggaaagagctgcatattaaccttataccaaacaaacaagatcaaactctcactattgtggatactggaattggaatgaccaaggctgacttgatcaataaccttggtactatcgccaagtctgggaccaaagcgttcatggaagctttgcaggctggtgcagatatctctatgattggccagttcggtgttagtttttattctgcttatttggttgctgagaaagtaactgtgatcaccaaacataatgatgatgagcagtacgcctgggagtcctcagcagggggatcattcacagtgaggacagacacaggtgaacgtatgggtcgtggaacaaaggttatcctacacctgaaagaagaccaaactgagtacttggaggaacaaagaataaaggagattgtgaagaaacattctcagcttattggatatcccattactctttttgtggagaaggaatgtgataaagaagtcagcgacgatgagactgaagaaaaggaagacaaagaagaagaaaaagaaaaagaagagaaagagtccaaagacaaacctgaaattgaagatgttggttctgatgaggaagaagaaaagaaggatggtgacaagaagaagaagaagactaaggaaaagtacatcgaccaagaagaactcaacaaaacaaagcccatctggaccagaaatcccgacgatattactaatgaggagtacggagaattctgcaagaacttgaccaatgactgggaagatcacttggcagtgaagcatttttcagttgaaggacaaaagaaaaagaacaacatcaaattgtatgtacgcagagatttcatcatggataactgtgaggagctaatccctgaatatctgaacttcattagaggggtggtagactcggaggatctccctctaaacatttcccgtgagatgttgcaacaaagtaaaattttgaaagttatcaggaaaaatttggtcaaaaaatgcttagaactctttacagaactggcggaagataaagagaactgcaagaaattctatgagcagttctctaaaaacataaagcttggaatacaagaagactctcaaaatcggaagaagctttcagagctgttaaggtactacacgtctgcctctggtgatgagatggtttctctcaaggactactgcaccagaatgaaggaaaaacagaaacatatctattatatcacaggtgagaccaaggaccaggtagctaactcagcctttgtggaacgtcttgggaaacatggcttagaagtgatctatatgattgagcccattgatgagtactgtgtccaacagctgaaggaatttgaggggaagactttaaacctctgcaaaaccatgaaagacatattggagaaaaaagttgaaaaggtggttgtgtcaaaccgattggtgacgtctccatgctgtattgtcacaagcacatatggctggacagaaaacatggagagaatcatgaaagctcaagccctaagagacaactcaacaatgggttatatggcagccaagaaacacctggagataaatcctgatgattccattattgagaccttaaggcaaaaggcagaggctgataagaatgacaagtctgtgaaggatctgctcatcttgctttacgaaactgcactcctgtcttctggcttcagtctggaagatccccagacacatgctaacaggacctacaggatgatcaaacttggtctgggtattgatgaagatgatcctgctgctgatgataccagtgctgctgtaactgaagaaatgccgcccctcgaaggagatgacgacacatcatgcatggaagaagtagactaacctctggctaagggatgacttaactgttcaatactctacaattcctccgataatatatattcaaggatgtttttctttatttttgttaatattaaaaagtctgtacggcatgacaacaactactttaaggggaagataagatttctgtctactaagtgatgctgtgataccttaggcactaaagcagagctagtaatgctttttgagtttcacgtcggtttattttcacagattggggtaacgtgcgttgtaagatgtatgtaacatgatgttaactttgtggtctaaagtgtttagctgtcaagcc

SEQ ID NO: 468426 - DNA, 1812 bp, Homo sapiens
tgagaaagaaacagaatggaaagaataaaaaatcgacgtgtagtgaatgggaaagtggaatattttctgaagtggaagggatttacagatgctgacaatacttgggaatctgaagaaaatttacattgtccagagttgattgaagcatttcttaattctcaaaaagctggcaaagaaaaagttggtacaaaaagaaaatctttatctgacagtgaatctgatgacagcaaatcaaagaagaaaagagaagctgctgacaaaccaagaggatttgccagaggtcgtgatcctgaaagagtaattggtgccacagacggcagtggggaattgatgtttctcatgaaatggaaagattcagatgaggcagactcagtgctggcctcaaaagaggcgaatatgaagtatcttcaaattataattgctttttatgaagagagactaacttggcatggttgtccggaagatgaagctcaataattgttcacattgtttatgtatgtatatatatgtgtgtgtatgtatattcgtatatggattctcatatgtatatatatataaaatttggatcttggttttttatatactagtgtgacaaaataagtacattctaatgggaatcaaatttgatatgttcattttgaaagtagcgttggaagagttgttgggttttttttttttcatccgtagcactggttactttgaacaaataaataaaagctttctgtagttgcttcctttatcagaaaagaacatttgttaccatggtatatcatttcctctgcattagagaacagcttttctaaatgtttggggttatgtccatagtcattactcaatcagaacttgtgttctcataagtctaaggaccattctaggttttttatttgttttttgtttgtgtatacataaaatgcgcacgcaaatttttttaaacattcaccagaacaaaaaatcacagtatttgctttaccggttcagcaaaagccaggaaaaaccacttggcagtaatcagaatgttatccaactgtatattgtttaccttattgtaaatacttgtgaacagtggtcaatagttttatgttcctttatgcaaaaaagtatctttgacatcaatacttttgttttcactagaactactttttgaatctcctttgcatttaactcaaaaagttcatttttagagaacatcatttacatttctgcatgttttgttagtgatagagcatttactgaatcctcatataacgggtcactggatatttgatcttaagcatacaaggacctattttcataatatcaagatctttgaggttttcatatgtgtatatttacaatttctacaatgttagcacttactctgttgcacattaaaatgacttttaagaagcttgtttacaacaatattcaacatttacaattatggactcatattcataataattatcggttcataatcataatgagtagtaaacctgtgttgaatttgtctccttttttatcaattctgccaggaacctctgagttatcccataccagcattaaacttaggcagttataggctaacataccttccctaaacagtcctcttttgttcaaaatgaaattgagaggctgttccataatatgaggcattttgaaagaccttgaatatataaaaactccctctgtcctaaagcaatggtccctagcctttttggtaccaggggccagtttcacagaaggaaattattccacagactggggttgggtggagaagggatgattcaagtacattgcatttattgcgcactttatttctattattattacatc

SEQ ID NO: 468427 - DNA, 773 bp, Homo sapiens
ccgcgggagatgtggggacgactccggaaatctcgggaaataggcaataactcgagctttggcaacgtcccccagcctagggaggcgctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccagacgcatttcaggtttcgtcgttttggcactgacaccatgattttactcgctctgagttcccaccaaggggagcccaccaacggcgtcacaggccctggccgtggcgctattgactgcagggatgaggcacagcgatgctgcagaagatggtggatagctcttaagtttcagaccacccagccctttccaatttccagtttctttattccagtcaaaagtgctttgtttgaatatcattcttgcttgcttatgtagaaaaatcttacttacacgataggatgattagaagcaacagaacataagcattcagtggctgcttcaaggtcctccctctcccatcccagaaatgccttccttatggaaaataagttttacttcccaattatgtgcatggacctctgttcattgcagcccccattggtactgggttattattattagcactgtatggctcaaggagtcagaaaatagaccatttatttatttatttatttgtttattagctagtgggtttttcctacaatcatagaata

SEQ ID NO: 468428 - DNA, 1379 bp, Homo sapiens
gccatgtatctacgcgacaggctgctacttccaaagccatctctacttcttccttcacacacttacgctatgctgcccagcccccattgcagttatgtgtggacacacaacaagttctcaccaggggaatgtgagctgaatcatctttctatcttctgggtaaatacagaggactccgaggccccagaggaaggtgaaaccacaagacagccggaacctgtggccctaaataagtcctatgtacaatgcatcttcaatgcatcttcagaacttacacctagaattctgaatttccaggcttcccacactcacttgaggcaatggatgagaaatggccactgtcctattactgcagtggggaatgcagcacaatcaaatgagaatgtgaagttacatgatctggaaactgttgtcactacacaactgataactatggagtttgaatctatgacattcacaaggattaccaagaaagatattcccttacccagtctccttcctaagattgatttcaggtgaatgggctgaagagagggggagaacatggccaagctcagggaggacagatgtttcccgtggacgaataaaaaagcactcacacttccatctgactagagagctgtgaagtcagtagaaagtaagagggaagctgtatgttggtctttcccatggtggacactggaactaaagctgcaaccaaaaacatggggtgatttcagacttttcccaggaatggatattaaattttatgagatgattttagagcatctgccggatgattatgttgtttttttctttgacctattactgatggacaatattaataaatgtgctactaataagtgaatattatattccaagaataaaatctgcacaatatagtctaaacattatcttgtaatatactactgtatgattttcattggtttagtaaagacttttatatctatctctaaaatgtcattctgggaattataacttggacatcaagttccttacactctggttgccctttattggttatccttcttttttctttttaatgggccaatcaagcacactatgtaactaagatgaaagctctttaagagcacaggtctttgttttatttgctgatttatttactaagatcctagaagtatgcctgatacattattcgtattcaataaatactttttgattggttaatgaattctctcttatattgatatttatgttctttaataattttatactctgaattatatattttttattctttgtgtctttatctggttagctgaaataagacataggagtgcatatacaaaaattttcttccatctgaatatgagggtggtataccggctgaaccattgaatatctgagaatttatttcc

SEQ ID NO: 468429 - DNA, 3189 bp, Homo sapiens
gacagagcagacacatagcaccggcctcccagctggcaggggccggcccccagcacacatcgtgaaggacacacagcaccagcccccagcgcacaccatgaaggacacacagcactggcccccagtgcacaccatgaaggacacacagcactggcctcccagctggcagtggccggtccccagtgcacgtcgcgaaggacacacagcactggcctcccagctggcaggggccggcccctagcgcacgtcgcgaaggacacacagcacacctccctgagctggagccagcaggcaagggtcacatctctacaatcagggagaagaacagagaggctgctgtgggaacccagcaggcatccggctcaccggcacacccgaaagctcgtgtggagcagggccgggcacgtgcaggctgtgcccaccctcgcactcacgttcacgtctggaaggcagagaacggcccagcagggcagcaggcagtctctgccactccggccgccacagcaaaacacccccgtcggcggcttcaagcaaccgacatttagctcacagctctggagactgtgagtctaacaggccccggcagactgtggttcacagccagcgcctcctggccacatccgaacgtaatgaagcgaagaatttctggggatagacgttcgggccatggtgacctctctgggggtgcccctcagtgtgagaaggacggagagaaggcgccggctccacagtgcggccgagcttctgtgagagacccgttgccgttcgcaagtccgagcgacgtggctggaaaaccagagccctcgccaggagagagtgaggcttgacagacagcgcctctccctccgcaggcaccggccctgagatggtacaggagcaaatctacccactgggccccagctggccgccgcataggaggggctgggtcggccgagacgtctcagagggaagctggagtccccggaaggttctgtccagaggcccagtggagggacacacagacccacccccgagagcactgaatttgggtcagcgcctgggccatctgcagccccgaagcccacaccctggggtctccaagccccccccagcacaggctagcggctccaggcagaggcttttcttcctgaggggtgtctacccggccccccagcctgcagggcagagtcacagcgcagggctggcaggcctggcagggaggacaaagggacagaggccgagtcaagacgttgtgtctcccgagcagacggagcaggtggggcctcaggcctccagggccgcaggagtcatccatcaaactgagtgcccctcattgaaattctaacggcaatgcggccacaggcagggctcctccggggcatgccctccctgcctgcctggtgctcctgagagccagacccaggtcacaaggtcatgaggccgcacgcagaggccgtccccggggagctccgggtgggcgccctgcatggccttcctgaggaccacacgcccctcccccagacgctggacagacacacttctcatggggagctgggtttttctcgggtcccctccccacaagccctgctcccgttcacgcatttcctcacgttccgggactgtgagtgctccaagctcagcctgacgtttccctgccccggccttggtgccagccgagactccgaggcctgtggggtcctctcactggagggtgacgtcggggaccgagacctgcaccctgtgcttcctttggtactggggacttcagaggtgacccccgggacctcagaggtgacccccgccctgctctcggacactacagccctgatccccaggacctcagagaaggaggacatttagacagagctgtgcacgagggggacgctgtctaccagccaaggcaagaaagaaagcagcactgtgtatttccataagcagcaaagacgccatcctaaaccatgcggacagtggtcacactgtgtgtttccataagcagcagagacgccatcctaaaccatgcggacagcggtcacactgtgtatttccatatgcagcagagaccccaccctaaaccatgcggacagtggtcacactgtgtgtttccatatgcagcagagaccccaccctaaacatgcggacagcggtcacactgtgtgtttccatatgcagcagagaccccaccctaaacatgcggacagcggtcacactgtgtgtttccatatgcagcagagaccccaccctaaacatgcggacagcagtcacactgtgtgtttccgtatgcagcagagaccccaacctaaaccaggcagacagcagtcacactatgtgtttccgtatgcagcagagaccccaccctaaacatgcagacagcggtcacactgtgtgtttccatatgcagcagagacgccatcctaaaccatgcggacagcagtcacactgtgtgtttctgtatgcagcagagaccccaccctaaaccgtgcggacagcggtcacactgtgtgtttccgtatgcagcagagaccccaccctaaacatgtggacagcggtcacactgtgtgtttccatatgcagcagagaccccaccctaaacatgcagacagcggtcacactgtgtgtttccatatgcagcagagaccccaccctaaactgtgcggacagtggtcacactgtgtgtttccatatgcagcagagaccccaccctaaactgtgcggacagtggtcacactgtgtgtttccgcatgcagcagagaccccaccctaaaccgtgcggacagcagtcacactgtgtgtttccgtatgcagcagagaccccaacctaaaccaggcagacagcgtcagctctggggaggtgaaggggctgggccatgggacagccatgggggatctaggcactatctgtgtcgttgtatcatctatgtgtggcttgtgaaattaaaactgtaaaatagaaatttatagaatgcttgtatccatatttttgtgtgatattgtcctgtggttttctcttttccattttttttcttgctgtatgttactggctgtgtctatgtgtattactgggtgtctgcctctgtgtatttgtgtgtgtctgtgtctctatgtgtctgtgtcactgggtgtgtgtgcacctgtgtgtttttctctgtcagtgtgtgttactgtgggtgtgtctgtgtgtgtctggatgtgtttgtgtgtgtgtatctctag

SEQ ID NO: 468430 - DNA, 556 bp, Homo sapiens
cagcgggaataaatgatccgcccctggccagtgctcacccgactgaccagagcgcagcccggtgaccgaagcgcacggggcgatcgcgaggcgccccctccctctccccgcgccgcctccagcgcgagtgacggcgcgccctccgggctccggagcggcggcgccgaacaatccccggcagggctcgcctcgccggtgacatcactcctgaagatactcctcgctcccagcgcctgccttccccaggcgtccgttcgtgtgcccgtctccgcctttccgcctcggaagagcgctcatcactggctggggacagagccgggcaccaaggagcgacaggatcccgaagagagagagagaaggcagcgagggaaggaggaccccggcaggcagcagcatgaaattcagcccagcgcactacctgctgcctctcctgcctgcgctggtcctcagcaccagcttcttcagcccaaaggattagatatcgtatcattgctggctgcttgaaggagaaatattaacttaaggaccttttgggccaagactatggggtttcttc

SEQ ID NO: 468431 - DNA, 645 bp, Homo sapiens
ctctctctgggcaccagcacaagatccatgttgaaccaagccgagccccaagagcccctgtacagctttagcagagcaattataccttttataggacaacatcaaattgaggaagcagggaaccaaacacaggaaccaagtgaggagaattcccagaatgatgacagaacttccaggtcttccaccatgcagcacaacttatgtagaccagcatccagagcaaagtacaggacaggaaatctcagcaaagtctctgagggggaaatggaattggcaggtgttctgtgtataaaattgtgtatagttgtcaaaaaagtagggccaaggcgtagctatatatttactctaaacgaatgggacaaagaggaggttttaacaccagtgtatgaggtcccaccacatggccagcaaaatccagatgtgaagaaagagagcacacaaaatgaaagaaaaaggcctttggaacttcatattccaatttccagcagtcaggctgaggaaacttctcagttacaaacacaggtgatgtattatgtaaaaggtgtatgattgagaggtcttaatatcaagcttcctcacgtcttcagtgaatgacaaatctgtacttggcagtcattgttaagaaaaggatggttgtctccaaat

SEQ ID NO: 468432 - DNA, 711 bp, Homo sapiens
tgagaactcatgaatacaaagaaggcatttccttctaagggcaccacctggtccaaggttagcccaggatcttatgccacaatccagaccatccccgaagtgccaccccagttccagagctcccaagcagattggttctgttgttactgtgttacaagtcagtttttccttttattcagtcctacttccttcatcccttttcagggaaattaaagtgacagttaaaaatagtgacaactggctggtagatggggacctgctctgggtgcatatccatgaaactcactgtgcatcatataaagatggccagctagacataggtaatatgtgcctcctcctaggagaggaaccaggatacaagccacgtgaaggctcaagaatcagtcctcccagactcacaaacactagagccagtgaaaaaattctcccctatgaaagcaatttcaaaaacttggaaaaagtgactgctatacaagatgcaccaaaatcaatggagggacacaggaaacatgaaaaatcagggaaatatgataccatcaaaggaccaaaattatccaataacagatcccaatcaaaaataattcctctttaaaagttcagataaagaattcaaaatactgatcttaaagaatctcaatgagatgcaagataaacctgaaaatcaatacaaagaaatcagaaaatcaatccaggatattaatgagaaattta

SEQ ID NO: 468433 - DNA, 679 bp, Homo sapiens
agaggatttcacacaaaatgaaaacaaagtatctttctgacagacagcgtatgcaggtgagggtcactgagaaggggctctccagtgttagctctaaactggctgcagaatgtgtatcctccagaaaatacaggggattgccaatcgatggaatcctgggagccccaatttttgggtatgtttgcatcaggaggaacaggaaagtcacaataaaaggggatggatccagcgagggtgaagaattggagctattaatatcatctagcgcagcagctgagaagagggtcaaaactgggtattgcaggagccatgttaaagctatgatgtactacttggatgccaggcttagagctcagtatggagcagaaatgtttcaggaaaagggtggagcagaatttgaaggggatggcagatggacacatggccacacatctggctttctcttgaatttcttaataccttgggataactgctgacatgattccccaagtttgaaaatcttgcgtaaagttgcttaagtaatggattcatgtttaccaacctagttttagctacatcccactggttttgttatgtcagatgcattcatttagtttaaagtgtttaaactttccattatgatttctgactaatcagtttttattaatttaaaaatttattaattccgcttataattttc

SEQ ID NO: 468434 - DNA, 502 bp, Homo sapiens
ggacactgtcatgggttccatgatgctctccaacaaggcccagttgcctagaaggacgcatggtttagcgggcaggcctggggctctgctgccctgtgtcacctcaggatgctgttcccacgtcccagctgcatcacaggcccagttgcctaggaggacacgtcgtttagcggccaggcctgggcactgctgcccggtgtcacctcaggatgctattcccacgtcccagctgctccagcttcagctgctgctcaaactgctccaggaggatccatgttcctcggcatgcctgaaaatgaaggtggaaaccaggaagcatgctgactggggcatgacttacggtggggaccaaggcttctatccagagcgcataggcaaagctctctggtgtgatgagggttccaggctaacgtccccaccactgtcatccagtggtcctggagggaactactgagaaagagtaggatatctatgagagaaggcatctccacttcttcatcag

SEQ ID NO: 468435 - DNA, 822 bp, Homo sapiens
tgcagatctgcggcatgaagggagcctgtgccatgctgctgaaagcagctccaaccgatgcatgtgtactgctcctcaaccccagactgtcaacactcactcctgctgcttgggctggagacactggcctcacctcctgcctgctggtctctgagtgtctcaccgaaggacaagggatgttcttgcagaacaaggagaagtattcctttttctgtttgccaaggagaggggtccctagagctccgtggggctccacactccacttgggaaataagatgctcctctgccctcacaaatatgcgtcctgtccctcatcgtatttggtaacttcccttagtagtcagggctctgcagagaacctggagaatgcctgtgccaccatcagcagtgagactaagccccattgttacggcacacgggttggatctctacgtgatatcccagatgcctgtgccaccatcagcagtgagactaagccccattgctacggcacacgggttggatctctacgtgatatcccagatgcctgtgccaccatcagcagtgagactatgccccatcagggcgactgcgagcagagcctctggacttgcttctattgaggaagttcagagacaagtttgatgtttaattacagcaaggatatatttctcagctaagctgatgcgcgacactgcctgttcgtttctttagttctgatactcattatattcatttcctttttcagtatcaaccttcatgtaaatgattttattgtaaaaatggaaaaagttaagatataaataaacttaacagatcaaaatattcctgattatatgtaca

SEQ ID NO: 468436 - DNA, 734 bp, Homo sapiens
ggcagcctgaggctgatgtgagcactgggctgggagtcagcggttctaagtgtgagcactgggctgggagtcagcggttctaagtgtgagccccagctctgcaacctaccaacctatttgggactctccacttctcatctgaaaatgcataggccagaaatagctgctgccctgtctgctgttatcatctcagtcagtgaacaagtgtgtggggatcatcagtctgtaccaggtacccctgtagacatgggactggcattgtgcgttcagacatgggccctgactgcacgtctcacatcccagtggcgaggagacagacagcaaacagtcacagtgggcccctgggtgtgggcggagggaacagctgaccacagcaatgaagaagagatgacaagaagctaccggggccactggttcctcggctccctggtcctggaggaggctgggctagacttgggaggaggggaggaggtgtctcctgctgccaccaggaccatggctgccctccctcacttgccgtgggcctccctccctctgcccttccctccctcgccacctgggggtactcagtcacttacttccacactcgttctttaatgtccatgagcaaacccggagatgagggcggctatactcaggacaggatcagggtccatgatgttgggtgtttacagtgtctcccaaacacatcgtgacagaggaccaggaacctccagagagggcccttcccagcc

SEQ ID NO: 468437 - DNA, 922 bp, Homo sapiens
gtgtgcattggcagagggacagtgccgcagtggggatggggtgctcaccctctctggaaactcctctctcctccccccaaatcacttcatgcttggggcctttgctgctcctcctcctctgcccatggggcttcttagtctccagagacctaagttcacatagggctgggcaagattgagatcaggggactcctaacacagccaacttgtctcagagtttccaagaagacccccatgcaggggcaagggtatggaatgtaaattgagtcaccatgggggatgcaggaaagagggtcctggtgctgtgtttcttctccactctgtgcctctgtgctggaggtgagggagaagagtccaggacagtgtttgaaatgctcgaagggatcccagggagttgccagttccactgctctggggctctgcaggctccagcagaggctgttaccaaatccagcaaccacagctttacacaccatggggtctccagcaatggacaatggacacactgtccactactgaggccccatggagaccagcacagaagcagtgcctgggtccaaggagcctccttccatcagggggtctacgggaggagtagccaggccaggactggcagggagagcaccccagcaggggagggcctgtgtggaaactacacggcagaggaagactttgagcagctaaagggggtctccagaactgactcatcttatacctgcaagtttgtgtcctttgacctttgaccatcatctccctgtttctcctacccccagctctttgtggctttcattctactctatttcaatgattccaacttttctagattctacatataagtgagatcatgtagtatgtgattttctgtgcttgctttatttcatttaacataatgtcttctaggtttatctatgtcattgcaaat

SEQ ID NO: 468438 - DNA, 5323 bp, Homo sapiens
gtagtttgatttagctgttccacaatgtatatacatttatcaatcttcttgtacaccacaaatatttataaattttgtcaattgaaaaaataaacaaaaatgtaaaacaaattatttaatgaatttcttaaacaatatttctgggacttggaattgcatcaaatatatagatcaatttgggcatatttggagggaagctgtaccctgcaaaggggcagagctgctgaagaccatgggaacccacctcttgcatcagcatgacctggatgtgagacatggaatcaaaggagattattttggagctttaagatttgactgctccactggatttaggacttgcatgagagctttagaccttttgggttggcccatttctgccatttggaatggttatctttacccaatgcctgtaccattgtatctaggaggagttggtgatcggggatttaggcatcgtggcaatgttttatttttcaagctgtgtgataagcctataggttatcatgttattattcttgtgcatgttatactcttcaatattacatactgaattttgaaatataagaatgttttgattcatgtagtttggcactctgttattacgtgtacatgtttgaaattgttatgtctacctggtgattaactcttttatcattataaaatgtcttgtctttccctaagaatttttgtgtcaaattctattttgtctgatattagtataagcattccagctctttttgatgactatttgcatgctgtatctttgcttttaatcttcgggtgtcattgaatctcaagtgttcaacttgtagacacaagatagttgagttttttttttcatttattctgccaatttttgcctgtttattaatatgtttagtctatctatattcaaagtatacatttaatattcacccccataatacattgttagtgttttggctttaaatattgacattttaaaatgagaagcctactttcataatctttaatatgtttgaaaaatgtattatttaccttcctagggatattttactggatagagaattctagaagtatgtctatgtttcttttaactcttttattatgttgttccattgaattttgccttacctagtttctaaccacatagctatggcctttcttgtatttggtctattagcccaaaacatggccttgtgcctaggcttacaacaaatatttatgaaatccatacgtatacataagaaacaaatgtgttatcaattaatattaccagtttagtagccttggaaaatgtctcataaaaactttatgtcagagtttcccttatctggaaatcaaagagatgagcgaatatcattaaagttttttatactctaaaattgtttctccgattttctttgattttcacaactatctgctgagaaagaaagatactcattttaattttcagattataagtgagaaaaacatttttcaaaaggattaagcaatctgtttaaaattgcatagctaattagtaaaaaggcttgggctcaaagttgtttgactttatactttatttcgagaaatacattattatatggagaaatcccttctactgtagcttaactcctcctttaaaaaaggaaaacaagcaaacacaaaaaatctttgtgtttatatcctgcttcttcaagagattgtgagcttcttgaaggccagagctgtaaattatatatttttgtgatttccccaaagtctcaaatgtgttctacacagtgcagtaaataatttgatataattctctgcaggaaaattgatccagtgctgaaaaccagtaaacaattctcattaactgtctctgtacctcatgtgtcacacagaatttgtcctatggtaagtgattaaacctggttgttaaagcaatgaatgatttatctagcagaatgtcaagttttgaagccctcccacctggaccctttagcctcaaggctgccataccacagcccaggttctgttgagaaagatgttgccggacagtctagaagggtcctgatgtttttctcatgatgagatgagtttatgcgtttagaggactaagggcacagtggtaaaatgccgctcatcacaccgagtcaagggtacgtgccgaccccactgaccgctgtgcatgtgccctgatcgccggccagaggagcgctggccgggcggtttctccactgtatgcaaaggccccccttccacgctgcattctaggaagaaagtcactatgggcagctcacatttcagagtaagaagtgttgaggcaggtggtcatagttgattgttaaccagtgttgaggcaggtggtcatagttgattgttaaccggtgttgaggcaggtggtcatagttgattgttaaccagtgttgaggcaggtggtcatagttgattgttaaccagtgttgaggcaggtggtcatagttgattgttaaccagtgttgaggtaagtggtcatagttgattgttaaccagtgttgaggcaggtggtcatagttgattgttaaccagtgttgaggcaggtggtcatagttgattgttaaccagtgttgaggcaggtggtcatagtttgattgttacccagtgttgaggtaagtggtcatagttgattgttaaccagtgttgaggcaggtggtcatagttgattgttaaccagtgttgaggcaggtggtcatagttgattgctaaccagtgttgaggcaggtggtcatagttgattgttaaccagtgttgaggtaagtggtcatagttgattgttaaccagtgttgaggcaggtggtcatagctgattgctaaccagtgttgaggcatgtggtcatagttgattgctaaccagcgttgaggcaggtggtgatagttgattgctaaccagtgttgaggtaagtggtcatagttgattgctaaccagtgttgaggcaggtggtcatagttgattgttaaccagtgttgaggcaggtggccatagttgattgctaaccagcgttgaggtaagtggccatagttgattgttaaccagtgttgaggtaagtggtcatagttgattgttaaccagtgttgaggtaagtggccatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggtaggtggtcatagttgattgttaaccagtgttgaggcaggtggtcatagttgattgttaaccagtgttgaggtaagtggtcatagttgattgttaaccagcgttgaggcaggtggtcatagttgattgttaaccagtgttgaggtaagtggtcatagttgattgttaaccagtgttgaggcaggtggtcatagttgattgttaaccagtgttgaggtaggtggccatagttgattgttaaccagtgttgaggcaggtggtcatagttgattgttaaccagtgttgaggtaggtggtcatagttgattgttaaccagtgttgaggtaggtggtcatagttgattgttaaccagtgttgaggtaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaggtggtcatagttgattgttaaccagtgttgaggcaagtggtcatagttgattgttaaccagtgttgaggcaggtggtcatagctgattgctaaccagtgttgaggtaagtggtcatagttgattgttaaccagtgttgaggtaggtggtcatagttgattgctcaccagtgttgaggcaggtggtcatagttgattgctaaccagtgttgaggcaggtggtcatagttgattgttaaccagtgttgaggcaggtggtcatagttgattgttaaccagtgttgaggcaggtggtcatagttgattgttaaccagtgttgaggtaagtggtcatagttgattgttaaccagtgttgaggcaggtggtcatagttgattgttaaccagtgttgaggtaagtggtcatagttgattgttaaccagcgttgaggtaggtggtcatagttgattgttaactagtgttgaggtaggtggtcatagttgattgttaaccagtgttgaggcagatggtcatagttgattgttaaccagtgttgaggcaggtggccatagttgattgttaaccagtgttgaggcaggtggtcatagttgattgttaaccagtgttgaggcaggtggtcatagttgattgttaacgagtgttgaggtaggtggtcatagttgattgttaaccagtgttgaggtaggtggtcatagttgattgctaaccagtgttgaggtaagtggtcatagttgattgttaaccagtgttgaggcaggtggtcatagttgattgctaaccagtgttgaggtaagtggtcatagttgattgctaaccagtgttgaggcaggtggtcatagttcatagttaaccagtgttgagacatgtggtcatagttgattgctaaccagtgttgaggtaagtggtcatagttgattgctaaccagtgttgaggcaggtggtcatagttcatagttaaccagtgttgaggcaggtggtcatagttgattgctaaccagtgttgaggcaggtggtcatagttgattgctaaccagtgttgaggtaagtggtcatagttgatagttaatgagtgttgaggcaggtggtcatagttgattgttaaccagtgttgaggcaggtggtcatagttgattgttaaccagtgttgaggtaagtggtcatagttgattgctaaccagtgttgaggtaagtggccatagttgattgctaaccagtgttgaggtaagtggtcatagttgattgtcaaccagtgttgaggcaggtggtcatagttgattgctaactag

SEQ ID NO: 468439 - DNA, 1255 bp, Homo sapiens
ttaatttccagtaaggaggtgtgggagcagacgtatgactgtggagttcagcacacatcccctgaccatgcctgccagaagctaccacaggaatggaatggaaatggctgctgagggcacactactgtgtcaactcagagtcagcgtctatcatataagaggacagggcatcatcctctgcactgactggggcatccacttcccagaggaggacactgaggcccagagaagaaagtttgccaaagatgacaagggcagtctgtgtctgcactgggcccagcccctgagtcttgacgttcctacttcagcccctcgtgtgcccccaaggacttgtactatgggaaacattctgagggaaattgccatttccctcaaaagaaacctgaggctattcctgaaaacaccaagtccactgagaatcttccttgagttgccctttgctgctggagttgattttagtgctctcggactccagggctccagccgcagttagaaacacaggcttttgactcttcttaatctgatgattgagaatggggatttctcaatgggccttcagtcctgcctcacccaggacctgggttcaacagcccaccctggtaggcaattgtgcaggctaaggcagatgatgcctaggcagcagtgggctctgtgtagtgattaaaacaattgcagcagctgcagctgccgtgtactgagagacgactgctgttttccatccgttttctcatttaatcctatagcagcacttttctcatgaggaatattcccagaacctgccaaggtctcccagctagtcatggagcaggtggagccaggaacaagcctgtccaggtgcccacaactcattgtaccgccctggggaccaaatatagcttctaacccaaagggctgctgtgagcaccaaggaaatcatgtgggtgcatgtaccagctacactaagcagaggtcttgtgatggttatgtattaggaaggaggacatgagttctaagctcactagctttcttttctcccaatgcaaacccctcccgattaacttggttcttcagttggaaatgtttgcaatgggagttgctgatgaagaaacttgctttcgtgatgggctggctgattgatcaaaaagaccatacgggattctgttttccccaagtaggaactgccccggctcttcaagcttcattaagttttaatttaatcattgccactttgcactggaattgtgttttatgagcacattaccagaagttgaaatct

SEQ ID NO: 468440 - DNA, 833 bp, Homo sapiens
aagggagtgaagtccgtggagatgcctttcatgggtcttttgttttgcaggggttttccaagactagataggtgtatatatagtgctgctttattggggcagattggagcaggaaggagaaataatgagaatgtcataataaagggtcctgacctggacagaggcagccccatctggttccccgtctctcctgcattccacatattgggaccaagagcacatgacttttctgctccactgataataatgagtagacatctggacccagagctttcatgcaacaatttgctcaggggagaaagatgggggttggtggaggcacagagagagcctcctgcagtggtgcaggtgtggaagaagtgtcaacttggctgtggggagtctggaagcctggaccccctgcgcagacccctctctcaaatcttgtcaccctcaaggtactggtaaagactcattgttgagagagacagagcgagagagagagagagagagaaatcctctaccctgagaggaaggggagaaaacagttctgagctccgaatcttctatcagtaccatgctatcttcagctacaagaggagggacagatgaaaaatcattgctgcaggcaagatccaccaatgaatgctaaatttagtgggcaaaagtctaagatacaactggtgtttacatggcttaaagctatctcccccggaacatttagcaacttaaaaagaaaaaaataacacctttacagcatggaaccctaccagacattgtcttaaccaagcaatcaaggtcgacatcattagtaaggacatactgactttaggtatccctgataccattgctct

SEQ ID NO: 468441 - DNA, 1074 bp, Homo sapiens
caatggtttatacagaaaaaaaataaatgcttggttagtgctagttttcaaaataatgaaattattttgtttgttcacaaacatcctccactggcaacaattagttttcctaatattctttttaacatttcattacaaaataacgaagtcgaatatatttgctgggtttcattcattatggttattaaatttaatgatgtttaaattgtcccatcttcagctggtgggagcctctaatgttgcctcctgagcctttctgacacgatcttattattctgtaatctcttccttgctttctagtaggacaaaatgtttcaggctgaaattgtacattccctgcctgagacctacaatcagccatttttccaaggagccctgggtccgtttgatgataaatgatttataatgatcacaatttggatgtcacaggttttcatcactactgaattgtccattgtttctagcttccagtagatggagatagataatatgcatttataaattacagggtttttacctcacttcatcagtcttacatctgattcttctttatcttatgctgagaatgctggttctcaatgacaccactttaattgatcattttcttcttatcacaatcagtcacaaaacaaggtgtgacatgaaaaataggaacatcactttggaagaggtgagtgttgaattcaagaaccaacgcatggagatatttacttttcttctcaggttgaagaccaaatgcctgtttgtggccaatggagctgagtttggtgactatgctgaaaatctgccatccgctgctcctgagtacggtctgtatgccatgtcctttagccttggtgcagctgaaagctgcagatctggagacaggcatgggaaaggctgggatctcaggaataatctgaagatcagccccgtcattaagccgatgtggagccgaacacagcgtcctgctgatactgtggaaagtgccagagtgaacatttttatcaaatgctggtctcaagaacttatttcagccttggaggaatcaaccgactagcaccaacgaaggaggtgactaacagacttctggtc

SEQ ID NO: 468442 - DNA, 560 bp, Homo sapiens
ggattttctcaggccaaagcagcactgacagccacaggccttgagtctttctctgcattgggctgcctggagttaagggaagtgacaatggacactcttgtggctgccacagctggcagtaagctgggtcacacccaaagctcatggcctcccacaccattgcagtactgggacttgcccaaggcccacaattgctatggcctgattgctgctgatgtttattcaaggcctgaggtcactgtgatggttacagaaattgcatctgagaacaacagcttggaattggaggctttgggcttcttcctggtgctttattttactctggctgagctggttcctgttgcgagacaaagtcccctatactctgttgtctccttttcccaagaagaagcagtttgtctctcaagcttcattgcctggaattataggagaagtaatgcaggcacttttgtgaccaccacagctggtgttttactgggttgtactccaagcccacagagcagcacagcaccgggacttcctcaagggccacaatccctacggcttggctgccactgaaa

SEQ ID NO: 468443 - DNA, 1358 bp, Homo sapiens
agctggggttcatgggcagagtggtgagcgacggagaactggggttcgtgggcagagtggtgagcgacggagagctggggttcatgggcagagtggtgagcgacggagaactggggttcgtgggcagagtggtgagcgacggagagctggggttcgtgggcagagtggtgagcgacgcagagctggggttcgtgggcagagtggtgagcgacggagaactggggttcgtgagcagagtggtgagcgacggagagctggggttcatgggcagagtggtgagcgacggagaactggggttcgtgggcagagtggtgagcgacggagaactggggttcgtgggcagagtggtgagcgacggagaactggggttcgtgggcagagtggtgagtgacggagaactggggttcgtgagcagagtggtgagcgacgcagagctggggttcatgggcagagtggtgagcgacggagaactggggttcgtgggcagagtggtgagcgacgcagagctggggttcgtgggcagagtggtgagcgacggagaactggggttcgtgggcagagtggtgagcgacgcagagctggggttcatgggcagagtggtgagcgacggagaactggggttcgtgggcagagtggtgagcgacggagaactggggttcgtgggcagagtggttggctgccccactgtcagcctgttctgaaagtaggaatgaccctcagctgagctgagatgttgctggtggagactctaagactgtggattctgactccctgggctcaggaaggacggtgctgggaacaaggtgcagacaaggcacgacgaagctggagtgcctcataccacccccatgaaagcgacgaaggactcccagaaccattcctgggggcccgtgggaacgaggactttgggggcacaaggacgagctgaagaagtcttcctgattgtggttgtcagagggaggacatggcatcgtggtgggccagagtatcggcctcaacaccacccacttttcaggctgcagtctccaccgtggccgctgtgtgcattggagggcacttggcagcatccccagcctccccactagaaaaccagatgccaggagcatatgcgcccctcctcaaggtgcaaccaccagaaacgacgccagacattgccaaatgtcccttgagggtggggacaaatgcccctcatcccccttgaggactgcagctggaactcaatgaagagcagcggacggccttggaggcacctggattcctcccactcactgatgccacaaacctgtaaaacgacttgtccagggccacacatcttaaaatctcccactgtcaatcactagaccccatttcttccagag

SEQ ID NO: 468444 - DNA, 1165 bp, Homo sapiens
caggtcctgatcatgttctgtttcttcagctggctgctggcaacacagatgttcaaactgtcacgaacatttatcaagctgtgtgaagcctgctccccttcaccttctgccaagattggaagctctctgagggcctcacaagaagcagatactggtgccatgcttcttgtacagcctgcagaactgtgaggcaaataagcctcttcttggtataaattacctgcctcaggcattcctttatagcaaagcaaatggacgaagacagaggactctggttgagagctccgattctccatcttcacacttctcagggaagaggcaagagctgccctgtccaatggggtaactgctacctacatgttgctatttacattcaaaataactaaaattaaatacagtttaaactctagttcctcagtcccctggcgctacttctggagtgctctgcatcgtcaggcagcggtggctgctgcagtagacaagcagatagagcacatctccatccccacagaaccagaatgtgtgctggcctagaaggaccgggggaaatccccgacccgctgagcccctcaaggcactaatgctcatcctaagcaatgcactggctccccgactgctggtccaggggaggagaaaagagcccttccgaatggatgtgtctcaggctggttctcagcctcaagaggagtgcatcccacgtgtcctgcccagctttctctgcccctcctccttcctgggctcagtactcccccgctcaggagtacatctccagcaagctcttcgtgaaggggatctattcaactctccagggtaacacaattctgtcagctccttgcatatatctcacaccatgttatcagcctaggaacagctgtgagctcctgcaggagtgctggcagacagacctgagcacctcacaggagaaaaattgccctgcaccttggagggaggtgctgggccaggcacagtgcctgggtagcatgggcagtggaatcccgtggtggaaggcacagctcagagcagtctctaagccagtccagggagggcatggtgtggaaagttcccagagctgaaaactccccaggccgctttcctgcgtcaacgctctgtagctttcttttgacagttggttactttttcacttcttgtgaagccatccagggat

SEQ ID NO: 468445 - DNA, 723 bp, Homo sapiens
ggtggacggcgtgtgggtgaccttcatgtgaggagaggagttaaccaatgcagggaatgaagaacggaatggatgaatgggcagtgcagtggcatagttaggatacccattttacagatgagcacactgaggcccgaagaattttctcagtgttcctatgtctaccgcacctacaagctgcccttcagactaggaatcctggttcctaactcagtgtccctatgtctaccgcacctacaagctgcccctggtaacaacgacagtgtgaagtgggcagcagagccccacaccaactctgccggcagcatcaccttagactccccagcttctggaactgtgaggaacaagtgtctgctgccctgcagggacagctcaaaagctgccctggacctagatccagctgcctgccaaggaccaccctgcgcccacctccctgctgcaaagcctgccctggcctctgacctgaaggtgggaggccagaagaagctgcccagggctgcagcttttactctctggaatggagacctgtcttgggagattttatcaaaacttctgttcccagatctctctttccagacaccttgatccccaggatctaaagctgcctcctcggaactctattctcagtcaaagccctgtctcctgagtgggccccggtcctccttgctttctgccagcctctgcaaggtcccagcccccttgcacatgcccacagctgtgagc

SEQ ID NO: 468446 - DNA, 692 bp, Homo sapiens
ctacagcctgtcttgttctgaatgctagcacaacttttagatatcattgactgctgtttcttttcaaaaggtaccgttcagacagaatcagctctttgccctgggcagacaggaaggtggcttgatccaccattgctaagaagggctggagactgtgagtcaaatgaaaagcatgagaaagaatgtgtgcatcctctagaggcaaagactggctccctggctgacaaccagttaccagctgtgcaattgcccacaaatgctcacattcccactgctaatgccaatattgtcctcaattcagttttttcacttagagattttggtgtaacctggataatacgatttgctggactcactttgtatgacaaaagaaggtgtgcaggaaaagcattattaagattaattttttccatagaaataaatcctaaagttcatttatcttccatatcaaaaacacaagcaaaagatgcataaactgattagattatttagtgtctggagaaagaatgtactgcttctgttatgttattactcacaatacctcaagttactatgaaacaaacgacaaagaatcataacacaataaagttcatagtactttacaattcccatgctcaaattatattggaaatacctgtaatctgtagttacgttaactcaagaatttttgcaaaaagctgtgatccttaccc

SEQ ID NO: 468447 - DNA, 1194 bp, Homo sapiens
ggtagtgtggcccgcagggacgccgacctgctggagcgtcgtgccagcatgggctgtggcaagcacgtgggccagcaggaggttcccgctgcacagctgtgggaggaggacacgggagaacacaatgacatgagtgactgtcctgcttggttaggaaagggaaacgtaaagttgtggaattctgttgatgatggatgtgagagtggtgaagccctgcgggatgatgtagaggacttccacatccctggaggccccccgagagctgggggtgagctgctgggtgatggcagtaagaacatgtggtatattattgatgaacgtggggactctgaggagtcctcagaggaggacacggcagagcccaatggcttcattgattgcccatcacgaggggagagggagaagctgggtgaggctcgcatggaccttggggtgtccgtgctgggggaccgttcataagaagagccagacaagaccctactgttcttaggtgcagacatgattaggaaacctgcagctccgaggggcccccactaatgttctaactcgcagaaggaaggagtgtgtgtgcgtgtgtgcgtgtgcgtgtgtgtgtgtgtgtgtgtgtgtttgtgtgtgtgcggtgtgaggtatgggccccttaaggaaatggaaatcaaccaaccaatgggacagacagacagacagacagacagagattcacttgcccaagtgttctgtcctgtcctctgaatccgctttcaagtcgcaagacgctgtgagctccaagtccacgcagagtccgccaaacgctccggccgctgatccgctccgcgaagatctgagtacaggccagccagggtgggtttaaatagcctcgggcgcagcctatcagcggaaagggcggagcttcactcctcctttccatcagtcacccccaactttcccaggctacacctcgtaggaaactgttctcctgctttgatttcatgcgccacctttgggacactctaagaacttacaggttttcttggccagatttattaggaattgtgtgcactgaaacactgaaaaccaactagtgggttctgtgcttcccacgttgtggttttgacaccagcagcatccttgccacatcaaacccccgagaccgcagatctgtgttgtacaagaatactactgaccctgagcatggcagttgaaagagtcttttcg

SEQ ID NO: 468448 - DNA, 513 bp, Homo sapiens
catgtcttcacccccagccctcagggactctcctgtgtgtcccagctactctccaaccatgcccagatttcagcgggggtcagttccaggcacccagttcgaagccctggccaatctactagcccacatgacgcagttacctggccatttctccacggttcccgtgagggccccacacccaggcgcacaagaacccctcctgcattccgtcctcacacgcaggcctgtccatctacttgctactgtcacactcttgccagcagaagaggcccctgtaatggccgatatcaccacccagtctatcctcaccccacagctgtgcagcgggaacctcctgctggcccacgtgcttgccacagcccgtgctggcacgacgctccagcaggtcggcgtccctgcgggccacactaccggtgacatggctagcatgaccctccttcctggcagtgacactgttgatgtgaaccccagtttcacatctgtcatttgtaaataggaccattttcccttttc

SEQ ID NO: 468449 - DNA, 1224 bp, Homo sapiens
tcctccaggccaccagaccccttgcagccttcttcgttatgattgcatgtgctttgtcacagggctcttctctgagatctgtcttctctgagtggaatccatggccagtacaagtaatgtgactgagttgattttcactggccttttccaggatccagctgtgcagagtgtatgctttgtggtgtttctccccgtgtaccttgccacggtggtgggcaatggcctcatcgttctgacggtcagtatcagcaagagtctggattctcccatgtacttcttccttagctgcctgtccttggtggagatcagttattcctccactatcgcccctaaattcatcatagacttacttgccaagattaaaaccatctctctggaaggctgtctgactcagatattcttcttccacttctttggggttgctgagatccttttgattgtggtgatggcctatgattgctacgtggccatttgcaagcctcttcattatatgaacattatcagtcgtcaactgtgtcaccttctggtggctggttcctggctggggggcttttgtcactccataattcagattctcgttatcatccaattgcccttctgtggtcccaatgtgattgaccactatttctgtgacctccagcctttattcaagcttgcctgcactgacaccttcatggagggggttattgtgttggccaacagtggattattctctgtcttctccttcctcatcttggtgtcctcttatattgtcattctggtcaacttgaggaaccattctgcagaggggaggcacaaagccctctccacctgtgcttctcacatcacagtggtcatcttgttttttggacctgctatcttcctctacatgcgaccttcttccactttcactgaagataaacttgtggctgtattctacacggtcatcacccccatgctgaaccccatcatttacacactcaggaatgcagaggtgaaaatcgccataagaagattgtggagcaaaaaggagaatccagggagggagtgaaaaaagagcttagggatgaaaaagtgatacaaaatgtatgtctgattactctctgttcttgaaatggattttgattttagtgggatattcaagaatgacagaaacaaatataaaggcttaatgatactgctgctgtgattctgcttagtagccaaagacacttggtatgctggtgtaatgtttgaaggacagag

SEQ ID NO: 468450 - DNA, 948 bp, Homo sapiens
gagggtctgcggcgtcattcttgaagtcactacctctccttcatggagatctgctactcctccgctacagcccccaaactcatctcagatctgctggctgaaaggaaagtcatatcttggtggggctgcatggcacagcttttcttcttgcacttctttggtggcactgagattttcctgctcactgtgatggcctatgaccactatgtggccatctgcaagcccctcagctacaccaccatcatgaactggcaggtgtgtactgtccttgtaggaatagcatgggtgggaggcttcatgcattcctttgcacaaatccttctcatcttccacctgctcttctgtggccccaatgtgatcaatcactatttctgtgacctagttccccttctcaaacttgcctgctctgacaccttcctcattggtctgctgattgttgccaatggaggcaccctgtctgtgatcagttttggggtcctcttagcatcctatatggtcatcttgctccatctgagaacctggagctctgaagggtggtgcaaagccctctccacctgtgggtcccatttcgctgtggttatcttgttctttgggccctgcgtcttcaactctctgaggccttctaccactctgcccatagacaagatggtggctgtgttctacacagtgataaccgcgatcctgaaccctgtcatctactctctgagaaatgctgaaatgaggaaggccatgaagaggctgtggattaggacattgagactaaatgagaaatagaggctgagtctttgtattgatacttgggtttagaatgactgttgagtccaaactgaaggagcagaataggttgaaggaaagttcacaggacctgttagttgcagattattctacctggcctctctctttaaaaagttcattttcataacttgaatagtatttctttttgtggag

SEQ ID NO: 468451 - DNA, 1043 bp, Homo sapiens
aggcataagaaagaaactgagaagaggaaaggaaaatcacaaagcctcaaccactgttcttggaggaagctcctgtgctttaaaatatggttgctacaaacaatgtgactgaaataattttcgtgggattttcccagaattggagtgagcagagggtcatttctgtgatgtttctcctcatgtacacagctgttgtgctgggcaatggcctcattgtggtgaccatcctggccagcaaagtgctcacctcccccatgtatttctttctcagctacttatcctttgtggagatctgctactgttctgtcatggcccccaagcttatctttgactcctttatcaagaggaaagtcatttctctcaagggctgcctcacacagatgttttccctccatttctttggtggcactgaggcctttctcctgatggtgatggcctatgaccgctatgtggccatctgcaagcccttgcactacatggccatcatgaaccagcgaatgtgtggtctcctcgtgaggatagcatggggcgggggcctgctgcattctgttgggcaaaccttcctgattttccagctcccgttctgtggccccaacatcatggaccactacttctgtgatgtccacccagtgctggagctggcctgcgcagacaccttcttcattagcctgctgatcatcaccaatggcggctccatctccgtagtcagtttcttcgtgctgatggcttcctacctgatcatcctgcacttcctgagaagccacaacttggaggggcagcacaaggccctctccacctgtgcctctcatgtcacagttgtcgacctgttcttcataccttgctccttggtctatattaggccctgtgtcaccctccctgcagacaagatagttgctgtattttatacagtggtcacacctctcttaaaccctgtgatttactccttcaggaatgctgaagtgaaaaatgccatgaggagatttattgggggaaaagtaatttgagaagagaagtagatgatttagttagggaaaataggagga

SEQ ID NO: 468452 - DNA, 735 bp, Homo sapiens
atcatcatcgaatgtaattgaatggaatcatcattgaatggaatcgaatggaatcatcatcgactggaatggaatggaatcatcatcgaatggaaaagaatggaattatcatcgaatggaatcaaacggaatcatcatcgaatggaatcgaatggagtcatcatcgaatggaatcaaaatgcatcatcatccaatggacttgaaaggaagcatcatcgaatgtacttgaaaggaagcatcatcaaatggaatcaaatggaatcatcattgaatggaagcaaatggaatcatcatcgaatggaatcgaatggaatcatcattgaatggaatcaaatggaatcatcatcaaatggaaccgaatgtaaccatcatcaaatggaatcgaatggaatcatcattgaatggaatcgaatggaatcatcatcaaatggaaccgaatgtaaccatcatcaaatggaatcaaatggaatcatcattgaatggaatcgaatggaatcatcaaaaaattcatcgaatggaatcgagaggaatcatcgaatgaattccaatggaatcatcatcgaatggaatcgaatggaatcatcgaatggccacgactggaatcatcatcaaatgggattgaatggaatcatcaaatggacacgaatggaatcacaactgaatggcaatgaaaggaatcatcgaatggcatcgaatggaatcatcatcgaatagaatcaaatggaataactgaag

SEQ ID NO: 468453 - DNA, 959 bp, Homo sapiens
tatcagctcctggagcttctctcaagtgggcggcagcagcagcttccggggtggcctgggcaccgcatggctctgggtggaggctatggtggggccagtggtatggggggcatcacagccatcatggtcagccagaacctgctgagcccccttaagctggaggtgaaccccaacatccaggctgtgtgcgcccaggagaaggagcagatcaagaccctctacaacaagtttgcctccttcatcgagaaggtgcggtccctggagcagcagaacaagatgctggagaccaagtggagcctcctgcagcagcagaagacagctcagagcgacatggacagcatattcgagagccacatcaacaaacttcggcgccgctccctggacatggacagcatcatccctgaggtcaaggcgcagtacaaggagatcgccaatggcagctgggctgaggctgagggcatgcatcagatcaagatgccaacacgaagctgtcgagctggaggccgccctgcagcggccgagcaagacatggtgcagcagctgtgccatggagcaccaggagctgatgaacgtcaagctggccctggacatcaagatcgccacctacaggaagctgctggagggcgaggagagctagctggggtctgggatacagaacatgagtgtccatctgaagaccaccagtggctactcaggtgggctgagctcgacccacgggcacctcacaagccctctacaacaggccttagctacagcctgggctccagctttggcactggtggaggctccagctccttcagccgcgccagcttctccaggtccatggttgtgaagaaggtggaaacgcgagatggcaagctagtgtccaagtcctctgatgtcctgcccaagtgaatggccatggcagcccctaccagcctgcccctcctgcggctgccccagggcccgtggaggaagcc

SEQ ID NO: 468454 - DNA, 580 bp, Homo sapiens
cactcctcagcccttgggcggtcgatgagaccgggcaccatggagcagggggcagcgctcatctgggaggctcaggcaatgcaggagcccaaggtggagggcagggagattcaggcatggcgggctgcaggtcccaagccctgccctgcagggaggcagctaaggcccagtgagaaatcgagcacagcagctgctggcccaggtgctaagcccctcactgccccgggcttgtgggccgtccggctgctccgagtgcggggccggccaagcccatgcccacccggaactcgcgctggcctgcaagtgctgcgcagccccagatcccacctgcgcctctgcctccacacctccctgcaagctgagggagctggctctggccttggccagcccagaaaagggttcccacaatgcagcagtgggctgaagggctcctcaagtgcggccagagtgggcaccaaggctgaggaggcgccgagagaaaagggggagagtatcacatcaagggaacaccccatgggacaaaggaaactgaacaacagccttcagccctagaccttccctctgacagaggctacccaaa

SEQ ID NO: 468455 - DNA, 674 bp, Homo sapiens
aggaggtgcctaatgagagaactcgttcccctatcaaaaataccatctgcaagttacttgtgtacataggaaaaagtccttcgcatttctggtataagaatttaaattaaaagaggaatgaagcagttttctatccacaatatttgtgaggatgttttatactcctgcttaaagtttaagttgctgattacttttcaaatagataatttggtggccatccacttcaccagagacgctttcaagaacatcagtaagctctttgccaatgagtccaggagagacctggaaccagccatggacctgttagtgctgtctcacggacaccagaccaacatcctggacatcatcctcatacaccaggaagctcttacccaaagtcacggagaacaggcaacatgtggcagaagggaaaacagaggtgcagaggctgatggcgttcattatcacaggaacaggatttctttggccacttcggctgaaattcacacttccatccaattcactcaagcgagagacttgaaatcacagatggaccatttcttgcaacaagagatactatcttttcaaaaagtcacctaaaatttgatagtgttgaatgactagctattctattgtggactttttccagttcacgggtactttctacagcagaatgataacagtatcaaagagct

SEQ ID NO: 468456 - DNA, 766 bp, Homo sapiens
tttggttcagaaatttgctcaaagaaactcggagagctcaaaatgcaaatccgtggggctccaaaatccaagagacaacttacactccccagctactctgagagatcagaggacacaagtggatcctgtgggcaccttacttgttcactcagcactcctggggcagctgacagtgtgaacaagcagccctgggaggagaggatgcttggcggcgatgccacagtcatagtggttagacatccatctctcacgttaaggggtgcttgccagtcagctgtgactgtgtctcaggtaactcgggaccaaatgaagatgtttatacagcaggaatttaagaaagttcagaaagtgattgctgatgaggagcagaaggcccttcatctagtggacatccaagaggcaatggccacagctcatgtgactgagatactggcagacatccaatcccacatggataggttgatgactcagatggcccaagccaaggaacaacttgatacctctaatgaatcagctgagccaaaggcagagggcgatgaggaaggacccaggcaaaaagctcctgctgagatcactgtgaatctgacccataccgattctgcgatcaaacaggaagcgtgttctgaaggagtaggagctgaaggagaaaaatatagcgtttcttctggaccttgacaaatggataggtctaggcttcttcagattggaaaaacaggaaagctgtctaagcaaagagtgtttaagttcaggggtacatgtgcaggac

SEQ ID NO: 468457 - DNA, 636 bp, Homo sapiens
tccccgaagccttgcagcagtacagcccaggtaagttgctgaggctgatgggtgtttctgaggcgattggacagtgtcagtcttcagctgctaagctgagaagatctgggaagtcagtcagagagccttgggccagagttccagggcatctcagagtggctgccaggcgagttggacagtctgatttccagtggtgtcctgcacagatgagacatggcttaggaggaatcccaagctgcgagcattccttaacccaaacagaggctaacagagaagaaggaggaatggagggtggaagtctgtccatagtgaaggaggcaagcccagagaaaagagagggtataggcatggggggggtacttgccccccaaggtgaggtggtgcttgccaccaaggtgaaggatcaaagcaagcgtccccttggtgatcagacacctctgaaatgtggttgaataatcagagaaagtaaatgctagctaatgttgatagaatgtcaataccaaatatattttctaaaaaagcaaagtcatatttacttccatcctgtaaacctttatgtggaataacatacacagtgtcattttcatgttaatgatgagagaaaacacagtttagagctaatgagggatagttatc

SEQ ID NO: 468458 - DNA, 618 bp, Homo sapiens
tgggagcccaccacttgcatcagtgtgacctgaacatgcactcacaaggggctcctatgggagagaccgcagtcatgcctggagtgatggacaaaagggagaacaagtccccttctccaggacccttcattccaggcagtttgtgttcagaactcaaaactgccctaggccgcaagctttccccatggagacagaaactgtggctttcaggccacatccctcctagtatgcccaagaagcaggatcacccaactcctgcactcttggctgcagcacacttcctattcatccctgggttctggtcaaatgaatttgtctccactcgagattatatcatgaatctcagttctgggatacatgatgtgcagaacatgcaggtttgttacatagctatacacgtgccatggtggtttcatgcacccatcaacccgtcatctccattagttgatcttcaatctatgatatcccttcttctgcttgatcaattcagctattgatacttgtgtatgcctcacaaagttcttgtcctgtctttttcagcgccgtcaggtcatttatgttcttctctaaactggttattctagttagcaatttgtctaacctattttcaaggttttt

SEQ ID NO: 468459 - DNA, 966 bp, Homo sapiens
ctgcatcacagtagaaggtgcatgatatcagtgtggcctattggtgaggccaattgctgtagcaaagtcttcattgtaatgtgcaactgcctgatagttttatcgatgatgctaaaggacccacacttggtcaaggctctctcatggttccagtgtatatggaagctgtattcagacctatgctcttacaaagaattctttttcaatgagacgtttcagtttctgttctggaccatgttcggtatggaagagcacagcgtggtggacgtgcctcagtttctggtgcccgagtttgcaggccgggccctctatggcatctttaccatcatcatggtcattgtgctgctcaacatgctcattgctatgatcaccaactccttccagaagattgaggatgatgctgacgtggagtggacgtttgctcgctccaagctgtatctgttctacttctgagagggcctgacactgcctgtgcccttcaacatcctgccctcctcgaaggctgtcttctaccttctcaggtgatgacctcagagctcccactcccaccccctaaatccccagcccctgcccccatttccctgtcctctaaccgacctcttcccaccactgaaatctctcaggagaatttgccagttcatttgctgttgctgttcctgctgcaaaaccaagaagccagactatcccccgatccctacttttgtgtgttcagttattctcccattcactcccttacccagtcactcattcacctttttcattcactcgcttattgactcgttccaccaacattcatcactatggcctcctttgttccaggccctgtcttggagggagagacggggcactgtagggcagggacacacgggaagctttcagtctgattcacctgccccagcttcacccacccacctgacccctagcccacaaacccgttcctcacttcttccagttctccctcaggaa

SEQ ID NO: 468460 - DNA, 2373 bp, Homo sapiens
ccgccctatggtgggagaagggcccgatgtggaggctcacggagcgtcggcggaaggcgcacaggatgctaaagctttacaatggcctctcgaaaggggaggcggtgggactccccgcggggcccgaccccctggactccactgatctgaacggggcgcacttcgacccggaactttacctagacaagctgcctagagagtgccctctggcccagctgatagacagtgagacggacatggtgccgcagatccgggctctagacagcgacatgcaaaccctggtctatgagaactacgataagttcatcccagccacagaaattgacaaacagtgtaaaactacctcccagtgccaagtgtataagtgtgtccagaattggtgggttcttggtctcactgacttcaagaatgaagctgcggaccctcctggagtgaagctgcagaccttcacgtgcggggccaccaagcccacgcccacccagaactccagctggcaagcaagcagcacacgtagccccggttctggctcatgcctcttcctccacacctccctgcaagctgagggagccagctccaaccttggccagcccagaaaggggctcccaccatgcagccacgggctgaagggcccctcaagtgccaccaaagtgggagcccaggcaaaggaggcaccgagagtgagcgagggctgtgagggctgccagcgcgctgtcacctctcataaggagtgattaatctgagcttctccagaaagtccattcctggtaggcactgggaataagaaatctcagagtataaaaaacatcaagtggtagcacttttgtgaatggctcccaaattagatcctttacctttttttttccatgaagcacagctgcacaaaacacgcttagcctgagatgaagcacatattagagaaaagttctctctatagcattatgtattactcaaatgagcattaaaaagaggagatgggacatgctctctctagctattattacctccactatacagttgacatacacaagctcattattgcattatgctttattcaacaaaataactttaatgttgaagcttaaattgaattcgttaaaacatctttgtctccagcataatgtgcctcaagtgtcttcttggtgcctgaattttctccacaattatagtgctgaagctatggaaatggtgaaattatatgcaatctgcaaaacaatgtggctataacatggtaattggacttccacataattaaatgaacatttcctcatcagagctgttccatcagagacccaaaggctatcgtacaaatcacccacttaggaaaacctttattcccagtagcctataaaaatctggttatgcaaacagatttgcttactcagtaacatgaatggcttctcatagttaaaaagtcatcaatgtgattgacctataatctgtttcctctgtgaccaagtgtcatttttattttgacagttaggagccttttgactctttcacagctggcatgaaggcacagggagggaaatctcaaaaaccaacaacctgtgtattcccagcctattaatcaatagaaaatcacttcaactggattagggtcttgtacctggcagaaaggctcttatggacattggaattggatttttacacttgatatgacacctccttgagtcagatgagattcgtgtttgatagactcttgccaaaacattgctccaggctgccctggggactagactctgccttaggcatccctctgactcctgtttgcttttacactgaggctgctttaagtcgcaccttgatctgaagccttgggcttctgttcctattgcttgcttttgttgggagggctgtgcagcttcttgacaaattgcaaaggtgcccacgagtttccaagtccccaacaacaaaaccagatgacaaacaaggatgcagcccacggctggggagacagatttcatgtccacacagatattccaagatgctgaactgaaatccaccccgaaacctgttttctctctcatttaagttcagtgttacctgggggcttgcagggcagggctggtgaccattcccagggcaaagatgctttgaaatgtcaactgagaatggtgtggtggttgacagatggcactctctccttgcaactggctctcagcagggggtgggaggaaatccttgacagaaccaatttacatgactgtttggaggactctggctagccccaggaggtgtttgcatttttaaatggttactagtgtcagaatgtttcatgagtaagagcacagcctctatgttggatgccctgaatttgaatctcagcattgccactttgtatataaccagaggatggatttggggacccaatgg

SEQ ID NO: 468461 - DNA, 625 bp, Homo sapiens
ggacatctggctcacagctggcctgaccaatctgaacaacaatggcaaagcaggctttatcaggcctgaggttcagagagtttagggatttacccaaggttgcggagcagtcagcagaattgagatttgaccctgatctatccagctgtggaaagattctctgcgacggtacatcctctgcgatggtgcgccctaaaggccatcgggttatacagctctgtgtagcccctgagcaccagttcaccttgccaggtaacacagcttgctgccttgaccatactgaaccagatacactttccttcaaacaccacactggtccctcaccccatcctagtgttcttcactgtacttacagccatagtcatttactcactgtgtgtctcctgctctacaggagtgacagagaaatcagtgccgtggttgggaaaataacccatattgagctgactcatcacccgaaccaacagttgacaattcctttgactgctagtgatatgtttaaagtgaaagttttgatgacataagtgaaaatgaagaagtagaatcaataggcttaagattgttttttagggtgtcagggctgaaacatgaaagaaagtgagggtttggcaaagcccatattttt

SEQ ID NO: 468462 - DNA, 679 bp, Homo sapiens
tccctgagttttctcttttttcagttgaatatccccagttcctccacatctgctgttttctgagtataatgacaaactgtagggtaatgaggcagattctcaagcatgattcaggctgtgatcctggagttggtgctcaagccccagtccagatgactcttagactctggcacaccgagggtgacagaaccctacattgggatagggactcaagtctttgtgagttgaagcagaaaagacgaggactcaactgcagaggtccaagtccactatggcaagtgaatagatacaacaccagggtgggagtcaaggactgtgaggaaaaagctcatgggcaacaaaatgcccagggcaaaggcaccatcctccacccacatatgtgcccacaaagaagaaagccagaaaaccagccagatagatggctgctgaaacaattcaagagagacatgatgatctactataatggcggtggagaacagatagaaattacttttgttaaaatacttctgggcggccaaatttcaacctgaagccaatgttcgtatccaaatcacaaataggaatgagaaatatgtttgggttatttccccccactctcatttttacttcctcaatctaaactttcctttatgttaactgttaacagaagtgttacttctgttaatacttgaagacattg

SEQ ID NO: 468463 - DNA, 1501 bp, Homo sapiens
aggaaaaagttaagtgaaagaaggcagaacagaataattcgatgacaatgggcttcagacaaggggagagaatgacaacttccctcacaaactgtgtgacttttaaacccacttctataaaaccaaaatggcaagagtacccatcttatctagcactgtcccagggctgttgtgaagatgaaatgataggcattgtcgagaagctcagtaacagctgttctctgaagacttccctgatggtattagatgctgttacagaactggactgcctagcaagaattgatataataaaatcactcaatagtagaggccacgcgaagcttttaacttccagaagcaaggatccttctttgtgcccaaacgcaatacaccagcaaagtctaaacaaagcttgtgccacactgaacaaaggaagaggcaaaggaatggaaaggggaagtaacttgcataatgtcacagatagtacgtagtgaaaccaggacttaaacctaatctgtcactaaaaccaatatatatttagaatgagccagtaggtataatggtaataaacacaagactatgagctctccaagggcaggaatttttgtatttttgtaatgatatgattcaaggggtctggaacaatgctagttatatagtaggtactcaataaatattcactaaatttggatgatcttccataatactgtattagagccataccatgatactcactgctgcattcaatgggtatgatagtgtgccacgactaagcaatgttacctaataacctagcataagatctggctttaccacctgcgtattctaggacgccttagagtttcacattaataataatatataagatgtaaataataaaccctactctctaaaaggatgtgaagttatgctgaagtatgtgaatgtggtagcatgccactgacacgataaaacttactttcactcttctctaaatccttttctagcaacaggactgtcatgcacaggtatgcaggttgtatgcacatgactccaggagataccttttacattgtaatctctgtaaacagtgactcttgaagttcaaggaatctaaatggcttcatacagcagttctgaatctagcatagtaactacagcaactagatgacaatgagaacacggtcattttcaagtgatccattcatcattcagtgaattaacgacctatagatcaaggtggatttattttaccctaaaatttgacccattccagaaacagtttttaaatgtaccaagtgctgattaagagcaattcaacaaatgcatcatcaaatatatgcccaaatatatgcccagttctgtgctaggcatcaaagggagaagaaaactgagttaaaaacatggttcacatccactcccctatagaaacttccactttactgtcccccagagacttccatgtcaactcatgcattagtcacttcttcattcttattttatttggcctctcagcagcactgaatagtctttattaaaactc

SEQ ID NO: 468464 - DNA, 965 bp, Homo sapiens
ttaatctacaagctgccgaaaggaacaactcaagtcatactctcctcactcaagtcttgattgttaacgaaatgcatttggctccaaaagatatgggctccaatggagaagcttatgagtgctgccatagaaatgaagtgaccataagcttcattcctgaagtcagcgagaccacgaacccactgggaggaacaaacaacccggacgcaccacctttaagagttgtaacactcactgtgaaggtctgcggcttcactcctgaagtcagtgagaccacggacccaccagaaggaggaaactccagacacgtcagaacatctgaaggaacaaactccggacacaccatctttaagaactgtaacactcaccgcgaggtcttagatttaccagaccaaatgccacagggaaaccccatgtttcatttttccaccaaaaggagcatgatctgcacatgtgaccaaatcagaagacaaatgtgtagatacttgccttaccctaatatcaaacttgttttgaagtgtgggtgatataacttttactcctctctatcctaacttttatttaatgcttaagaaagccaacaatgtaacctgaagaggtcaaatgtgattaggaaggacccatagacatgatattatcagaaagtggctgacctgtgtgggcatgtatcaaagaaaaatgacattttttcccatatgtttcctaagaaataggacactgaaatattgttccacaaaacaagatgaagaccgtggataacaacaataataataaataactaatgtggtgcttcacattttaaaggatacaaaactatttcacatacattatttcatggctttcctattcgcatttacaggtagtgcctatttttcttggactgaagcacatatttcccaactgctagtaaggttaggaatgttatcttgcagagagtgctccgttgttagccctcaccaataatt

SEQ ID NO: 468465 - DNA, 951 bp, Homo sapiens
actgcctgcacttcttggctcatgacttcttccttcaaagctggccattgcagcgtgaatttgaaaattttaaatgtaatttgtaaagctcgaggttccagctgccttaattctgaagaatctgcctgtgcaaggattttgaataatgcagaaagtggaagacagcaagctccaagaaacttaaggcctgagactgcaggctggtactcacggactaagcctccaggcctgccctggtacccatatagccccagacttttggcccaccccagcactaggtcagcacccctgggttcaggcaggaagccagcacccatggtcacaggcttcacttcttcccagtatcagaccaatccatgtggccccactctccaggccagcccctgtggtttcacgttccaggcctgctccagcagactgagtgtttgggcttatcccagtagtccctggtgtgaggccagctctcatgaccaaggttccaagtttactcctacagacctgagaaataagacaggatttatggtgtcaagaataactagcccgtctattggttttggacatgacagaattatgtaggttttatatcactgtaaaagacaacaaaatccttggcatatgcatcatatattggatagtttaacatgctgtgctgtaaaataaaaaatgttatcacacatctatggagagtgagagaaggaatatgaatgaggaggatgcctaaatgagaagatttggaaaaaaaaaaaaaagatatttttccatatgtttttctagaattttagcatttatgtttaggtgtatatttgatctaaaaatatattctccatacactatgaggtttgaaggtacatgtgcagatttgttacataggtaaactcatatcatgggggtttgttgtacatattattttgccaaccaggtactaagcctagtaaccaatagttatttatt

SEQ ID NO: 468466 - DNA, 555 bp, Homo sapiens
taagataagatacagacacatttcttcttggccatgaagatgagccaaattgccttagctatttggtcttacccatggtgcaacacttgccagaagtttctccagggaaattatgcagctctaagcagctccagatcttttagccccaagtttcctcaaaataacctggacattttccacactcttcagttccacctcactggtccctggacgagttgtgaatctatcaataaatcctttaaaaggaaaagttcctataacctggtcaggggtggcatgggaaaggaagacttggaaagactatttgcattctgcagtgctgaagaagtacaagaggagggcatcactcattctctggtcttggtctgtaggaaaatgaggaccccaagaaactgctggagccacaaatatggcctcggccatgtggtgcaaaagcctgtgtgggctcctgccaagacaccaaaatagcttattcatattgaaattttagtctaatccaggcccatgatagaccttggatagtgccaatttctaaagaagagaacatgtaaatag

SEQ ID NO: 468467 - DNA, 543 bp, Homo sapiens
aaatcgggcttcatcaacttactatgcttccaggagcagcgctgcccaagaccatgagaacccacctcttgtatcagttttggaaacttccttcccatgcattgtttaacaacaacaacagagggaggtgctgttttaaaataattcgtgggtcaaatagaaacttggtggatgttggtcactgttttggtgtagtctgtggaatgggtcaaagggggatagttttcacactgaaggaaaaaaatgagtattctattcttgatgatgaagaaaatgggtgcctgaaaggtctagtcattaacaaagttgaaagacacctagaggagtaccgagagccttggaggatgagcacccacagctgtttttcactgcagctgcccctgaaccaaaccttctgggcttcatgcggatttgggttctgtctgacaactctctgggaagatccccctgccaacacaaattgggaactaaccaaatgagtttattaaatgaaagaaaagaggtttgcagaggacctgaaatctaggtattgacaatcgagac

SEQ ID NO: 468468 - DNA, 1775 bp, Homo sapiens
cttctcacacacgcagaaagaagtgagacctgagctagcatgctgtcccctcatcatgagatgccctgcgccacctcaggatgctggcgagtgtccccactggcaagaaggccctcaccagatatactgtaagaaaatcttcaaattcattgtacattatcagttccccaaggaagacgagcaggttctgcattccatctcaaaatgttgtaaggcatttttatcagacaaaggcatccttctcacaagccttccacaactttcttcctcttctttaaaacacatacaaactgtacaacttgaacattgtaacagtgaatcttcctaccgagatctgtacggtgaccacagcaccagagtcaatgttcatcaaatgacaacttatcacatggctgaagaacacatgaatttgggctatagaagaatagtcattccgcagaaggaaaaggctttattcagctgggagcatcggcagactcaacgtctccaaaaactgagcaccccgagtgagcaattcctgtcccttttaagggcttacaactctaagggggtccgtgtgagagagccgtgatcgattgagcaagcaggggagaatgatattctgcttctgaacaccagccctaccactaaaatgctatctatccaagttgtcctccaaggccacacaggtggtgtgagcaacatatagtttgccaaagaggacaataatcagatcattttaatgtatataggcaatttattgccccagagacaggatggatccagggacaagatggatctgtcaagcaacctattaatgccaatattaaaggcttacctatttggggaattcaacttatgtacaattaaattaaattcttactttcccaagttttgtattttaactctgtcaatacatatgtatcgaaatatttttccacaagttttagaatttgttctttcttttttaaaaaattattttgtatgtgccaaatgtccttttaccctttttcaacatgaatagccaaaatcattatttatttgcaatgaaaactgccctaaataaattgctttcttaaactaaacaattcatttatttgtgataatccaaactttctcccctgctgccatctttgtttcaactgttcattaaatttgatataatcctgggcccctgcataggatagagttctttgaaaactttcttatatattgaattattttttaaatttgaaacacaaatggacattttccttcagatgcctgaaactacactatagaaatgtatgcttcatattttcaggtgctgtctgtagatgttggtatctgaaaaaaatgcaaattcttatgataatttgtaaaactttcattgtaataagagccattgtttattaaatgtctactatgtgtcaggtaatctctttatatatttattacatcgaaatcccacaaaaaaatcatcaaagtacatgctaactagcggataagagaaatggagatgctgagaagttaagtgacttatctaaagtcacccatctgaaactggcaactgacccaagttatttctaattccaaaaccatgagcgtttgaatacaatacaatttaaacaatgttttaataatttattatgaaagaattcaaatgaacagagaagttgcgaatatagtatagtgacctccaatatccttgaatccagtttccctattaacatctcaatgcatttgttccatggcattcctttttttcctccccttttcttccctcccttcccttcctttccatacttttctttttc

SEQ ID NO: 468469 - DNA, 556 bp, Homo sapiens
aaaatatagaggcagtctgctatggaccctcttctgcaagtctactgcactttgttggatgcccacttcagactctgtttgcctgagtatcaccagtggaggctgcagaacagcaaagattgctgcgtgctccttcctctggaagcctcatcccagagaagcaccagcctgatggcagctggagctctcctgtatgaggtgtctgtccacccctgttgggagttctctcccagtcaggaggcacagggctgtgatgccaaccgccgctgccacaagccagatgctctgtcccagggagatgagagttttgtctgtaagcacgtgactagagctgctggatttcctgcagagatactttgcccacatgaaacagagagaaaagaattctcatgtggtttaagacacaagtttgatggagatttccaggggattcaaaagctagaagcaactacagagctataaatactgtgaaaccaaatacacatatgcagccttctcaggatggggttaaactctttgcagagctgtggttcactgttatgtaattctaaaggga

SEQ ID NO: 468470 - DNA, 557 bp, Homo sapiens
aacattgccatggcatctgtaaactgtcatggtcctggccctccctcagaggtagtggaggaggaggaggaaacatttgaatgcagatttaggaagccggtggacagtgaatatagaaagaaggcaattttttactttctgcggaaagggtacactcgccagcagttttgccatgagaggagcttcttctccattggaagctgtcactcaagtaattataatggaggtggtgataggaatggtaaaccttgtgatgggaacatcagtgataatatgagatcatataacagagacaccaaacctagattcagagactcagaaaaagatttctcaaaagaagtgacacctggactgaccttaaggatgagtaaaagcccaccagctgaacacagcagtgaatctcttgaaggcagcagatagttggctggttacctggtacttttatctcacagctcttaagattctttcctttgtcttaactttagataacctgatgacaacgtgcctaggtgaagatctttttgtgatgaatttcccaggtgttctttgtgtttctc

SEQ ID NO: 468471 - DNA, 2066 bp, Homo sapiens
ggtcagtttatgatactacagggcctgccatgaatacttatccgtaaaatggaatggagacccgtgaacacaggggaggagcttctgcatgttagtttccagcagtcaactaaggtaacacattgtttccaactaatcattccaaagccatccccagctgcttacaccaaacttactctcatggcaagctgtacaatctacacatatcaccttatcattcctggtgtcctatgtggttcccatcaacaactttctctctcttgctcatgtgtcatacaagaagggtcttggcggtggtctgacctgccatggactgtccatctgcccggactacagcgagaattcgatgagggagaagagtcaggcctgagaccagtgcgaagaaaagaagggtcattgaactattataaaccagtgatgtttctagagttttcctccaatttcatcaaagaaggagaaacagatatagtgacctaacacgtagtttttagaaactgttgttacagagttaagagctgaaactttcacaagtttttaaaaccaacaaacaagcacaagaaaatataatattttctatacaaggtattctgatgatataatagttttatattcattcatcttattaatcaaagatggaagtaaacaaaagaggtcatagatgtttttgctaataaaaaagagagggagttccttactttcattatttaatgttaataataatcataattggaaaaaaaaaaacccatagattcgaagttaagtggcttgcccaaggtcaggtttaccaaaatatcatttattctatattcaaaggtctttcactcaaaagactcattacctgaagtattttaatgaaaatattatagaatttaatataaaaataaactattagaagatggagagacaaggcttcaggagtactctcagtgacataccgagtaaaacttttcttctttagagacagccttgtaaaatggcattttgttttacttaaaattttaatcgtctttccgtaaagtaaactgttgaggacagattatacctatactgaagctcttagtataaagtacttattttttccttaccataggtttgttaattttttaaaacttttagttaacatttgttatttctgatcataaatgtaatgcaaaaaacgttcctgaaaactgaagtataaagtatttgttcccttaaaggtcagggacaagataaaaatatgtgctatcattgcaattgttcaaagagtcctggctgatataaccagataagaaaagaacgttaataatctgaagatacatgattatctacaatggaacaattattagaaatcatagtttcagaaaggttgccagatataaagctaatattcaaaaaataaattactggtcccttttcaaagacaagtcaaaaacttaagagaaaataagatcatttcctttagcaacaaaactgtaatgtgtctgtaaattaatctatcaagacctttatagagaaatttataaaacatgatggacataatagaaaatataaatatatggaaaattacaccacaatcaacattatgacttagtattataaaggtttcaaaactatcctaattagtcaataatttgaaaatgacttcaacaaaattaacaatatatttataatattaataagctaacttaaaattttatataataaataattggaaatattcacttaagtatataacttcaaagcatgaggacaatggtacatgctcatgaagatttttttatacaaaaattacaatttgaattattttctaccataggaaatattcaaaaagtcttcctgttagacatacagtatatggcaaaagatagaatgcctataatgaaactcccatgtctcagctgttgtaaatattaaaatgcatactacatataaaaagtaccatgcctagttattcaaggttttcaaaaacaaagatgttgtaaagatatatgcaataactattactaaagcataatattataacattatttaaaaagcatgtgctttgaagtctgcagacctagaatacagttcttctctatcac

SEQ ID NO: 468472 - DNA, 1651 bp, Homo sapiens
aatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacccgaagtcttctgttgatgactattgtgtgagaacagacgaaacactgagttttcctcaaaaaccacggttaaaggtgcttggtgaagaaggaattccagcgtgtggtttctctttctttgagaacctttattgttcttggagctctttgaaaggcaaaggactaaatttgggagtaaaagtggttgtaagaatatacagacatttattttctcatgcttcagcttgctttcttttcctggagaagaaaccaagggtcacggtgggtgatgtggtggcagagtcagaactagaacttgggcttctgactcttaccctgaggctcctttcactgcttcgtgtgaaagcctttggagtgtgagtgtgtctgttaatctgggagtcattaggatggcagaatagcgaggtcacctggattagcagctaatgaattccctaccctttgttctgataacaggataggacaataaaatattattcttaagcttctgagagggaatttacttgactcaggctggtatattttgcaaattagtgatatcctgtgcacagctctgtcctagaatgcctcccctgcactgcagtgttgatgtacaagtcgtccccctctttggacttgccgaatctctaacagtggctgcgtggatccatgatttcagcttcaactagggggcttctccttcatcattacagctcccactggacttcagtcatgatatccttcaactttcccaccttgctctgcagcctggggctgtgtcatgctgtgtcctccagagagagcagcccatcaaaggcatttctcatccttataaccgtggttttcatttctaacaattccatttgattctttcttatcgtttctgtctctctgctaaaattatccatctgatcttgcacattgttcgccttttccattagagcctttaaaataattatagttattttaaattctctgacagatagtttcaacacctgtgtcatacctgaacgtgattctgatgatttctttgcctctcgggaatgtgttgccttttcttgcccttttgtacgttcagttgaaagcgtgacatcttgtgtagcatggtagagcctgactgaaaggattttccccagtgcctaggcaggacagtgttcgctgcccttctcttcacagatgaagggtgttgttcctgatggaagatgaggtgagcagggtctgggtagagtggtcaggggtgtatgctcctccctcagcagctgctgtgaccttcccccaggtcgaccacaaaggacactttcttcttaaatctttcctcactcttttctgtgggaaaactcctggtgggatttgtagagaaaaaagtccctaagaagacatggacctgcccaattgctacagcctccaagggcttcagactctcttgccagtacacacttagcctttgtaaattcaccagccatcccagctgaactctttctcccc

SEQ ID NO: 468473 - DNA, 1296 bp, Homo sapiens
agcaaactgtgttcctgatgcagccaaaagctgccacgacactgcccagagagcgaggggagtgtgaagcagcagcactggccggcagcggccctggcgagtttgcaggctccctggctctgcagggacagagggagctgggagttcacctggagtggcccacagacttagccatcaacccaatggacaactcactttatgtcctcgacaacaatgtggtcctgcaaatctctgaaaaccaccaggtgcgcattgtcgccgggaggcccatgcactgccaggtccctggcattgaccacttcctgctaagcaaggtggccatccacgcaaccctggagtcagccaccgctttggctgtttcacacaatggggtcctgtatattgctgagactgatgagaaaaagatcaaccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgatggaggacttcttaagaggtgtgatcagagaaccagaagttcagcttattataatcctagcaacaattaaatatatatatctggggtgttcctctaagagatatttaatgaatggactaacatcgctctttctacttagatttttttaagctgctttttgaggtcttagccatggttcacacgactgagattgctgaatatgtcaccattagataagcatgtgagaggtggggaaggaactagccttgttgagtattagctgtgggctaggagct

SEQ ID NO: 468474 - DNA, 1353 bp, Homo sapiens
ctgggctagtttctgaaaagacagaggactcaatgtccctgggccagagagctcaacaagcaatgacagtgcaatgccatgcgtgtggggcagtggaacccagggaggaagctggaattctgactggctttgacttggtgacaaatggcggcatctccatcatcctgcggttcgagcgggcacctttcatcacacaggagcacaccctgtggctgccatgggatcgcttctttgtcatggaaaccatcatcatgagacatgaggagaatgagattcccagctgtgacctgagcaattttgcccgccccaacccagtcgtctctccatccccactgacgtccttcgccagctcctgtgcagagaaaggccccattgtgccggaaattcagtcctcacacaaagccagtgaggagactgagattcagagagtccatggggccacgccatcttccctccactcggctttgcaggaggaaatctctatctctggctgcaagatgaggctgagctacctgagcagccggacccctggctacaaatctgtcctgaggatcagcctcacccacccgaccatccccttcaacctcatgaaggtgcacctcatggtagcggtggagggccgcctcttcaggaagtggttcgctgcagccccagacctgtcctattatttcatttgggacaagacagacgtctacaaccagaaggtgtttgggctttcagaagcctttgacctgtccgtgactggccaggacctaaaagaatgtgaactgaaagacctgaatgtagaaaacccgaccattacaatgaggctacagaaccaaagggccctgaaaagtgctgtgctggctttttccgtgggttatgaatatgaatcctgcccagatctaatcctgtgggaaaaaagaacaacagtgctgcagggctatgaaattgacgcgtccaagcttggaggatggagcctagacaaacatcatgccctcaacattcaaagtggcatcctgcacaaagggaatggggagaaccagtttgtgtctcagcagcctcctgtcattgggagcatcatgggcaatgggcgccggagaagcatctcctgccccagctgcaacggccttgctgacggcaacaagctcctggccccagtggccctcacctgtggctctgacgggagcctctatgtgggtgatttcaactacattagaaggatcttcccctctggaaatgtcaccaacatcctagagctgagaaataaagatttcagacataggtaagccaaccagtggagaatttcctgcctcacccctgccttgttgcatgctgtatggtaagctgcacatgtcaatttcaaatggctgt

SEQ ID NO: 468475 - DNA, 857 bp, Homo sapiens
ttgccaagcaggaacgtacggtaggagcaagtgcaataatgagaagacagaacaggaagcagttgcagggaatcatctccaccattgccttcatttcacatatcaggaagcgtggactccagcctgcagaagagttgctaatggctgtgtcagtcacagagcggtcaaggcctgtatttctcaatcaggacacagaaaaagtgggaaagtcggtggataactgccccagcaactgctatggcaatggtgactgcatctctgggacctgccactgcttcctgggtttcctgggccccgactgtggcagaggcgctgagtgcgatgtgcccaccaaccagtgtatcgatgtggcctgcagcaaccatggcacctgcatcacgggcacctgcatctgcaaccctggctacaagggcgagagctgtgaggaagatgagctggcatcgcacagcaccccagagctgcagtgttatttataagagagaaaaaaatgtctggaactttgatttacgttatctatttgaaaagaaatgttcttactccagctttcttttctgaggagggccatctgctaacaagctcacttttttttctcccccttccttcttctgaagtttattgccccatattttttaaagcttgaacgcagccagtaggacactgggaaggagttgggggaggagcagaaaagaaaaaacctagacctttcacagtgaaaagtgagaccctgtgtttttggtcctgcagagtgtctaatagcttgtgtggtcactgaagcatggcatttttgggggaaagacctgtgtccgcagcctggtcatgcaggcctcatcattttgttaatgggctatgcttctgcc

SEQ ID NO: 468476 - DNA, 1009 bp, Homo sapiens
agtgagtacatagtagatgtttaatggatacttggtgattgagttcatgggtatagggatggatggatgggtgtgcatggatggatggatggatggatggatggatggatggatggatggatagatggatggatggatggatgggggagtggatgggtggagggatggatggatggataggtggatggatgagtggatagatgcatggatgagtggatgggtcccatccccctgagtccccaagtccaggacagctggacaagtcaaggaagggcttccttacagaacttgggtctcgccgcaagggagtcagtatattgtttccagctgtctaggctcgtggaaaagaaagcacactggaaggaggttgaagtgggtgttgagaaagcctgtatttggtatctgctgcagatgtggccagataatgagagtccagtgagccaagtcctgctgtacagttgtgttctgagggttcgctcaccatccgacacaagcacaacaaagcgagcacaaagtgatactggagtgctgacagtcagggagaagatcacagcgcgagaaagagagagcgcagaaacttcaaaagcatgaaatgatgctggggccatttcatttaggagcaaataaccctgcagaaggtagtcacaaagggcatcagcgtaatagagcagagtaaaaagaatagctgtgcgtgatccttagccatcaaggaaagtttagattgcattcaggagacttcgactagaaggcaggaatgtctcaaacaggcatccgaaggatttccacaaataacgaggtgcattttccctttacaatttgtgctacaggactgagacgtggaaatctggggactcatgtactctgtgttattattgattatataccttttttccatacggtatcagagctgctgctgtttctgccttatcaaattagttattggggacggttcttggagatggccctgaccacccaataatagagcaggggcagtgttcaagatcggaag

SEQ ID NO: 468477 - DNA, 2007 bp, Homo sapiens
gcaggaacgccgtctccatctacatcctcaacctggctgcggcagacttcctcttcctcagcggccacgcctgagctttctgagtgccatgagcaccgagcgctgcctgtgcgtcctgtggcccatctggtaccgctgcctcctccccccacacacctgtcagcggtcgtgtgtgtcttgctttgggccctgtccctactgcggagcatcctggagtgaatgttctgtgacttcctgtttagtgatgctgattctatttggtgtcaaccatcagatttcatcacagtcgtgtggctgatttttttatgtgtggttctctgtgggtccagcctggtcctgctgattaggattctctgtggatcctggaagatgcctctgaccgggctgtacgtgacgatcctgctcacagtgctagtcttcctactccgcagcctgcccttcggcattcggtgggctctgtctactgggatccacctggatttggaagtcattttctgtcatgtccatctagtttccattttcctgtcccctctaaacggtagtgccaaccccgtcatttacttcttcgtgggctcctttaggcagcgtcaaaataggcagaacctgaagctggttctccagagggctctgcaggacatgcctgaggtgaaggtggagggcggcttcctgagggaaccctggagctgtcgggaagcagattcgggcagtgaggaagaacctctgccctgtcagtcagacgggactttgagagcaatactgccctgccacgcttgacaattacatgcgttttcttagtgttgtgcctcagaaatgtctcagcggtaactcaaggtcgtcgaatagatgtttatctatactgacagttccagttttcatccacagaaagcattagtctgacagtacaatgtttagattctccttgatattaccaacacatttttcctgttatcttacactgaaaactttttctgcaattttcattgtaataaaaggagttcctctccacaaccctaaactcatctttatacgtttcctacctgattgtatcaaaaaggaagtttccttattgatctctcagactatgttcccctgaaaccatattcccttctatgactggaagcattactgaagttgggagctcgattctgaataagtgagttctgttatctctacattccactgaattctcagatataaagcaaaataatgtccttagagacagactctttcttcataaaaacactctcacaaattggttttatgaaaagtcctctcctgtcatttgtccacagcatggtgacacactggccttgatttctagtaaagacaaccatggccgcttccccttgagaactggtaagttcttatttagctcttcctggactaatagaccagtgaggagcctgtaaatatgccccaccagttccattttgcccattggaaatggcagtattgattataaagtggaaactatcttgaaaaatcattattcacttacagattctttcagttgtaggagaattcttcttacttccaggttttgcacaaatttttctggctgtaactttcagttagttttatggtcgttcacgtgagaagcaaaactgaaaatatctgacctttccatgctaatgtcaattatagtatctggataataacttacagttggtatagaattctaatacatgctgtgacatagatgaacctgaaaacattgtgctaaggaaaataagccaaaccaaagaacaatattgtaagttcaaattttatgagatattgaaactaggaaatttgtgaacacagaaaataagttaggaggagcctggtgctggatgatggagggaatgtgtagccattagttaatgagcaaagactttctgtgtggaataatgcaaagttcttaaaggggacagtggtaatggttacaacttattggaatatacttaatgaaacagaattttacaactaaaatagttgaagttgtaaaatgtatgttatgtaaatttt

SEQ ID NO: 468478 - DNA, 675 bp, Homo sapiens
caccgtggtgacaaatctagagaaatggatggagagagaactaacaaagtcactgaagaaattaatgaatgttataatctggaagcaggtgcagaggaagtcagccctggccaggttgaggatgtagagagagaaggtgttactgtgcatgcagaagcccaggagccagagcatgactgcatttcctgccagcccgaccaggtcaatgatgaggatcagcactatgaggaccaggacctccatgccacaacgatgaggatgggtctcctctgtatcactaattggtgcaatttctgtatccaaggctgggatggttggattcatgctcagaaaccctacgtggactgtggactgaagcattactctgtcctgggccggaaactttctctaaggtgcaggaattcggatagacaaagaggtggctgtgacaccctcatgatttagagtggtcctccatggatgaaaatgaagatcatgcattgtggacatgaggaaaatgtgacatcttgctagtacaagtgtgatgatggctgggcctggtgagctagaaatggcgcagtgtgtcagtcattgacgatagaaacctttttatatccccagtgcctggctccctgtgcagcacactgtgttcttcagaaatattcattcagtgaatgaatgcatgaatgaacagcc

SEQ ID NO: 468479 - DNA, 771 bp, Homo sapiens
ccatctgtcacccctttctttgactaggaaagggaattccctgaccccttgtgcttcctggatgaggcgatgcctcaccctgcttcaggtcaaacctggtctcctaagttgattgtcgattcccttcatgagaagaaaatcatctcctttaatgggtgtatggctcaagcctatgaagaacacatttttggtgctactgagatcatcctgctgacagtgatggcctgtgacaactatgtggccatctgcaaacctctgcactacacaaccatcatgagccacagcctgtgcattctcctagtggtagtggcctggataggaggatttctccatgcaaatattcagattctatttacagtatggctgcccttctgtggccccaatgtcatagaccacttcatgtgtgacttgtgccctttgttaaaacttgtttgcctggacactcatacccttggtctctttgttgctgccaacagtgggttcatctgcttattaaacttccttctctaggtggtatcctatgtgatcatcttgagatgtttaaagaactatatcttggaggggaggggtaaagccctctccacctgtatttctcacatcataatagttgtcttattctttgtgccttgtatatttgtgtatctgcacccagtgacaaactctgcccattgataaagctgctgctgtattttatactatggtggtcccaatgttaaatcctttgatctacacactcagaaatgctgagggtacatgtgcacaacgtgcagg

SEQ ID NO: 468480 - DNA, 1364 bp, Homo sapiens
agggtcttcaatttacagaacgcagaggcacagaaactcttgtttgctgtgtttacactcatctactttctcaccatggtagacaacctaatcattgtggtgacaatcaccaccagcccagccctggactcccccgtgtatttttttctgtctttcttttccttcatagatggctgctcctcttctaccatggcccccaaaatgatatttgacttactcactgaaaagaaaactatttccttcagtgggtgcatgacccagctctttgtagaacatttctttgggggagttgagatcattctgctcgtggtgatggcctatgactgctatgtggccatctgcaagcccctgtactacctgatcacaatgaacaggcaggtatgtggcctcctggtggccatggcatgggtcgggggatttcttcacgctctgattcaaatgcttttaatagtctggctgcccttctgtggccccaatgtcattgaccatttcatctgtgaccttttccctctgctaaaactctcctgcactgacactcacgtctttggactctttgttgccgccaacagtgggctgatgtgtatgctcattttttctattcttattacctcttacgtcctaatcctctgctcacagcggaaggctctctctacctgcgccttccatatcactgtagtcgtcctattctttgttccctgtatattggtgtaccttcgacccatgatcaccttccctattgataaagctgtgtctgtgttttatactgtggtaacacccatgttaaaccctttaatctacaccctcagaaacacagaggtgaaaaatgccatgaagcagctctggagccaaataatctggggtaacaatttgtgtgattagagaagataaacacagaacctactcatattttaacaacaggtatgactaatgaaaagggtaaaggtcttgaggtcagaatagtgagtttaagtatattttattcccctcattttctggaatctttaatgatgccttttcataaaagatcaatatctgattaaatgatgactaatgtttctgccaatttgaaacttcttcacatttacaaattattaatcagggggacattgctagtcaacataaaaatgttacagtgtatggaaaacccatgagtttatgtgtttagtagaataattatctgcaaagcttcggtatagagtatataactaacaggccaaataattaaaataaacaaaaagacctaatggctaaatcttttgttgaaaatgcatagttttaatcccaactaataaaatcgaagtagaactattattgtgagagagagagataggtgagaaacgattgggttttgaggaatgagagtc

SEQ ID NO: 468481 - DNA, 535 bp, Homo sapiens
tatgaccactatgtggccatccgtaagcccttgcactatgcaaccatcatgagccaacctatgtgtggattcctgatggtggtggctgggattctgggatttgtgcatggagggatccagactttgttcatagcccagttaccattctgtggccccaatgtcatcaaccactttatgtgtgatttagtacctcttctggagctggcctgcacagacactcacaccttggggcctctgattgctgccaacagtgggtcactgtgtttcctcattttttccatgctggttgcttcctatgtcatcatcctgtgcttcctgaggactcatagctctgaagggcgtcgcaaagctctgtctaatgccagcaaaggaaaagaaagcactgaaaacaaaacagctgaaaaggaaattaccagagatgtagaaataagtttgtatcatgaaactggatgatggtgatcacaaatgtagatcatagaaaagaatccataccaagaatgtaatgaaatgttaaaagattcagatatagtcagac

SEQ ID NO: 468482 - DNA, 1205 bp, Homo sapiens
ggtttgtggcaacatgctcattgtggtcactatcacctccagccccacgctggcttcccctgtgtattttttcctggccaacctatcctttattgacaccttttattcttcttctatggctcctaaactcattgctgactcattgtatgaggggagaaccatctcttatgagtgctgcatggctcagctctttggagctcattttttgggaggtgttgagatcattctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaatgccatgagaaagctctttacatggtaagaaattgcaggtggaaaatgagtggtaaagcaggaaataaaaatgactttatttttgcttgaaatacatgctgcctttagagtaattttttttttgttgctgagtaatacaacatggcgtttctttttattttaccttagtcttctcatttcaaactctggaatctaaaactctggaatagtcccttctccaagaatatttgggaaaccaatttgaagagagaattccatcccaaatgtgaggagttatggaaatgcttaattattttccattgcttagccttggggagaaagtttattgctttctagcaactaccatgagggactcttttgtaagcctttctgttctgttcatttgatttcctcaggtgtatagtatgattctgctgacatgggtggagtat

SEQ ID NO: 468483 - DNA, 950 bp, Homo sapiens
ttctgctgcaacagaaactaaaaccaaccagacaaatgagaaaccctgttaacaagtctgccggaagcaacgtaagatcagtactctgaaaaggtaatgggtttgagaaaaatttttgccccacctacagcgcctgtcaaaagtggtgaacaggagagggagaatgagaattggcttgtaccatcttctgtggctacggaaaggctaactttagctttggcttttgtggattgtaaacatgcattggcacctgtgaggtgtgccgaggacttaggaggttttctcggagcctgtcaggatgtgggaactgagcttcattgctctgcagtgttggctcgggcaatggctaatttggtagctgacagatctaaaggaagccaagggtcaagccctaaagtgggaaagtgttataagtgtagaaaaattggacgttttggaaaagaacaccgccagacctctgggcagaagggattttataatgcagttccccctcaagagaaaaaaatgccaggactttgccctcgaacacctggaaacaggattagatctcctagagagcaaattacattaattgaaagaaacaaactcactaagattcccattggtatttggggacctttgccaacaggatacataggattcatttcgggtaaaggtcatgttaacttagagggcattactgtaatcctaggagttgattttgattgtgaaggagaaattcgggtagtggtaatgtcacaaaatccttgggtttttgaaacgggagaatgtattcctcaactgttgcttattccctgtaaattgcacctctctctatgagaggagaaatgaaggaatcagggatttggaagtacaactacatgggaaatttatctatcacgacccatagcatctcacagacccacttgtgcagtgtaaattgtagaaaagatttgtgggcttatggaaac

SEQ ID NO: 468484 - DNA, 531 bp, Homo sapiens
agcatgttacaagacactcccaccagcaccatgacagtttacaaatgccatggcaaaatcaggaaaaccctcccttggggtctggattgggaccgctttctggtaacagggccaccatcctcaagactgcagaatgggagatcaaacagcagcttgcaccctgcactgggaaaagccacaggcactcagctccaacctgtgaaagcagctcagggggctgaaccctgcaaagccacagggcagagctgtccaagaccttcggagcccacccttgtaccagtgtgccctggatgtaggacacagaagtcaaaggagattaagattttatggctgcccttctgggtttcagacttgcatggggcctattgcccctttcttttggccaatttttcccttttgggatgcaaatgtttgcctgatgtcagtacttccgttgtatcttagaagtaaataacttgttttgattttacaggctcaggactttgttatccagcatttgccaagtgctctatttcatgtggtttaatgaaa

SEQ ID NO: 468485 - DNA, 1121 bp, Homo sapiens
gttgcagccagaggggtctttgggaaagctaaagcagacgatgccatttttctccctgttcctgattctggcatcttgtctccatcctttgtgcacgagccccagagatccagcctctgctttgggctgcaacatcccacctgcaaaaggatcttccgaaaacctacaactggtccccagcattgggctctttgttccaggctccaagtgctttggcatcaacgctgggatggttaattctcttccacatgcctttacagcatccatccaaccacccatcccctggtggctgaaaaaggggacgccaggcttagacagagataatgaaatggaaatagactggagatttgggagacaggtttttgaaagaagaaggcgcaaatgtgaaggccacatgctggaactgaccatgctgtgtccaaggaaccaagaggaggccagccccatcccttttacctctgaaacgcctgttgaatccatcaccaccacttgactctcactgcccctaccatcattaaagccttcctttgaattattcagtagcttctgcactggtctctttgcttccagttctttcccacgccatccatccactcagctgagactcaagcagcattgggaatcagtggttctcaaacctaagctcgaatcagcaccacctggagggcctgttaagttgcaaattgttgagtcccaccccagagtttcaggttaagtaggtctagatggggccccagaattgggattctgacaagtcccaggtgttgctgatgctactcgttcaaggacaatactttgagaaccgctgctctaaagtttacaccaaagatctaatattactcatcttctttaaaaactccagttactctccactctctttaaaatggagtcccagctccttcccatggtctaagtgattgtcaccacccagctgaggcttgcctcttcagcatcaccttaagctgctgacctctcttcagcctgcgatgtggacacaatgcactcttcatgttccttaaacttggcatacatttcagacctcacaccgttccctctgccggcaactctctcctccttgtcgcctgtcagattcctacttgtctatcaaggtctgacttgac

SEQ ID NO: 468486 - DNA, 1056 bp, Homo sapiens
acctccgctccagccgccattcatgtcttacttgggaagtattgatggggcctcagctctttctgcattcttagaacagggcagcctatggatgcctttgtttggctcaggcagctctgaagtgccagacaagaaggaggccaggtgggagaaagagctgactcagaactggtgtgaggtgcctttcccctgctctgagagcaccttgactgctctcctgtcagctggggaggtgactctgatgggcactcaagttggtgcagagggatgcaagcggatgaagctggcagtgctggacttttggcagtatctggaggcattcttagttgtcacaactggggagggtgctactggcatctactgcatcctcacaaggcaggagggcaagtttctgccttccgaagagtgcatgaggcctctttataagggccttaatcacactcacgagggaggagccctggtgacctaactacctcttaaaatccccactgcttactaccttcacattggggacccctgaaatttgaaaagagacacattcaaaccgtcgccctagcgatgctgctgaactccctacaatgcagacagcagcccccccacagagaattacccagccccacgtcagtagtgctgaatatttccaagtcggcagaataggattgttcccctctctgtgcctacggttaggactttaaatctctttggccacagagtgggaagaccacgagaacaggagttcctctgagaatcccattatgaatatttgaagtttagtaggtttatggtctcggttcttaatttttagagtgggtaattgcgtgggctccactaaatgaaatttactagctctttccttccatggcatatggcatcggaataggactgctttttatcccctgtgatttttctacccatattcttgcaaagaactcaaagccattctaatctgtcattttctcctgcttgcttttttccttggtgtggtcagacctctggctcccttggtacttgccagttttgatcggaggccacagggtcctgtgttgtagactctag

SEQ ID NO: 468487 - DNA, 1330 bp, Homo sapiens
ggtttttctcccttcagcatgatactagctgtgggtctgtcatgtatggcttttactgtgttgaggatttcaaatacagacaactcttgaatgaatgcagtcactacccacggaagcaaaggttggaggatgggaaaattcagcagaatgttgaagactatggagttggaatcctgactccaccactgaccttctgtgctgacttgacgtcagcagcatcttcggtgaagggcctgctccttcctcccaagccctgctgggcttccgggctggctcctgtgctcccctcagcagcagtcctcggtgctgagtgggaggatgatcctgggaagcttctcccggtgaaggttcctggatctccttgccaaggctgctgtgtcatcattttcaattcaacaaacatatgagtagttattctacatccagcccaatcttaggtgctgtgggggagacaacagtactgctttggatattaagggttttttttttttgtgatcccatggaaattttagggttgtttttctatttctatgaagaatgtcattggaattttaataggggctttattaaacctatgtattgctttgggtagtatgggcattttaacaatattattcttattcattaacatgggatatctttccatttatttgtttatcttcttcaatttctctcatcaacatcttatagcttttggtgtaaaaatttttcacctccttgattacatttattcctagatattttgttttttgatgctatcaatttttgtgggatcattttcttgatttctttttcagccaagtcattatttgtacatagaaatgccgctgatttttgtttattttgtatactgcaactttactgaattcatttattctaacagttttttttgtgggttaaaactttcgagttttctacatataggatcatgtcgtctgtaagtaaagatcatttgaatttggatgcctttttatttttattttttcttatctgattgctctggctagcactagtacttttcatactatactgaatagaagttacatgggcattcctgccttgtaccagatcttagtagaaaagctttcagttgttccccattgattatgagtttagctatgggtttttaatacatagcctttattgtattgaggaatttttcttctatacctaaactgttaagaggttttatcaagaagggatgctgaactttgttaaatgtttttctgcaccagttgagatgattgtgtggcttttatctttcattctattaatgtgatgtgtcatgctgattgaattgcatatgttaaaccagccttgcatgccaggc

SEQ ID NO: 468488 - DNA, 675 bp, Homo sapiens
ctacaaatgataacgatcccttatgttcgtatccacttcgtaataggtcacaaaaggaaccacttgtgcgaacatgatcttatttgcttttcacaaccacatgatgaaaataagcactattttcccctttgcagatggactcccaagttcagtgctcttcccaggacacacagctgccccatcctgggtgagagtgagaccccgtctcttaaaaacaaaacaaagaacagctgtttgtctgctacacgtggccctctccaacctgccccagcctctctctccagcatatttttaccacatactgccctgcagcctggggccctgcccctggactgaggcgcagctaccggaatgtgctgtgctagttcacacatctgggcccttgccggtgcagctctgtctttacctccttacccacctgctgaactcctgctcatcctctaagacccagctcaagtctttgctgatccatcccctcagagcagagctgattgccccctcctttgagccagcatcacactttgaacagttatattggagcacttatcacggtgtgttgaaactatttattcctgtgtcagtttcgcccagaagattaggtacttcttaagggcaggagctgtcctatctatttctgagtaagccttttgaaaagagaaaaaaaaaaccctaaaa

SEQ ID NO: 468489 - DNA, 980 bp, Homo sapiens
agcactgcctggcacagagcaggcgctcggcaaaggcttgcgggatgcgcagaccagctcatttaatgcttgcaggtgccctctgcggtgggcattactatttccaccatcctcatgatggatctggaatccacgggggtcccctgcccaggatcgtgcagcctgtggaaggcagcaggcgccgggatgccgaatggattgaatgagcttctcggggattccctgagcttggtgaacgcagagcccaccctgacggtcaggcctaaccccaccgccaataacagagcagccctaggtggaagtgggctgcctgtgcctggcactgggagcggcagaggcggctgccgctgtggaagtagcgcccgcagtgccaagctcctgtgcctgggaggacgcgggcactgggcgacctgcagtcggggctgcccccaggcagggctccctggctttctcacagcgcggctcgcgggaaacgacgctgccctatggcacagtgaaaagcccccaacacactggttttcctcacagcctgccccaactgctcatcggaacctgcagcccccttccctgccccaactgtccctctgcggaccccattaccctactttctgtcgagcccaactgccctatcctttatacaggctgtcgggggcaatggtgcccatgctgccgtgaatgtccccgtgtgacagttgttagaaggggagtaattacctccttttggaagtttcaatgagaccatgtaggtaaaaaacatcttgcaagctcttcattgaaatgttgcttgccaaaaatagggaaacgggggctaggtcaaatgactgtcccaaagccactcatgcttctgaaaggggttgcatggggggtcctcgtccctagcagcctgggccaatcccatctgctccagcctctgctgtgtctccctgcctgcagtacaataccctccacagaaactgcccccagaggcatctgagagcatg

SEQ ID NO: 468490 - DNA, 1044 bp, Homo sapiens
gctccctgtaccagctgcccagaggagcatttccctctgacctgtcctgtgaccatttgatgtaggctgtgaaggactcccttagccttctgcgggagaagttaatatgggattagccacaaccaattagatggtatcaaacccaaagggatccaacagtttagctaaactgaagattgggctgaaggaggggggctgcggctgtcaggagggcctcagcagaccccttccccaggaagccaggcttccggcagcatctcaagtcccacaggccttggtaaggaaaggccaggagagggagggcatcaccctgagcttctcacaggcccaacatcctggcgggaagcctcctggtttgggtggggcttcggcgggggtgcggctggggatgagggaaagctgctcggctgggcaattaagctgcgtgctttcctgctttggccccttggccagcaagcagttctgcccattgctctgctcggtaactgtgactcatcctctgggactctccttcacgtcacctcccctggaaagccttgtttcccctgtcctggtctgaagtcccacaggactttgtccatgcctcccatgtgtcactcattacactctatgtctgtctcccctctagactgcgactgcttgaaggctatacaacattgcttcattggtctttgactctgcagggcatggtacagtgatcagtgcaaagtaaacggtcagtaagagtctttttgaggggatggaaaggaaacacaaagaagccaagatttgtaccgcttttgtggtcttgggtaaattctttcactttttgagatttaatttccttatctgcaaaatggggataacactttctcatctgactgtctatgcactgccattgtaaagcttggcccttagcagtttgcttagctaagttggttatgtttctcttgctaggaactgcttcccttcccacccctccagggcatcaggccatgggtcagatattctcttgtctctcagaggagtctgttcctggggaaggtaatcaagtaagaggaattc

SEQ ID NO: 468491 - DNA, 1853 bp, Homo sapiens
ccttccccagcacacatgtccccgtcacgacgtgcagtccacaacattcatctgcttcggttgatggcagcatctccaccttgccacaggctggtcttagctaactccttgcactgactgcttggcatctttagtctaagcaactgctcagtggactcagtgttcctgctttctgatagcctgctgggaattgtgcaagaatggtctgtgcatttgtcagtaggcagattggctccaagcggggccacccgctgctcgcagcaccctggagcccatcccgagtgtggggtcccttcctctccactctggaaacctggggcacagctggccgccctgatgccaccgacggctctgctgctgcagggactctgcttgtgggggtgtgcgaggcccactccggctgccctggggctgctcctgcaccccccagcctccggcaacaggcaaaacagactgctctgagcagtggctgctgctccccggggtccatccgagcaccggcagcagcacaacttggcagccggcacagccccgggcaggaagctcctgcagggggactccgcggaggcctggaggacacccgttcagaggcactcttctctgacatgggacagcagctgcggacggttgctggaggcagtctgatgcgcctccgcgttaggaagattggggatgccaaccacttgcacagagagcacaaagctcaccagatgcttccaaggctcagagggctggcctcacactggtgctggcccacattagctagcacgcggcagtccccggggggtctgggaagatccccaccgaggggcaaattcccctagtcaccctacagcaagcccattaacttcttgttcctcggggagtgaaggcactgtgattgtgagtcatgccactccccaattattttgaaagaaagcttccttagtgaaggaggagaattacagagcagcgccagcgttggggaaacatgctcaacttccagcagtcattcccgctcgcctcctttctctttgctcgaggttcagtctgtctgcaaagcctcccttgtcagcagctggcgaggcagctcaacaatagaatgatgcttgtttcaccgcttccaactgagctccctcgccaagctctctccctccagcacagagaggaaggatagccccacagccacttgacatacttgacatggatgaagggtgtgggggttgggggggaggaggagagaagtggtagcctctctaagaactgcagaaaaggaaatcctatgatctgacttccatgctaccagttctgggaccctcctgtgggaattaattgctctaacctaaactttgcccactgtagttttaaatgagtttgccctcagatgtgagtaatctggccgtcttatctttcactccactgacctccagggttggcctgacaggtcaggtggggggtccttatctccttcctcactttatccatctcactcaggtcttcggttcaggctccacaactgattgatgctgttttcctgttagtatctctttttcatcatgcacgatcctccatagtgatggaatggagacagcttctcagagaaagcacagctttggaaggtaagtgccgtttggatggtgagaccatcagatcaatttaactaggccaagactctgatcaatgttcttaaacctatgtaacccactgccacagagatttcaaagtgaggaagggtcctggacgcccattcatccattctcaatgaattattcatttgaccagcactttctgactttctagcttcagccagacaccgtacaagggacaggggagactgagatgaagaacactcggtgcttcttcccaaggcactc

SEQ ID NO: 468492 - DNA, 1102 bp, Homo sapiens
tgtcactgtgcctgtctcatgttgctatgcagttatttatccacacatttctccttcctcaaaaactaggagagaaaaatcacagagggcaagtctcatcccctgcggatgttcttatcctcagtgccctgtgcgatgcctggcacacagtaggtgctcagagcacatttgtggggagtaatgtgctggaaggggctaagtcaaaagaacgcacttgcatcctgtttgtgcccaatcgagtccagcgccgccagtggacggattctatttggattagagctgtgtgccccggggagccgaagcaactcctgaagacatgtgctaaggctttcgatgaatttaaattacctgcattaagttccataaaattgcgctgggattttgacagaggttgctttgaatctggggagaactgacgtctttacaatgttgatatttcccatctaggaatattagatgtctcaccatttatttagatcctcttatgtgatactcagtagagttttatagtttttctataaaagtttcgttcatattttattgggtttattccttgggaccttaaaggcatttgttgttattatttgttctttttttacgtttgaatgtatctatttttaattggtggcatggagggaagctttgagttttggttgttgctctgttaactctaccactgcgctggaatcttattatctaacagtctgtcatttctttccgctggatttcatagaagatgatcatataatctgaaaataatagttttctcttccattcttctttttcttctcttaaatcgtgctggataggaggggcatcgctatattgtttccagacagaatgggaaatgtttccaaggtttttctgaatgttatataattaagacagcttaattttccttcctgctttgttgaggcatcttttaaaacaggaaaagtatatagaattttatcaaatgtttcttgatgtgtagtgacataaccatatagaattttcctttatcatccagtggcctattttaatatatattataatgttgaattagcctgtgttactgggataaagtaatccctggcgaaccctccaagtttcctgcccagcc

SEQ ID NO: 468493 - DNA, 590 bp, Homo sapiens
agtccacagcttgctcagaccaatgtgcactgtgggaggggcagtgaagcagcctccagctcttgctgctgaatggattcccaaccctcatagaacagccaaggagcgggtcaccggctgcctcgttaaagttgaatttcaggaagtcctccttgagccccgggttaagtcagctccctgggttacacactccacagcactaaatgactttccattgctggactcacctgagagtactgtaggtgcacacttacacctagtgtgttttacacctgttagtttcagcaggtctatcttagagtataaactcccagaaagaaggaactgggtctacaagagtctctgtaaaaggtctgagtacttaaacggagttggaaaatgaatccgtgtctagctagtaaattgtatgtaaaacccttttcatgtgggaggtgggaaggatcaggagactttctcctgtgggctctcctcccgctgccccaggcccgcgagtctgtcacacagctatgacttacctaaatgtgtgtcacccagaggacaggaacatttgattgctggggaaaaatacttattttttcctaacgcctttc

SEQ ID NO: 468494 - DNA, 900 bp, Homo sapiens
cttttattttaggttcaaggggtacatgtgcaagtttgttgcatgagtacattgcatgatgctgaagtttgggaaaactatgccaatagaaatgaatcacagattcgtaaaatcaaatttgcttttgatgttatcaagattccctatcaagaaccttctaatcaagggtttttcaacctcggcactattgacatttggagctggataattatttgtttcaatgttaaaactgaagtaaagtctattgaaatgcaccatgaagctccgagtgaagatcttcctggggataatgtgggcttcaatgtcaaaaatatgcctgttgaagatgttcattgtggcaatgttgctggtgacagcaaaaatgacccaccagtggaaacagctggcctcactgctcaggtgattatcctgaaccaaccaggccaaatcagtgctcactgtgaatctgtactggattgtcacacaactcaaattgcttgcaaggttgctgagctgaaggaaaagattgattgcaattctggtaagaagttggaagatgatcctaaattattaaatgctgatgatgctgccatcctttatatgacagttgctatgggtgtcatcaaagcagtggacaaggcaaggtcatcaaaggtgtcatcaaagcagtggacaagaaggcaaggtattgccaaggagctggcaagatatgaataacaataaatctgtgttcatatgtgtattgaaaaatacttgttactaacattttatttttgcttatatcattctgtcctttcatttatgcaaatgtaatcttttttatttacaaaactggattgaaaaataatattacattgtaaactgtttttcttcaataagatatactatgtttatctttccatgacatcacatatttttcac

SEQ ID NO: 468495 - DNA, 695 bp, Homo sapiens
ttttttatattgtaatgattatatatgtctcctgtgtggcagccacttaggtcttatattccagcttgggctccttggcggtacaagtttactataatgaagacaaatattaatatacggtaccagagcagagatagcaccctcgaaggcccacaaaacaatccggtgatttatgaggactttttctacccaaatgatacacaatcacagaagctggcttttcactgcctcggtctccagatcagggacaggtttcggatatcagctcagagaaggggtttggatcctttggcggagcccgtgcagtggggacccaccagacccaccagaccaaatcttgatccaacaaatgaagggacaatgattaggccctcttatagcactatacattggggtcctggtatccaaaaacagggcaaccatattcccagtttctgccctgatttaactattaatagtgcccctttaaatcacaaaaaaatgctttaagcatttcaatatggttccattgtaccctctctcagcacatcaattatgcttctttttagaaaatttcagtagttggtttagagcttataatatagttttttacctaatgtatctccactttcaaataacactatactacttcacatgtagcacaagtactttgtgatatagtgttcataatttctttttatagcattgctgtcatt

SEQ ID NO: 468496 - DNA, 581 bp, Homo sapiens
ggcacagtgacaccctgtgtcactttggatcctccacatgcaggaggcatggagtacttccatctgctgcacctatgccagggacgatgcctgcagcatcccagctggcttcccggatccagctcttcacacctgcttccaaatgggaagggctgttgtttaagaaaaattcattaaagaagctctcaagaaagccacaagagaagccaaattatccagggttactgaactcaagtccaagcactatctgttcccccaaacagatgccccttcactctgcctcagaattaagattatgttcacctgaagaaatgtctgctggaaagaaaccggcacaagcctcagaggacattgcttccccagtgacggtggatctcattgtatctgtcattgcaatttgtcctgatagcttccaccagcttaggcaaagctcctttgccttccgagttaacctatgtgaaggcgacagtggttcaggtcttcctgtggactagatgtcccagtcttgccttccccttgataatgcagtaagggacccccattttacaatgtaggacaggcaggaagacaaccagctcaac

SEQ ID NO: 468497 - DNA, 1043 bp, Homo sapiens
agctgcctcctgcagggcagggcagggctggggacctgcagcccaccatgcctgagcccccccccaacccccacagtgggctcctgagccgcccgagcctccccaaggagcgcagctccctgctccatggccccggtcccatctaccgcccaaaggctgaggagtgccagtgcacagcgcaggactggcaggcagctccatctgtggccccagtgcaggatccactgggtgaagccagctgggctcctgagttcactcctgagccagcgagaccacgaacccaccagaaggaagaaactctgaacacatgcgaacatcagaaggaacaaactccggacacgctgcttttaagaactgtaacactcacggcaggggtccgcggctttattcttgaagtcagtgaaaccaagaaaccaccgattccggacacaattgttattgaaattaaccataaaggtcgggctcattatttttactattaaatttaggtatgggcatttcctcctcctgcttctaaagaagccctactctgtaacaaagtggtttccaataaatgtgcttattttattgtgaaaaaatagtaaacaaatacacaaataaatttatgtacaattactttttgaaccacaagagccttggcagcaggaaggggagagagggagagacggggggggagagagagggagagacaacgagagagagagcaagagagcaagagagagagcgcgtgagagagagagagagggagagggagagggagagagagggagagggagagagacggagagggagagggagagagagggatagagagagagggagagagagagagagggagagagagagagcaagagagagagggagagatagaggtggagggagagagagatggagagagagagagagagacagagaaagaaagagagacagagagagacggagagagagagagagatggagagagacagagagagagagagagagagagagatggagagagagagagatcgatccccttataaaaccattagctttcatgagaa

SEQ ID NO: 468498 - DNA, 762 bp, Homo sapiens
gctgaagattgagcgtctaacaccttcatgtattatgtccccaaagaaaagctgatctcatacgctagtgtgagtggacagaacagagccaaggtggacagcaaaggggtgacttctgaaggatctgtggagattgctgccctggaagaagctgttgtctctacagaggagatgttatctgagcatgcaatagctcctgatgtaaggagcagaaatcgtgcgggtgtttgcactcttattccttccttgtatttccagccttttccaaatgcaagccctgatgtcttcagctggcagctaccaattacagttgctcagtcaaagtggagagcacattgtactctggtccacaaactggaaatgaataaagcagtcaaatatgatgatattccacaacagtggaaagattcaggttttaatcctggtccttttcacagcaaggaggtctcagcttttgcaaaagcgaagaagttgcactggctctagcggccttggcttggaagtcatacaatgttacttcctccacatgctactagttaaagctaatcacagttcatctcaagtgcaagaagcgaaaaagtagattactcatattgatgagacaaatgccaaagtcatagtgcaaagaggcttgtataatagaaatggaagaatatggctgtgttttgcaatttaccacaattgacttgtaaactttgtaaatttctagctctttgggccccaaattattcacatttctcttacgtacaaaatatactcaaa

SEQ ID NO: 468499 - DNA, 3010 bp, Homo sapiens
ggcgagggtccgtggcttcattcttgaagtcaccttgctctctgctgcatctttcctgtggccattgctatgccagctgtgacagatgatgatgatgatgatgataatgatgatgatgataatgatgattccagggcaccacctttcttcaatttcagaggatgtatgaaaaagtccaggcagaagcctgctgcaggggcagagccctcatggagaacctctactacagcagagaggaaatgtggggttgggcccccacacagagtactcactgaggcactgtctagtggagctgtgagaagaggaccactattctctagaccctggaatggtagattcgctggctgctttcaccctgtgcctagaaaagccacaagcactcaatgcaagcactcgagagcagctgtgggggctgaactctgcaaagccacaggcacaaagttgcccaaagccttgggagtccaccccttgcatcagtatgccctggatatgggacattgagtcaaaggagattattttggagctttgagatttaatgacttccctgctggttttcagacttgcatgaagcctgcagaccctttcttttggccaatttctcccttttggagggaggggaaagcatgtatagtaaattactcttctcatccaaaaagcttagtttgttcttttcaatgcttgtatcatattccataaaatgagtatttttaaattttatctaaaacattctcttacatatatatttcacatctccacatttttcaacttcaatcgtgtgtgtgcatatgtatgtgtgtgtgtgtaattttacattatttctgtgatatactataggagaacataccataaatgagattgttttgtttcttgctatcttctgtaatgttcatttgacaaaccacaaaacgagtacttcagcaaaatattttatcagttcacatttccaacatcaatgtattggagatacgtttactcacgctgttgccaacaatgaatagtactgccctttataattattgccaagttgatataaatgtatttaattattgcttaaattgttaatatcattaaattgttaaaaactattatttagcattttctttaccacaagtgagattaaacatctttgcacatattttgtggacatgacttcctcttctgtgagttgccgttattcaatgacaattttattataaaaatatttgtcttcttccaaatcattggagagatttttcaaatagttactataataaattttatttgtcatatattttattgtaaatattttccattgctattatttttcttacaacttctataaggtgacttttgcccactaaaggtatattcttaaaatgtatatatatgtctggattctgggtacactgttaaagacaaaaaggtctcccactcacaagttttacaaaaagtctattttctatagactataatgttatattttggcttaaaatgtcttaattatttattttaacacttaatgtatgtagtcttacatttcctatattatgtgaacaacaaaatcgattttattttctttctagtgagaagtcatttattctagcaaaacttattaattttccttacttcctgtgacttagactgccttccttgttacatattaagttttcatatttactttattctctttactacttctaaattctgttaaaacaacctattaattgatttctgagccatttattatatggttttgaatttaaggtaatcattagtatcaaaaagcacatcctttttagtattttttaatttttaaaaatgttcatgaatatttgaagatgtttacgtttccatgataactacattaattttacccagtgctttttaaattgaattctgtgaagaattgcattcatttatatttagaaacagtacattcagaaagaaaacaaccagctcttaaaggtcctcataagcatctcaaggagtttgcatctttttttgaggtcagtgtgcttaaatgcatttcttgaggttgaaaatgctttgaaaaacagaagaaaaatagtcatatttgaaattacagacattactttgtttacaaagtgaagggtgattgaaacaaaggaaggcaagctccgaaacaggaagttcagtaatgcagctgttactatcttcaagttaaatataaagggggagaatatgcctaaatgaggaacacagcagtatggatagataagtggacagattttaaaactagtaggatttagtgttgagcgaggaatgagtgaagcactgggatttccagctttcataatttgttcaccacatccagggaccaaaagttaatacgctatctgtactgcgtgaaacacaatgcaaatccagagcacataatactatgtaaatgtacttatgacagaattatgctaaatttaaaatgcagtatgcaaatgtcataagtatgttttgtaaacagaaacaataaacagagaaaataaaatatatctaaagctatcacgtcaaaggaaaaccatatatctaatttaatttacagaaaataataaaatgataagtaattaaaagttgctccttttttactattgtacgtaataattattttttaaaaataccattttttgagcatttgcttgagcaaatgctatgtgcctttcactgtgttgactcccactaatattatttacttgccacaaacttccctttaagtaggactgtttctagtatccttctttctatttattttcttaccagttaaggaagctgccgcttacagagataaatcacttgctgaaagtcatttgtttcctaggaagtgacagagccagaactgatttggaagttaactttctttttcttgtatccttcactatattgtgcttatattcagtactaactactgtcaattaataaataacatcttttggtgcctcagaggagagacagtaattatagaagaacagaaaatatatccaaaaacaaaacaatacacaaaagcacaatacattatttc

SEQ ID NO: 468500 - DNA, 880 bp, Homo sapiens
gctcctaactgggaggagagggggctctagagcacattccttgagggctctggttttgcagataatgttattaaatccttttcagagctctgctgcctatcaaaaactcactttgaatgtcaatacctggcacactgacgtaggcaaggacaagaataacattggcaagtacaactcactgactcagagagaaaagagggatcagacaaataagaaaggatgtgatacatattggtacatttttgtagactataataataagccaaagaaaaaattaaaaataaatgaaaaagaaaagcatcaagcaagaaagaaggttaagcatagaagcaagagaaccacatttagaaggctatttgtaataataagtgagaaagtgacagtgatttggactagagaggtgatgatacttggaagtattttggattttgaaagtagaaataacagaatttgctggtcgattgaatatttggatggtataagagaaaggagatttcttcgaggttttggatcagggaaaatggaataatggacttggcattaactaagatcaattgagcatctttggggaggaatatcagaaattcagttttagacatgttaggttgtgatatcaactaatcattcaagtagaaatgttgagtgagttggagtaatacatcagcagcttaagacataggtctggaatggagatatatatttaggagtcaactggacaatatttaaagccctgaatttcataatatcacaaaaagtgttaatataaataaagagaagagaataaaagagaaaaaccttgagtcagtattaagaaattttaaaagtttaatggaagaactggcattttcgatgggtcttaaatgttggttaaagtttttac

SEQ ID NO: 468501 - DNA, 628 bp, Homo sapiens
gctcactcactcactcacacactcacctctttctctctgcaataagtccagccaccctccagcgaccatgctggataagccatttaaaattatgagagatgctcacggggccccacctgttctggtcttcagcccttcgactcagcaaggtcactgttcagacttgactcgtgattggctgctgcgcttcagcgtgttattactgtctgatttgatcggaggcagggggtggtctccaatcaaacagagaaaaggtcctagagaagggcacaattggagaaactggttattttacaaaggctttgactggaatggcatgctcacaggattcctcaagaatcctgtgttaagtaagggacctcaagagaaaaggaatttacccaactcacaggctgaccttgagtattcctgtgaagtaatcagtgatctctggctgctgctgaaaagaaacaagaaagatgggaatgacattcctgcacaggtgtctgccgactcagttttggctgtatacttggaaaccttgcagaggtaaataaattcctagctcatggctgtcaaacatattaaattattttttaaaaaggaaatctttatggaatttcaatgtaggaaattgagaaaagtggag

SEQ ID NO: 468502 - DNA, 703 bp, Homo sapiens
gtgtgtcaaagagaatcttcattttccaaagttcaaagtcaataagtaatgcctaaaactgtgaagttaagaagtggcaacgtatgcatattacttagaaatatagagcctctggaagcttccaatgatggtggaaggcgaagagggaacttgcgcatcacatggcaaaagcaggagcaagagagaggcgaggaggtgccgcacacttttaaaagaccagatctcatgaaaactcactattttagggtttatcctcagtttgggcttcctcatgaccagactccagtaacacattttaggcaggaacaacacgaaagtgatgttatgtcttcaattcattatatcagaagtcatataatgtctatttgtcctattactgatggcccaaaatgtatgcaggtccccttccagcacagcctttcctcatttcctggggctgcagctgcactggagcaaatctgctagtttctaaaggtgatataatcaacctatggacaatgttaagtgaggacttaacatactcccttctggttggcacctggatggtagatgcagtgttccccatcaaagcattcatgtgcatgagttgataagcatgagagcttttattttgacctgagaaggattgagttgttttcaaagaacattaaggaatactttagtctttacagttgggatggaaggggtagggcaagaacccaac

SEQ ID NO: 468503 - DNA, 1944 bp, Homo sapiens
tcaagttttcattctggttcttgtaactacaccagcagcaggaaagactcatgttgtgcaggcccacatggcaaaggaactaatgcctctgggctacagcaagaaaatgggtgatatactttccagtgtcattctttctcacacagtgtcccagtgtgagatccagggcttgggaggctcaaggtgctcttctgtgtcctggattccccaggaggagatagcctggcaggaggactgcccacactctaccaaagattctgccaccatcacttttatctcagcagctaaagctttccctaagacaaccaatttccctgctacaatgctctggtaccctaagcggggtaaacagcctcaaatggctctggtgtctaccaatgctacccgggccaaaagtagaatgcacgtagaggatggggaaagtgatttccagtccataattcataacatagtaagaacaaagacaaggttcattcagtaatccacatagtgtgaaattacacatggacaactttctatttgatgttgacgtttctaatggtgtaaaaagatgtatttttaaaacaggaagagagagttcaatcttaaaggattttcagaattgtttcctttttagcatatactttatttctcatgtgtttgcagtgtggaaaagaaacatgatgatgactgatgacttacgaaaaatatttctaaaaaaaattggttttagtaagtactgaatgaaatccttgtttgatcatgcttgtctatacagaaaaaagaactgcttagggtgaggaaaggcagccatcatttattaagcactttctgtataccagacaccatgcttgaacatcacatatgctttctcatttcatcttcacagcaactgtgcaaagcagataagactaacatcatttatagaagagaaaacagtagttcaatgcagctaagtaactttcccaatgtcacacaagagatttcaattatttaataactccaaaactatactcttttggtaggcattccaattatttttgaggagattttagacaagtacatgttttctgctatcatgaaattctagaaacagataccatgaaatgaaagaatatgggatctgagaatggaccttccatagcaactggtccaactctttttgatagaacaccaaggcctagataccatgtgtgacttgtctgctgtcatatagttattcagtggcagtgctgggactaaaacacttccattatgctcacaggtgagtcaaatatagaggagtgttttatatcacaatgaaagttctgaagtcaaagagaccaagaatctttcttctgctattactaacctcagtttcttcagctgtataataaaaatctgcacagttcttgtaacattaaatgaaataatgaatgtgaataaagtacctaatgtaatgtctgacatacagtattcaactaagtggagatgttattattattaaatcagaaacaaaataccatgtaaaaagggcaaatagttaacatagactccagctggaaatccagatttcaggaaaagctcatgtaaacttactatgctgtgatatatgaaataaataatatgtcttagtacctttgtgtcttaattattctatatgtttgtttttaacttttaaagaacaatagctaagggcaatccaaaatttcatttgcgaaaatagtgtcaatcttccctcctcccagcaaacttcattgggtgacttcgcattcacaggagtgctaagtagtagcaaaatcatctgtgatgacgggacaaagggagatacaggaaagataattgtgaactgcatcatctcttttcaacataaatacatatttacaaaatgtactgcagtagtaagatgaaaggaaaggacaattttatgttcttctataagtcatatacaatagtacaataataaagtgaaaaatattaaatatt

SEQ ID NO: 468504 - DNA, 613 bp, Homo sapiens
aaggcgatactttacattcttttctcctactaagtcttcaaaagctgcttaccagtacctttcagtagatttcaagcttcacataatggcttgtggaattgcttccctctgcagccctttaaacttttctggagaactttgtcttgaaatgcacatacttagccaagttctttcttctgaaccatcctttttgctgcccccttctggaagccagagtcacctgcagaaaaactcctccctactagctctccaagatgtggaaaggcaaagtccaccaaactccagcaggttcacgggaggctttcatgttggacatctcttactcatcagtcaaccagtggtgtccttaactgcttgccagatacctcaagttccatggatccaaaaccaaattcattctctcaccctccaccaatttctcttccgccttgttttctccttcccttctctatctactcattctgtaatcaatacatatatatatgaagagagagagagaggaagattaattgatttttaagaattggctcccgtgagtgcagaggctataaccacatacactccacacagtcattttcttccaaggtctcactgccccagaatagtgtggggt

SEQ ID NO: 468505 - DNA, 860 bp, Homo sapiens
gtaggcggaggctgcaagcctgtcctccctgtgtggccaggaggagagaggaggtcctgcagcagggacagccttgcctgtgggcagagctaactctggctaaaactgagcactttctgcccaccgggccgggctctgaattacctcctcgctgcctgggcaagggcccgccacgcccctttctcccactcccttccctgtcaactctcggtctcaaggaagctgctgctgtcaatcctatccctgtgcgtttggccacaatgcaaaggcgcctcctggtgtttgcatttgaatagagacccaagcccgaagtcaaacaatgaggctcgtggtgggagtgggagagatttggggtagagcgcattcttgcagccccttctgcgcctccgtgaaggcagttctcttctccactttctcagaagtcttatttctccacttgctggggctacccctgctcctggggacaggaaggggattgcgtttcagccagggccccatctgcacagcctggggtcttctggcttcttcatccaggagcgctgtggcttctaatgacagctttcacataggaacaccttctgtgtgcctggcagctataggtacatggatcactttatgtgataaggaaatgggggctctgagctacttagctggtaaacggcagagcatggcctcaaactttggcctggcaggctccaaagtccccagtccttccagtataccaaataccgtcatgattgttttggaaacagggcccttgccaaaaccagcctcaagttcctggtgccaggagggccccacacctttctgggctaggcagtgtgtgggtcccgcctccggaagaccaggctggtgataaa

SEQ ID NO: 468506 - DNA, 1515 bp, Homo sapiens
ctgggggtgaaggcacttctctatggatccatctggatgaaaaggtctgtataaatgcaagatcattatcatcatcagctgtcccagttggagcctactgattctcaagcccacagtcaatggggcctttccaacaattccattgtacatggcttggaaaaggcacatggagagaggtgccctccaggcctggcccaggtcagggacaagtcagaagctacatctggagcagatccaggatcttatcctggtgcacacgaggggccagcatcgtgcttgcacatttatagctcaggtgctctctggtgttaccaggaagctgctgggaagagacggaggccggagagtgtcccaggacaatgcttccttcactcatgttcatttttaactttaaaaaatggcctccatgatccccaaaatggtcttttggtagtcacttttggcagagcccatgcagattttttaaaaaaccttttagaatcttgagaacatttcaaatgtgcagaaaaattgcaaatatatccaaagaactccccaaaacatattctttatgcagactcaccaagtgttaacattttgccacatttactttgccatgctgtccctctcccttcctctctctctataatttttttcctgaacatttaagagcaagttgcagacacaatgacattttactcctgcatactgtgtggattttctgagaacaaggtcattcttttatataacctcggtacaaatgttaaagctaggaaatttagcaaaatttttattgaatccagaagtaggttcatggctaaggcctctgtaacaaaagatggtttaacaaaagaaaagcttacaaatttatttaagataagttttacatgacacaggagctttctaaggaaaggaacactcaaagaaacagttaaacttgtgtatttttatgctaagtttgactaataatggacaatcatgaagacaaataattggacaaaagggttatggtgtaatggtaataaactgggagaacttagcaaggcctctttggtcagattcttctctgataccctgtgtcttcagagataaagatgtttctttcctccaggtatagggagaacatcttgcgaatgggggtcttatatgacccatttcagggtaaggtcagaaaatcgttcttaggttttgtgacctgcttcaagggagaagagcgagaggaagtctataaactagggatcacagcaaccttacgggattgttgtgagggtcaactgagcagttggtagagtagctggcatataacaagggttcaataaatgtttattctttcccctaaccttccccttggtaaattattttaagagatagtatagtttaaaatattagttccatgggctcttcctccagtgctgtcagtgaacatttattgagatgtgaccatgtgtagtaatgacaacatgattgaatatgttctgtgtgccaagttatctattttaactctcaaaactcttatgaggcaacaactattgactg

SEQ ID NO: 468507 - DNA, 683 bp, Homo sapiens
tctcccagccccgagtattcaaggaaattgcctcctcagctgtgttctagataagactgtgctgacctttgcaggatgggcagagatgccaaggcctcaggctctgttgccttttgcatccacttcagtggctttcaaattggaggtaacctggaagctgacgtgagaagagagggtgtcagacccgccttcacagttcagccctggcccactctaagggacgaaggagttggatccttcttcctcacaggcctagtgcctctggcttcagttggtgtgaccttagagccctctgagcaattaatggctgccattttgaagacagcagatgtaattcagcagcttacattgctttacacatgtacacttcagagacacacaggcctgaggctggcctgcaggttgagctctgaagagtttctgatgtctacagcccagaagaccaggtgttctgaagattcctgtcaccagtgctgagatgttctgaatgaacagctctacaggagaaatatagcaatcaaactacaaggtactatagaaatagagtccatatcctctccttcttatgaggagataaaggctcagagaggtgaaggaacagcagggccaagacaaagaaccaggtctttcccctcccaggtcaaaatgcataaggtgttgtaaaccaagacaattgttagact

SEQ ID NO: 468508 - DNA, 1599 bp, Homo sapiens
tcaaggggccagagccttttggtacattccctgtgctgcaagttgaagctctggcatgagctcatcatggggttttttggaatcatgggccaagatggaatgtctcagagcaacgagggaccttacaggtcaggagcccagtggataaagctgctggctcagaggcacctgcagtgccaccttggaggctatggaaagacaactgctgtcatcgtagaaattggacactggagtctgcaaaaagcctcctggaagggacactcactcgctggaggtgctgactcccaggggttggggtggtccattccttgtcccccagcccacaacacacacactcaggccattgctcgtccttcactggtagacctcatagcatgtctcatggcccctcccttggcttcctatgaaagtgacctgggtggctgcctatggagtgagatctcaggttcacctagaagccactctgtccccaaagaattctgtctggcagtcgggatctgatagtcctttgataggcagggtctggtgcctttcattgctcattgagaaactggactgaaaatagaagttttgaatgttgggtgagcagagcgtgctgtcagggcagtgtctatacagtgtgtttcccttttaacttgtggtttagtttcagttttcctcactaatgaggttaataaggaaatgatgcttccaacaatagctgttactgctaagcccctgtggagataaaagatcagtggtaagatctttcaatgccttctcattttaaactcgtagaattggtgtctgttaacattatggtgtaaacagattattgaaaatttttaataaatataattttagtaactatatgacatttgtaaaattcatccaaccatttctatattattggacactttctgattttttgttattacaagtaatgctagttatggcatctatgagtagatgttttatttactataataaacatctgtgagtagctgtttactataataaacatctggttttcaattgtaaaatggagtttataagagacgtgctttataggattgctgtgagaaacacttgcgatactgcattgaaagcacttagcctagtgcctggcacataaggatgcctcaatcaacgcgagctgtcacttttcccattactgctatggttactgttattgttgttattgctatcttagctgacaactttaataattacagttggcactgaattcattcattcattttatatatacgtatatatttagtgagttctgctatgcaccagggacactctagtgatggggaccaagctatgaccagtcagaaagacttttactggctaggagcttgaattctagtgaagagagaggcagatgataaattagtaaacaagcaaacaaatacagaaataatagtttcagagagtgatatttgctattaaggaaataaaatggaaaaactaatacacaatgactggaagtagggggagtctttaaatcttcagagagggagacatttttcctaagaggtgaatgctgagaagataacagttacgtaacagacctgaagaagggctttcaaagcaggagagatagcatgaaga

SEQ ID NO: 468509 - DNA, 938 bp, Homo sapiens
tatctgatattggggagggggcaggatttaggaactgctcctcgacatgggaatgatttacaagtgccaacaaggctccttactagctgcagcaatgtttatgaacgagcaaacctctggtgcatctgggaagcaggagatgcagggcctggtaggagtcatgacaccgcaaataagaatgatcctacaccaaaacaaaaatactgtgacctacatgcgctctcttggagactgctgcttggttgttattaatgagagatttccaattaacttgggctgttcaaagcagctctatgcctgggaaagagaatgcatgagaattttccaaagagctttttctcttgaaacagaaaatataaatggtagtggggggaaaaaaatcaaagttactgaatatggaaatcaccactttggggtttatgagaaccacatcctgctaactccctgctatgcgatggggctttcagaggtaatgaggcaagtaccagagtgtcaaatgtctgccttgctttacacttatgtgtgctcttgtcctggtcctcctgctggatggcagcttgaaataggccatagtaggagtatttacaccacagaaattggcaaacactatgaagtggggctcccccctaccctccacagagagctggttgttaagcacttacccgcatgccacttactacaaggaaagaaaaagtttttgtatgctttggtgctcacagcagcaaataactagtaaagcttaagatgagaacgtgcaatatttgtctataatgtacggaggactgagggggaagaattagaagttactccactcctagatcccaggtgccctggtccagtgctaagttatagtaaatgggccccttgtggcatgaaggagttagtatctcttcctcagtcactaatttacctgggcttattgtcctgttgtgcttctg

SEQ ID NO: 468510 - DNA, 1447 bp, Homo sapiens
cgtttcagttcacagtgtgtgcagtcgtgtgtcttgcgcatacacacatgcacatagacagccaatttgaacaccgaggattaacttgtcttaaaggggcaactctctctctctgagcgggtggcacagggcttgatgacaggaggccaccccttccccagcccatctgctgctagggaagaccagcgtgtgggctgttcattgccaccaaggaggttttcctgctgtttactgaggtttaactctccttgtaaaggagggcctggcccaaacatctgtttcatcaaaggggttggagtcttggagacacaaaagcttctctcagtggctccattctatggcctttatcgctcccagagaggcaggcctccagccgacagtgtgcagggccacaggactctcagagcctttcccttctccatacttttccttctccattcttcccagggtttagagagcttggagccaaaggactgggatctgaacccctcctctgacatgggacaattcactcctcagttttcatccatagaatcagaatgacagaaaacccagcctgctcttctcacaggatggcaaggagaaccaaactagaagagtgcagtaaagtgtaaagtgctgtacaaatggggatggttgtttttatagctgaaacttacactcttagtttctggatctttctataatgtttattgagtgggtgagagaaaatgatgaaggccccagggggtacaattaagcctttagggaatagcagttagaaaaatgccattttcctccctaaaaacgaaaacaaacaaatctttagggtttttttttaaatggtaaaatacacataacataaatttgtcatcttacgcattgttaggtgtacagttcagcagtgttaagtacattcatattgctgtgcaacccatctccaggacatttccatcttgctagaagggaattctgtgcccatggacaacaactccccattttccactgtcctcagaccctggcaaccatcactctgctttctgtgtctatgaatttgactaagtacctcaaataagtggaatcacgcaggatttgtctttcagtgattggcttatttcacttagtgtaatgtcctcaaggttcattcatatagttagtctgtgtcagaattcccttcctttttaacactgaataatattccactgtatgtatatgccacattttgtttatgcattcatctgtccacgaacaacttgggtggattccacttttccgccattgtgaatgctgctgctatgagtgtaggtatacaaatatcttttcaagaccctgctttcaattcttttcggtatgtacccagtagtgcaattgctggatcatacggtaatcatatttttaatgtttcaagaaaccgccatactgttttccatagtggctgtactatttcacatttccaccaacagtgtac

SEQ ID NO: 468511 - DNA, 574 bp, Homo sapiens
cttttccttgtgtcacccagggtgccatcacacatcaggtccctcttcaagtctgatcttaggttctcactctactctatcctgctggaaaccaggtccatgggactagatacagaaaaagagactgatggagaggacccagagaacataagtgacatggtctcttccctcagagatgctttgactctaacagcctccagttacttggagccagagaaggcccaaggtcaaaaggtgctaaagcctggtcctttagccaaacaagcaaaccaggtgactcaggtgactctaccaggctcatgtcaaagtgatggagacagggatccagttggctccagcccaggaaatagggttgggactcccaaacagaagcgccgagggcaatccaacttgaaaacagggcacaggcaagggggccttttggagacattacctaaaggaccacccacggcatttctctgttttagagacaggggagcccagcagttaagaaagcagagttggggtagtggactcagccagtgggttcatcaaacaggagagtcaaggcagttgcttaaattagaataagtaa

SEQ ID NO: 468512 - DNA, 1625 bp, Homo sapiens
gatccttgctcctttcagatgtagccagtgcaaaaactgcccaaggaggataatggtaacttgttacgccaaacagactcaaagtctccctctagagtgtaaacagagagcttcagagagaagccacccaacagaaaccaggagcaggaataagaaagcatcaagatgcagaggacgcaggagaagcagcatctgcacgatgggcagaggacagaggcccagtcacactcaccctctgcctgatggagagacctcccaacataactccaatcgcattgtgaccccggtgccttctagcacatacccattctatagagcagtagttcttaaccccaagccccagggggcaattctgctccccaggggatatttggcaatgtctggagccatttttggttgtcacaattgggggcagggaatgtgccagtggcacctggtgggtagagtccagggatgtgctaaatgttctacagtgcacgcgacagccctccacaaccacgaattatcaggctccaaatgccaatagtgccgaggttgagagactcagggctagagttttagaaaaacttaaaagaaataagatttgggttttttataatcatgaacaatgctacagtgaaaatccttgaaattatagcttagacaaatgatcattatttaggataaattctgaaaagtagtatgctagttcaaaagggtatacttcatgtaagttttagttatgcccagtaacagtgcaaaagactgtctatttccctgggtccttaccaatattagcactattcatccttttaatcttggccaaaatgaaaggatgaaaaaaaaagagagattttaatcccatttttattaccagtgagtttgagcatcttttagtgagtccaattatacaactgtttattgtacaacgctgtacaatataattatttacatcatattaaatatacttgagtatatataattattgtattatatattcattgcattgtattttactatataattatttatcaagttcttaatagatgtttgcagaataataatagctggcactgcttatgtgcaaggcactgttctaagcacaccttgatgtggtcctacctcctcctagccacgtgggtgcacttatcccgcccttgtgttccactggttaggtgaaggctcctttctggtttgaaaaggaatgtatatgagtacatttgaaatatgattgaattttaaaatatttaaaaatattacaacgtttaaaatgttaatattttttaaacactacacacttgttctcattttagtcccaaaacaacctggtgaggttggcactactactactataattcttgctttaaagatgaagaaattgagacacggagtgtccagagacttgcccaaagacacagatcaaagaggggtgttcacaatctgaacccaggtttttttatcccaaagcttccatctttaactactacaccgaactgccagtaacaagagccacttcatgtcttgaaatagcagttggtacacaagcccctaatggaggctttgatttctaagtcaagagggatgcttaagcctttcaaataaaaacagaaagggtcagagacgtatcccaagggggactggaaccc

SEQ ID NO: 468513 - DNA, 510 bp, Homo sapiens
agcaataggaattctgcgctagatgaacataaaaaggggcaagtttctagatcacacttgtaaagtgtctttagcccacatatatttggggatttggggatcctatttgcaaaggcaacttatttgtatggatgaatcccatggttattgttcactaatcatgatggttgtgtgctttactacaaatatgtgcttgatggcagtctggttcaacacagaggttgctcacatcattggtgaaggagtacggtttcaatgtgaaggacacatcaaagacatatcagaactttactcatttgtcagtaatataagatacttctttagagaggcagataatagttttcaaatactggaagaatatctcaatgttgtgtgctattcacaatgtaacagctaaaaggtgacacagttcaggtttaatctacgttgttaacatttcctttgtcacttccttaaatctaaacaatcaacaaaacaatcaactgagcactgattggtagtgtttgctga

SEQ ID NO: 468514 - DNA, 492 bp, Homo sapiens
cacacaaccaacatccagcaccgagtgccagatgcttgagagaggaggcatcttggacttcccactgattgttgcaggatggatcctgaagaaggaaacagaggctattgacggaggaaatgggaaagtagcaagaactggagagaaagaagacagatttagaaggattaagtatgtgggtgagtgggattctggggtcctaggagcagaaccactgcagagagttcccactagggcaatgcctagtggagccccaggagtgggaccatcaagaccccagaactatagagctaccagtgtacagtaccagccagagaaagttactggcataaaactccaacttgttgttcgtggactgttggaagcaaacctagcaccccttgaaggtgtgagagtgtgggaagagcaggtgaggagcggcgaattgcctcatttcgggcaatgagaggaagaggagggtcgggccacagtgatgcatcacagactgtggtg

SEQ ID NO: 468515 - DNA, 566 bp, Homo sapiens
accaacatccagcaccgagtgccagatgcttgagagaggaggcatcttggacttcccactgattgttgcaggatggatcctgaagaaggaaacagaggctattgacggaggaaatgggaaagtagcaagaactggagagaaagaagacagatttagaaggattaagtatgtgggtgagtgggattctggggtcctagctattaatgaagaatttttctttacatgccgtgccttcatccacttcaataacctttttatgcttttccctttgtttgctattattttgtctgatgagtttgtctgtgaacagagacatcttaagagaaaaaaaggaattggtgaaaagacagacatgttaaaattgttatttgcctgagcattagaattttagattaaggcctagaatcaaattcagtttattttctcatagattttatgatacatgttgttttcatttcctattttgagatttaggataggcccagaattgtaataaagttgccatttaaaaaccttccattcattgttatcctagtagacatgtattatttttctcttccaaacat

SEQ ID NO: 468516 - DNA, 980 bp, Homo sapiens
tgtctgctgctgtgtacgatgtgccttttgccttccaccatgattgtgaggcctccccagccacatggaactctaaagattgctttcaccattttcagaggcctctacacaattcaacagatgtattgggtattgactgtatctgtcaaagcacatagggactggcatagagaggggtaccagccacagcatgaggaaggtgatcatcaagacaggaaaaacggattgccgtccatcccatgccccacaattctaccactaccactgtctggcttctcatggtgtgaccgtgagaagcaccccatccatagcccttccattccccaaatgacctccaagttcccttctcttctccccatggattctgacactaaagatgccagcttcatccaaaggctgacttgcttcagggtggcaagatggctgcagcagttccaggcttcacatttgtgtagtcaaaaagctggaaagtcctatgggaatggataatagggtccttaattaataaacaggaggcattctgaaaatttatttttggaatttgtttggttagaacttgaaatacatttctccacggaagcaagttttcaatttactcacaaagaacatcttttcatgtcaataaatattctctgaaagataattgtacatagttgtcttgtatcccttcatatgtatgtatcatgatttatttaactaactttctactgtgggacaaattttggttctttccaaactctttatattataagcaacagtgtgttgaacatttttgttgcaaaaactctgtttatgctgttatttcctcaaattcaattcagtgctacttttgacagtactacttttggtggcttttaatcccatgctttgtgagatgaagtctctgcaaatatgtatgtttgggaatgctacaattcttcacgggtctggaaaccagttttaaaagctccacacatttctgctgttgtacagttcagttt

SEQ ID NO: 468517 - DNA, 587 bp, Homo sapiens
ttattttcagcctggttcttgaaggatgtataggagtttttcagaaggaagagaaagggaagaagcttccagcacctgcctgactacttattactgcttatcctcatttgccgctaatgagggtgatgctgacttgaacaatgtcaatcagggatctacctgcatttctcctactggaccccatttggagcatatttgtaaggtggagcaaaccaagcaaaagagcgggccagaaccaggaagagaagcggcgtcctcccgtgatgtctctccagcgccctctactgacaaagcttatcgtggcgctcaatgtaaaggacaaatgctttacacgtcattatggcagagcagtcaatgctctttcgacggcactataaataatccctttattacatgaattctctcaaaatatcgggaaaaggaatggcctgttaactgagatgattgtataaattgaatttgtttttgatccttgaatctgacaaggatacaatactgcctctaccctgccctttcccccaccaaataatttaaactaagcatacgtgggaaacgattaaaaaatggtatatcagattgtatgactt

SEQ ID NO: 468518 - DNA, 1387 bp, Homo sapiens
gctgtcctccccttttcctcctccttccctcctcctccttctcttttttcttccgtaataatagttattattattagccatcaagaatcgagtgcctaggctctctcctcggagacactgggtgcattctggttgccattttaccttgcctccaacccagcctaaaatgcaaaccgtgtttgacgcccatcccccactggttgtggctgcagcccagcacgttcccctggccaaggagaaagctcacaaagaagcagagctatgcggatgcttgggcggggattctccagcctgtaggaaagggtctgccactattgccgctgaacaccaagatggaccagagaatctgcgcaggacagcaacaatgcctgctgtggtaaccctgagccaaagcaaagcccatgttatggggtggcaggaaccaagagccctgccgagaaggctgacctgccaaaaggaaaatgaggtagagaagcacgagaagcaagacagacaacgcagtcacagagagcagagcctggccgtcacacccactgtctccagcagccgcccacaggagcccacccggcacagtcaccagatgtgacccaggacttgtattccggcaatgactcttccattttcctcccataattatttccagctcttgctcatacaattgttggtttgaaccaccgcacccagttgatttatcctgcaattaaaaaaaaagtgactttgtagctccctctgcaatcttatcttccgtaaatggtgtaaacagttactgctgtgcaaggactctgatttctgacttcttccatgagttctgttttcatatatccaactcgttgctggatacttccatcaggatatacagtcagctctctgtatccctgggatctgcatttgtggattcaaccaactgcagatcaaagatatttggaaaaaaaacaataaaaagctatgacaatttaaaataatacaagtttttaaaaatgcaatgtaacaattatttatatagcatttacattgtattaggtattgtaagtaatatagagatgatttaaggtatatgggaggatgtgcctaggttatatgcaaataagataccattttatacaaggaactttgatatataaaggatttagatatctgctgtgggtcctggaataaatcccctatggataccaaaggacaactgtactcatagaatctcaaattcaatgtatatacaaccaaagatatcatctttttcctcacaccaagtactctttctgatatttctgttaatggcaccattctccattgccttcatgtttacaaccttcatatgatccctgggtctttcctttcccttgattccaatatctggataattggaacattctaccgactcgacctccat

SEQ ID NO: 468519 - DNA, 1343 bp, Homo sapiens
gcgtcacacaaccttccttcaagatgtacatctgaaagattgtttttatatgtgcattattcagcctccccagactctccctcagaactgtaaacaacaaagaaatattttcataactatcagttattctaccaatgacaactccaggttctctggcctttggtatccacagctgtaccagtggcctgcagagttctcaggccttcggcctcaaactgaaagttcgatcatcaccttcctggttctgaagcattcagacttagacttagccacgctactggctttcctggttctccagcttgcagacgacctatcaatggatttctcaattttcataattttatccctaaccaatacaattggcaatgactttacaacagttgagctagataccacagaggtgtatgtatacccaattaaacaaaacaaaactatctggttctatagcaatcaagccaaatacaggctttgagatcttgtacaagttatataatttttatatgcctcagtttcatccaaaataaggataataatatctaccacattaatttgtaaagcaaagagaacaagttggtatgttaaatgtacataaagatgcagattttttcttcatatttaacaatttgctttatgccatcaattgtagtaattgtgataacaatgcagacatttatttattattggttctcaatggacaattacatatgttgcaatgctaaccttctcttcatagaaaaagacagttttagagtgttaccaagatttgtctaatttatacaagcattcgcaactgctctctgggagattttaaagtatgagctatcccttcctaaaatataattattagaaaccttattctctgcatcatgttgaagtcataatagaaaaatatgttatctatataacatcagagactttattgtttatatattaaagcaaagataaattgtttaccatattaaaatatcagtatgaagcttattgcctgctagttttgctagtacttccctcttatattgattttttctacaaattgtataataaagtaaaatattaaggaaatcatactgtagtaaattttctactcccagaaacatacttacaagccttaactctcaatacctgtgaatgtaaccttattttgaaatagagtcattgcagatataattaaggatcttgatatgtgatcatcttggatttagggtgtactgtaaatctaaagaacagaatcctaataaaagaaagaataaagatatttgagacacatcaggacacaaattagaaagctatgtgaagatgcaggtcttctggaaaatctgtatgcacatataaaatttagaatc

SEQ ID NO: 468520 - DNA, 791 bp, Homo sapiens
gccgcaggggtgaagctgcccagggccatgggagcccacctcttgcatcactgtgacccagatcttgtggagttctgtgggagcgagaccacttggctccctggcttcagtccccttcccatgggagtggacgaatctcctgcttcacagaagttcccagagccagaggatgcaagtactcctgggtctcagagcctgcccaaacagccacccacctgcacagccgctaagaaccttcccagctctgtgctcgagacccaaggcccaggtggcatgggcttacgaggggacttcctgaccaactggctgcaaggatccatgggaaaagtgtggtttttcatggagcgaacacgaaagattaaagaggtgatggtgctgcactgtgatttccagtgtactttactaaaggaatatggatttcataagagctggtcaaaggaagtaggtcctgacctaaagcaaagagtcttggatctccaaccagtttattctttatttgcaagatcttccccttcggcacagatttcaagaaatcatattccaaagatagccctgctaaggtaaaactactgccctgagtcctatgaggctaaggaattaaatttggaggtgaccttgagacactaagacaaagggtccaaatgagaaaatatttggtggttactaacattctgtttcttaatcttcaggttaataaaatgatagacattcactttgtaaaaaaaaaaaaaaatcattctgcagtacacttaagttttgtatatatctctgtgtgaattatatgctttgat

SEQ ID NO: 468521 - DNA, 559 bp, Homo sapiens
ccttaattaatgtttaaggctctaaatcaaaatatagtattattgaggtcaccacccaggaaccaaagaggccagaatcctccctactgcaagtggcgcaaactccccaagtctccacctcgtcctcccagtctgcaggctctttcaggcttgaaagctggaattcaccggggaacttggctgtctcctgtctctatcaaagcgacttggcaaattgctgaaaatgaagcaggtttcattagcagagaggagcctcagttaactcatttattagacaaaaacggctgccaagatccattcaacaattactgccatcagcacaccaactctttatctccaattcactccagatggttcagcccttctggcaattccaatgtttcccgtgggacaggactagagcgtgtttcctacaaagatctccatactggtggaataaactcaaacatgccagaatatgttggtagctaaagacttaaatacattaaattatattagtgtgtattacctgcattaaacacctatctttaaggctgattaaaatgtatttgaatgtttt

SEQ ID NO: 468522 - DNA, 949 bp, Homo sapiens
accactacctgcaataacatgactaggaaagttgacggtgtaggtttcagtctatggctgaaggcctgagagtccccggcaaaccactggtgaaagtccaagattccaaaggccaaaaaccctggggtctgatgtccaagggtggtaggaatggactgaagcatccagtgttccaggctatggagctccctcaacagaagccaccgcagggagataagccatgccttttctgggccagtcctgtagagggaggcattccgggctcctggagcagcctgtggacccatgagcctcatccatgtcagtgcactgaaggtacacacaagagcctgggggcccttgttggcaggtctattgctgttggcaacaggatacttagagatccaaagcctgtgggtctctgtggaggcttgagcagtggctctgtccatactccaggcagctctccatgtggttctgtagaccagagggttcatgagggatcttctatgccaaggattgcaaagttccttggcagaagtgtgagtccccagggacactcactcactcaccccttccccacagcaggaagcccccctctcccccgggctctgtgccagtacctgtgatataaataaagatgcatttcaatgaaactttttttttaaataaagtcattctggggacattgcttagaagaaaaaaggtatattggctccttgtattagtattcatttgttattatgacaaatatcacaaagctaagcaacacaaattgtcttcatatgttgtagatcagagtatgacaaaggtcttaggggctaatatcaagattacactattgcaaaaactggcattttgtgggaatttgagtgttcatcactgctatccaaagtaatcctcactcagaatatggctaagactcctgcagaggttacattatatgaaagatttccttacaattgtctta

SEQ ID NO: 468523 - DNA, 1600 bp, Homo sapiens
gtctttttaaatgttgacaaaatgagaaaacatcttgacaatagctcaagttctaagagaaggtctaaaagaccttcaagagtgaggctgaagaagtcagccagcaaacctaaagaactagcagaactgacagcatccccaaggaaatggggccaggttaatgctcattgccaggaatttttgctccagcattttcaaaactcacaggaggtcacagatgagacaggctctcagaatctcctatggcttcctgatgtcacaagtgcccttgctgtcctgtcatgtcacatgccaaaaataaaaactcttcctatgctcttccttagcaaagctctgtggtcttcatattttggatgtaagaggagacaaatgcaacaatgcatataccgtggcttgaggaccaaaactcttcttaaaatcttatttagagatcacaaatagtaatatttgagtgcaaaagtggccaagattttaatgtctcttttgctaagtttttttaataagacattttagtgctgcaatatagggggtgtgtgtgtgtatgtgcacgttgtgcacatgtgtgcgtttgagcctgaaggtatttattcatgtccctgatgactgttaagcatcattaaaggaaattaaacaactgggatggggaagcacttaaagcttattaattctcaaaattttacagtgtgatgggaaaatagtgatgcaaaatattataagcaaggcaaggattgacaattagattttttattttctcacttatataaattaacagaaaatcagaagctgttctaggtatattcccttccttttatattttgcctgttgtcactcatttctttatctatcccaccctactcccatcatatgcacacttacaataaataaacctttgttttccattcatacctgaatagttttgcatctgaagggttttattttaatgtttttctctctttgaatgaaatgttgttccatataactacatctctaaataacttacggacttttagaacatgttgtagaataaaccatacttaagaggctatctcatttttacttgttaaataaaaacactctctcatttgaaacttcataaaatttaagctgaatatttcttagagcctacattgttttctgttgtaattatttgaatttattctaaaatttttaaattctgtgtcactttaggttgaacaatgtaaatatttcataaatattacaaaagtatgaataaataagagaatcaatacagtgaatttattctagcaatcagcctattttcctatagagccatccacatttaatcagatacaaatattaaagcagtaccttaatattgagggtaataatgcaattctaaaagttcctggtgtgcttatttttagtacaataaagcatttatgatatgcctactatatgcatggtttcatattaaacaatcaagatacagaaacaaattaaaaaggaataaaccttttttcagttgaaattattatgcaaacaaacaaatcataatacctaatgacagaataatgaaatagtaaggtttgaagttgctgtcctacgaagggaccttttcacttttatattctttgatact

SEQ ID NO: 468524 - DNA, 793 bp, Homo sapiens
tgggaacctggaagctggaaaagggaagcgagagttcattttattttatactcagtcatacatcttcaactaagatttttcctttcatacctcaatcatgagtatgttctcttttgtaactgctcaagtcaggatgcttgatgctcagaagtcaaagcgtggaaaaaggcaagaaataactaagatcagagcagaactgaaggagacagagacacaaaaaacccttcaaaaaatcagtggatccaggagctggttttttgaaatgatcaacaaaattgatagaccactagcaacactaataaagaagaaaagagagaagaatcaaatagacgcaataaaaaatgataaaggggatataaccaccgacaccacaaaagtacaaactaccatcagagaatactataaacacctctacgcaaataaactagaaaatctagaagaaaaggataaattgctggacacatacaccctcccaagaaaacatttttatgttgggactgccaagacaggataatagagaagtaggaagatgaggataaaattgtaactaaagttgaaaattttctcttttttttcttttcttccttagaaaaccataaagttagtttatatgggatagggaaggcaaagaagagtttaattcttaggaaattttggttaaaattaggaatcacctataatatttggcttaacaaggttcttttaaaggctgcatcattctctgggaatgtggacttactttgtaattttctgaattaaagactagttgccctactctttaatgtctcaatcc

SEQ ID NO: 468525 - DNA, 789 bp, Homo sapiens
tctactcatcaagctgtgtcaattgctgctgccgctgctgcaagtgtcttatagaaacattgctctatagagcactagatgcaagctgtttgtggatctaccattctggggtctggaggacagcaggcccttcccacacttccacaaggaagtgcctcagtgaagactccatgtggggcctcctactccgtatatccttttggaactgccctagtagagattctctcttgtggagaggcctcaggggacttttactcatggtataaggacttggtgccctgtgtcccagccatggctaaaacgagtcaaggtacagctcaggccattatttcagaagatacaagccccaagccttggcagcttaccaatagtgttgggcctgtgggtacacagaagtcaaaaattgagggaagttcagaagggaaatgtgaggtgggagcccccacacagagtcccactggggcactgcccagtggagctgtgagaagagggccaccatcctccagaccccagaattttagatccactgacaacacaatgcatctgaaaaagccgcagatactcaaagccagcctgtgaaagcatatatatcttatctttttcttaccttttggatgaaggaattatacatattgaaatctataaatcttaagtatacagtttgataaattttgatcagtgtatatacctctgtgacccatacttctatcaatttatatatttccattattctaaaaagaaaattgtctcgagcaccttgtaaatacccaggcaaactctattctaaaa

SEQ ID NO: 468526 - DNA, 600 bp, Homo sapiens
gagagaaatatgctcaacagagctcaccgtgtacatgtctgtaaaaagggaggaaagaagtttttcttccctggagcccgagggcgcttcactattctacttgtgatcaagactgacagcagcctataccagcccatgttctacttcctggccatgttggccaccattgacttgggcctttcaacagctaccatccctaagatgcttgggatcttctggtttagcctcagggagattatctgtgatgcctgcctcatccagatgtttttcatccacaactttactggcatggagtcagcagccctcgtgggaatggcttatgaccactttgtggccatctgcaacccgctacgatatagcatcatcctcaccaaaaaggctgtttctgtgattggtcttggtgtgttagaaggcagcaggaggaagacactgacagatgattcggatggaaataagacaactaaaatcaacaacttcaaaggacgaatgatgagggcataaattgtttaaagcacatctccaaaattttcagcattacagatgggtttagatacatctggaaatgggacggcatctaaaacaactgtttatgtttctgcc

SEQ ID NO: 468527 - DNA, 1355 bp, Homo sapiens
cgggccaggtggattttcatcctgatatgcatgggaccgctagtgagtttcacccctcctccttcctgttgctggggatcccaggactagaaacacttcacatctggatcggctttcccttctgtgctgtgtacatgatcgcactcatagggaacttcactattctacttgtgatcaagactgacagcagcctacaccagcccatgttctacttcctggccatgttggccaccactgatgtgggtctctcaacagctaccatccctaagatgcttggaatcttctggatcaacctcagagggatcatctttgaagcctgcctcacccagatgttttttatccacaacttcacacttatggagtcagcagtccttgtggcaatggcttatgacagctatgtggccatctgcaatccactccaatatagcgccatcctcaccaacaaggttgtttctgtgattggtcttggtgtgtttgtgagggctttaattttcgtcattccctctatacttcttatattgcggttgcccttctgtgggaatcatgtaattccccacacctactgtgagcacatgggtcttgctcatctatcttgtgccagcatcaaaatcaatattatttatggtttatgtgccatttgtaatctggtgtttgacatcacagtcattgccctttcttatgtgcatattctttgtgctgttttccgtcttcctactcatgaagcccgactcaagtccctcagcacatgtggttcacatgtgtgtgtaatccttgccttctatacaccagccctcttttcctttatgactcattgctttggccgaaatgtgccccgctatatccatatactcctagccaatctctatgttgtggtgccaccaatgctcaatcctgtcatatatggagtcagaaccaagcagatctataaatgtgtaaagaaaatattattgcaggaacaaggaatggaaaaggaagagtacctaatacatacgaggttctgaatgcaattttatgaaatttcagtaatgttatttttctctattatttggaatagctggttgaagtgtttatatcagatatgaatgcacccattttttgccgggtaattgatgtttcatggagctgcttcttacaatacaattataataattttctgagtgtcaacttttataactgtaggatgctggagataaaattttgactatgtcaccttcccttactttgtggaatttatagagtctaaaattaatgagcaacttcaactttgaaatgtccatactttttgttttaattgttccatatcattataatttatgtttatcttcccttaagagacacagcgatttaatggtaac

SEQ ID NO: 468528 - DNA, 1436 bp, Homo sapiens
ctgtaaaaccaaagacaggaagtatgctacaaatgaagactctgcacaaagcctcaaccctctggaaacatcgagaaaataattatactgactgtactcaacctatattgcagttaaagggacacctacacacagagatgggaaagaatcaattcatcaaggcagaacagaccctccgggagcccatgttctactttctggccatcctttccacaattgatttggccctttctacaacctctgtgcctcgtacgctgggtatcttctggtttgatgctcatgagattaactttggagcttgtgtggcccagatgtttctgatccatgccttcactggcatggaggctgaggtcctggtggccatggcctttgacctcacatttttcctcattggaatcccaggtctggaagacttccacatgtggatctccgggcctttctgctctgtttaccttgtggctttgctgggcaatgccaccattctgctagtcatcaaggtagaacagactctccgggagcccatgttctacttcctggccattctttccactattgatttggccctttctgcaacctctgtgcctcgcatgctgggtatcttctggtttgatgctcacgagattaactatggagcttgtgtggcccagatgtttctgatccatgccttcactggcatggaggctgaggtcttactggctatggcttttgaccgttatgtggccatctgtgctccactacattacgcaaccatcttgacatccctagtgttggtgggcattagcatgtgcattgtaattcgtcccgttttacttacacttcccatggtctatcttatctaccgcctacccttttgtcaggctcacataatagcccattcctactgtgagcacatgggcattgcaaaattgtcctgtggaaacattcgtatcaatggtatctatgggctttttgtagtttctttctttgttctgaacctggtgctcattggcatctcgtatgtttacattctccgtgctgtcttccgcctcccatcacatgatgctcagctaaaagccctaagcacgtgtggcgctcatgttggagtcatctgtgttttctatatcccttcagtcttctctttccttactcatcgatttggacaccaaataccaggttacattcacattcttgttgccaatctctatttgattatcccaccctctctcaaccccatcatttatgggaacacacctcatgccttcacacttcagcatctaaacaaaacttctctgttgacatgagcacttatttttcccctcttgggctgggtttttgtgactttcaattccaggtcaacatttattcattctcatgtattctgtcacacatatttagcattaaacagaagcaaattgcaaaccaccaaatattggaagagaggtatttactttacttgg

SEQ ID NO: 468529 - DNA, 1445 bp, Homo sapiens
tttctgagtccaagattgtaaagctatgacaattcttcttaatagcagcctccaaagagccactttcttcctgacgggcttccaaggtctagaaggtctccatggctggatctctattcccttctgcttcatctacctgacagttatcttggggaacctcaccattctccacgtcatttgtactgatgccactctccatggacccatgtactatttcttgggcatgctagctgtcacagacttaggcctttgcctttccacactgcccactgtgctgggcattttctggtttgataccagagagattggcatccctgcctgtttcactcagctcttcttcatccacaccttgtcttcaatggagtcatcagttctgttatccatgtccattgaccgctacgtggccgtctgcaacccactgcatgactccaccgtcctgacacctgcatgtattgtcaagatggggctaagctcagtgcttagaagtgctctcctcatcctccccttgccattcctcctgaagcgcttccaatactgccactcccatgtgctggctcatgcttattgtcttcacctggagatcatgaagctggcctgctctagcatcattgtcaatcacatctatgggctctttgttgtggcctgcaccgtgggtgtggactccctgctcatctttctctcatacgccctcatccttcgcaccgtgctcagcattgcctcccaccaggagcgactccgagccctcaacacctgtgtctctcatatctgtgctgtactgctcttctacatccccatgattggcttgtctcttgtgcatcgctttggtgaacatctgccccgcgttgtacacctcttcatgtcctatgtgtatctgctggtaccaccccttatgaaccccatcatctacagcatcaagaccaagcaaattcgccagcgcatcattaagaagtttcagtttataaagtcacttaggtgtttttggaaggattaagttagagtaaagagaggaagttttggacataaagcccacaggtttctgtttgttttcagctgtgctgtggcaaaataataaaccgttgactgtcaacaaaaaggcaattggctgtgcaacataaggcagtgtgaccaggagaaagttacttacctctctgttctccagtttcctcaactgcagaatgagcaaggaaataattataataccttccttcctcatagggatgttgtaaatatttaataatttaggtagttttctaacacagtgtctggcaaatatacaattttcaataaatattaaccattatgattggacaaaatctaaaacagtacaaaagtttcatctttcaattctctggccagtgtaatttcattgatgattaactgtttaaacatatttttatttatttatttttatgttactttatcataattacagattttattcattt

SEQ ID NO: 468530 - DNA, 1103 bp, Homo sapiens
agagcctatatgatcttcaggtggacagtgagttaacggcccaaactattaatgccaccgttattggagtgcaatcaccagtactgcctcaatttacttcaggattttggagggcacccaccttcccccttgtctcctcacacaatgaccctgggatccctgggaaacagcagcagcagcgtttctgctaccttcctgctgagtggcatccctgggctggagcgcatgcacatctggatctccatcccactgtgcttcatgtatctggtttccatcccgggcaactgcacaattctttttatcattaaaacagagcgctcacttcatgaacctatgtatctcttcctgtccatgctggctctgattgacctgggtctctccctttgcactctccctacagtcctgggcatcttttgggttggagcacgagaaattagccatgatgcctgctttgctcagctctttttcattcactgcttctccttcctcgagtcctctgtgctactgtctatggcctttgaccgctttgtggctatctgccaccccttgcactatgtttccattctcaccaacacagtcattggcaggattggcctggtctctctgggtcgtagtgtagcactcatttttccattaccttttatgctcaaaagattcccctattgtggctccccagttctctcacattcttattgtctccaccaagaagtgatgaaattggcctgtgccgacatgaaggccaacagcatctacggcatgtttgtcatcgtctctacagtgggtatagactcactgctcatcctcttctcttatgctctgatcctgcgcaccgtgctgtccatcgcctccagggctgagagattcaaggcccttaacacctgtgtttcccacatctgtgctgtgctgctcttctacactcccatgattggcctctctgtcatccatcgctttggaaagcaggcaccccacctggtccaggtggtcatgggtttcatgtatcttctctttcctcctgtgatgaatcccattgtctacagtgtgaagaccaaacagatccgggatcgagtgacgcatgccttttgttactaactgtgtctagtgtt

SEQ ID NO: 468531 - DNA, 2086 bp, Homo sapiens
gagcccatgtatttttctagccatgttagctgccactgacctcagcctttcactgtcttccatgcctaccatggtcagtgttcactggttcaactggcgttcaataacttttaatggctgccttatccagatgttcttcatccacacatttgggggagtggaatcaggtgttctggtggccatggcctttgatcgctttgtggccatccgctttcctttgcactatgctacaattctcactcacagtgtcatcagcaagattgcagcagccatcctgctacggagtgtgggggctgtgctccctgtgccttttctcatcaaaaggttacctttctgtcactccaatgtcctctcccatgcatactgcctccatcaggatgccatgaggcttgcctgtgctgacactggtgtcaatagcatctatggcctgttggctgtgatcttcatcattgtactagatgccttaatacttttggcctcttacattctaatcctgcaggcagtattgagcattgcttcccaggaagacaggctcaaggctctcaacacctttcagtgtcttcaaccaaccatggcaatattcaataacaccacttcgtcttcctcaaacttcctcctcactgcattccctgggctggaatgtgctcatgtctggatctccattccagtctgctgtctctacaccattgccctcttgggaaacagtatgatctttcttgtcatcattactaagcggagactccacaaacccatgtattatttcctctccatgctggcagctgttgatctatgtctgaccattacgacccttcccactgtgcttggtgttctctggtttcatgcccgggagatcagctttaaagcttgcttcattcaaatgttctttgtgcatgctttctccttgctggagtcctcggtgctggtagccatggcctttgaccgcttcgtggctatctgtaacccactgaactatgctactatcctcacagacaggatggtcctggtgatagggctggtcatctgcattagaccagcagttttcttacttccccttcttgtagccataaacactgtgtcttttcatgggggtcacgagctttcccatccattttgctaccacccagaagtgatcaaatacacatattccaaaccttggatcagcagtttttggggactgtttcttcagctctacctgaatggcactgacgtattgtttattcttttctcctatgtcctgatcctccgtactgttctgggcattgtggcccgaaagaagcaacaaaaagctctcagcacttgtgtctgtcacatctgtgcagtcactattttctatgtgccactgatcagcctctctttggcacaccgcctcttccactccaccccaagggtgctctgtagcactttggccaatatttatctgctcttaccacctgtgctgaaccctatcatttacagcttgaagaccaagacaatccgccaggctatgttccagctgctccaatccaagggttcatggggttttaatgaacttactgagcatctggttctggataccatgaagctggcctgctctgacaacaagaccaatgtcatctatggcttcttcattgctctctgtactatgctggacttggcactgattgttttgtcttatgtgctgatcttgaagactatactcagcattgcatctttggcagagaggcttaaggccctaaatacctgtgtctcccacatctgtgctgtgctcaccttctatgtgcccatcatcaccctggctgccatgcatcactttgccaagcacaaaagccctcttgttgtgatccttattgcagatatgttcttgttggtgccgccccttatgaaccccattgtgtactgtgtaaagactcgacaaatctgggagaagatcttggggaagttgcttaatgggttataatgttgaaatcattaggagagggtgcactctgcctaccacaaatacattttctcaacttctctttatctatttatttctttagcaggacattgctagatgtactgtattcatctttgctgacactttttgctccaagtacaacaaacttat

SEQ ID NO: 468532 - DNA, 2901 bp, Homo sapiens
tgcatgcatcatgcagatgttcttcatccatgtatttggaatagtagaatcaggagtcctagtgtccatggcctttgacagatttgtggccatccgaaacccattacactatgtttccatcctcactcacgatgttattcgaaagactggaatagctgtcctcacccgggcagtctgtgtggtattccctgtgcccttccttataaagtgcctacccttctgccattccaatgtcttgtctcattcatactgtcttcaccaaaacatgatgcggctagcttgtgccagcacccgcatcaacagcctctacggcctcatcgtcgtcatcttcacactggggctcgatgttctcctcactctactgtcttatgtactcaccctgaagactgtgctgggcattgtctccagaggtgaaaggctgaaaaccctcagcacatgcctctctcacatgtctaccgtgctcctcttctatgttccttttatgggtgctgcctccatgatccacagattttgggagcatttatcaccaccagaactctgtgttaaatcctcacctagtctgctggtggacacattaccccaaagaggaccagaacctcagggtagtggagttgctggccctccctatttccttgccaccaaaattgccgtgctaactgacagagctccaaatcacggaagctgcctcacgagtgcaccctcctggtggacattgcccctcattgctgtctaccttctctctgcactgggaaatggcaccatcctctggatcattgccctgcagcccgccctgcaccgcccaatgcacttcttcctcttcttgcttagtgtgtctgatattggattggtcactgccctgatgcccacactgctgggcatcgcccttgctggtgctcacactgtccctgcctcagcctgccttctacagatggtttttatccatgtcttttctgtcatggagtcctctgtcttgctcgccatgtccattgatcgggcactggccatctgccgacctctccactacccagcgctcctcaccaatggtgtaattagcaaaatcagcctggccatttcttttcgatgcctgggtctccatctgcccctgccattcctgctggcctacatgccctactgcctcccacaggtcctaacccattcttattgcttgcatccagatgtggctcgtttggcctgcccagaagcttggggtgcagcctacagcctatttgtggttctttcagccatgggtttggaccccctgcttattttcttctcctatggcctgattggcaaggtgttgcaaggtgtggagtccagagaggatcgctggaaggctggtcaaacctgtgctgcccacctctctgcagtgctcctcttctatatccctatgatcctcctggcactgattaaccatcctgagctgccaatcactcagcatacccatactcttctatcctatgtccatttccttcttcctccattgataaaccctattctctatagtgtcaagatgaaggagattagaaagagaatactcaacaggttgcagcccaggaaggtgggtggtgctcagccatggggctccacaatctgtagttggcaaagccagccaggcctgtgtcctttccttcaggaagaagtctacctggtgttctattatactgcagctgagctggcactcacatcacaagatacagaccttcccactctccctccacttttcaaaggcaaaggaccctcatcctgtagccacctgccactactggccatgaggagtactgccagaaaaccacagatgttcctgtcagtgggctcccctctggcccagggcagttccagaaatgccatccaagagtcaaatcctggaatgggggatcccaagaacctgctctacacccctgtggttgtgctggtacctacggtgcaagagaaagtcctcttactcttccctcaagcagaaggagtctctccccatagccagcacagctggacagcactgagtttaatgcatcagaatttcatttctgacaccagtgtgtctgctctcccctctccaagcacccagagacattctctgcaccacactgccattgccattgcctgatgacaggggcagcgcggcatcggcgattcaaggaatgacaacatatcacttatttattatagctttatagtgtgatttacttaatatgagatgtaaagcaaacccaatctcacaaaacaaacgaaagctttggatttctaggaggtgttaaattatatttatagattaaatgtaagaaaataaacattaacggatagcaaccagaatgttactcgtgtgtgtatgtgtgtgtgtgtgtgtgtgtgtgtgtgtgtgtcagaaagagagaggaagagagagagaggggggagggagatattgagaattcataacagggatcataagttcaaatgtttagagaagccaaggaaataacataaatttataaaacaagtacatattcacactgtgagtagtgggatctttattaaccaagaggcttaagacttctcaggggttgcctactgaatgtttgaatgtttccatgggggaatataggtctactacttccatgtctttccatatttaagataatttatgtctatattttatatattttgtgtgtataattttatatatatatagacaaaataatccaaacactgccatgtccaaacaaaacctgtctgaagaccatattgagatcttaaagcttttaaacacattaacttatttaatccctggaatgtatggagaaataattatgttcttaatttaaaagtacatatgaaatatatcataatacataggaagtaattttctcaataccacacagccaggaaatggcagagctgaaaccagaggacctgttcctgacc

SEQ ID NO: 468533 - DNA, 1666 bp, Homo sapiens
ccggaagccagcagccatcactttacacttttgaacagcagtaaattacccccaaatacttcacagagaaaaagatgttttttcttcatggattcacttttatggaatctggagtgctggtggctacagcctttgaccgttatgtggccatctgtgatcctctgaggtacactaccattctcactaattccagaatcattcaaatgggtcttctgatgattacacgtgctatagtactaatattaccactacttttgctccttaagcctctctatttctgtagaatgaatgccctttctcactcctattgttaccatccagatgtgattcaattagcatgttcagacattcgggcaaatagcatctgtggattaattgatctcatcctgaccactggaatagatacaccatgcattgtcctgtcatatatcttaattattcgctttgtcctcagaattgcctcccctgaagaatggcacaaggtcttcagcacctgtgtctcccacgtgggagcagttgctttcttctacatccacatgctgagcctgtccttggtgtatcgctatggtcggtcagcccccagagtagtccattcagtgatggctaacgtatacctgcttttaccccctgtgctcaaccccatcatctacagtgtaaaaacaaaacaaatccgcaaggctatgctcagtctgctgcttacaaaatgaacagacatagttttatttgatacaaacctggcatgaatgacttgcactgtagaaaagcgaacttgctctcttactgcctattgcatgtgggtttttaaaatatttttcattcaccaaacaaatagtaaatatgttgtacatttggtcataaaatataagtatgatatatcacccaagacatttgtagtggaattaggaaaataacaataatgaaatgataaataatactcctggcaattaacatgtattgactctttgtttcaggctaggtgttctactaactgcttttaagacatattccatttattcttccaaaacagcaaaatgaaatatatattactattagtgatatattacagatgatggaacagatttatagacatttaggcccccaaaggccatgtgaataacatgaggcacagttgagatttgaacccaggtgttctgtatctcaaatgctatgctcttcatcactgtattacatactctgccaaagtcatgtagcagaaatgttttaagatcaaaagtaagacctggatctccatggttccatcctttgtcttaaaaagttgtagtaaccttcttagaatatactctagctgttttcttcatggataattcataatacaaaaggtaggaatagatatgtcagggcatgtgagtcactatccagtgttggacagtccaaagaaaagctttaggggtgaggcacacttgctaatttatcacagggaatgggaacttgagagaactagaaaagaatgtaaagtaaattacaaggaagtttggggcagatgttctgaacctttttctgcattgtggtcccttagaaagctaatgaaatttatggacctttccccatagataaacatactcacattattttccatagtgtgattaaatgccattaaagacctatgtgactccttaaccagctaaagaaccaaggtaaagaattc

SEQ ID NO: 468534 - DNA, 589 bp, Homo sapiens
ggccagcggatgcctcggtgtgcgatgcatgccagcttgatgtgcaggctggctctgagccggaccgtgctcctcatcagacctccttctccctccacagggaagaatgacctgacaaactcaagaggcaagccaatttggttatggatagctcaagtttttccattcctaaggaaatctcagctcaatatcagggttttcccaaatttcaccttgagtgccctggctacctctttctgcataatctccagggtgattcgtccactgtggggtgatcagagatctcaagggtatgctggagttcctaaagctgtattgcagcacagacagacctttctgcagcagttcactccaacacaacttcaaattgcagaagacagtgtcccccttagggtgttaggttcatttatctttctgcatttttataataagagaagataagaaaactaaaaggtgtgtcaatgaattcccatgggaaaaagtgagaagtgattcagtgatccaatgatgtcccatctcccaaggagaagaattggaaggcttcacttgactgtaggtgaccattaagtctgctaggtcatgtttagca

SEQ ID NO: 468535 - DNA, 709 bp, Homo sapiens
tctacaagagctctggatgacttactttgtgggaacagtatggggacaattggggaggtcttggtacagtgggaaggcttagcatgcaatgtgaattatatggaggaagtcactctaacaactcaatgcagtttggaaaagggttgggatcaaaatgaggagactgaacaaaagaagcatcacttctattccttctctccagtacttcctcatgcggatgcagcagaggaagatttacccacctgcacgactcagcggaagaagaagtttgcgagagagaaagggaaagaaaggtcaagctgcggaatgaatgtcgacgatgttgcaatggatggtttaatgcgaagacacggcatacacgtggccctgctgagcatccatggacaggcagcagagataaaccatccctcctacagtccatacattgcaaaatgtgcccatggctcctgaagtacagttgattcttatttttcacaaattctgtgtctatgaatttgcctgctcaccaaaatttatttgtaaccccaaaaccaatattcatggtatgtcaccttagagattgttcattgttggcatagagaaatgctactgatttggggatactgattttgtatcctgcaaataaattatttatacaaataaattatttgtaaatttacttattagttctaatagttttttggcagagtctttagcttttaccaaatat

SEQ ID NO: 468536 - DNA, 1569 bp, Homo sapiens
ctgaataggaacagctccggtctacagctcccagtgtgagcgacgcagaagatgggtgatttctgcatttccatctgaggtactgggttcatctcactagggagtgccagaaagtgggtgcaagacagtgggtgcagcccaccgtgcgtgagctgaagcagggtgaggcactgcctcactcgggaagcacaaggggccagggagttctatttcctagtcaaagaaaggggtgacaggcggcacctggaaaatcgggtcactcccaccctaatactgcgcttctccaacaggcttaaaaaacggcacaccaggagattatatatcctgcacctggttcagagggtcctacgcccacggagtctcactgattgctagcacagcagtctgagatcaaactgcaaggcagcagcaaggctgggggaggggtgcctgccattgcccaggcttgattaggtaaacaaagcagcctggaagctcgaactgggtggggcccaccacagctcaaggaggcctgcctgcctctgtaggctccacttctcagggcacggcacagacagacaaaaagacagcagtaacctctgcagactcaaatgtccctgtctgacagctttgaagagagtagtcgttctcccagcacgcagctggagatctgagaactggcagactgcctcctcaagtgggtccctgacccccgagcagcctaactgggaggcaccccccagtaggggcagactgacacctctgagacaaaacttcccgaggaacgatcaggcagcagcatttgcgggtcaccaaaatccactgttctacagccaccgctgttctgcagccacagctgctgacacccaggcaaaaagggtctggagtgtacctctagcaaactccaacagacctgcagctgagggtcctgtctgttagaaggaaaactaacaaacagaaaggacatccacaccaaaacccatctgtacgttgccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggagggagaatgactttgacgagttgagagaagaaggcttcagacgatcaaacaactctgagctacaggaggaaattcaaaccaatggcaaagaagttagaaaccttgaaaaaaaactagacgaatggataactagaataaccaatgcagaaagagcaactccaagacacataattgtcagattcaccaaagttgaaatgaaggaaaaaatgttaagggcagccagagagaaaggtcgggttacccacaaagggaagtccatcagactaacagcggatctcctggcagaaactctacaagccagaagagagtgggggccaacattcaacattcttaaataaaagaattttcaacccagaatttcatatccagccaaactaagcttcataagtgaaggagaaataaaatactttacagtcaagcaaatgctgagagattttgtcaccaccaggcctgccct

SEQ ID NO: 468537 - DNA, 984 bp, Homo sapiens
gagagagagagagacaagaggccaacagaagcgggcgatagtgaagtcaaagcagacagcatcacctcctcttatgggcacctgtctaaaatgttaccagggatatgggcaagccgcgagcagtgctctcatgttgacagctctcatgcgtcttcagcaaatgaagtataaatgtaaaagaaaatcagtaaaagccggtccgttatcggactgtatagaggtgggaaggccaaaccgaggaattatgtctgacagaagggaagaaatgactgtggtggccttctcagaccctgtggaaaaggcatctacccatccagtgaaagtgtctacccggaccaacaggcctggtggaactgccatcaataaaccaaatgtgatcagggcgaggaacagggaagaaggaaatatggggaaatggggtgaatgtcaggtggatcagagagatacagtcattggggtcaggtgtggtatccagaataatgtgggaggccggattgaagtccgggccaggaacaatggtaactgtgggagactcaacaaagaggcgatggcagccactgcacggagacatgatggccagcctaaaacagtaaggtcaagttgtttggacaaaaaggctacaggacgtggtcccagtccttgtgtaagaattccaactgcacagccctgcacttcagctgtgtgtaatgaaaagggttgggatgagtcagggagagctagtgtgggggcagtctctaaagctgtctttaaggaacggaaagaggagtgaggaaaggatttaagatctatggggtcagctaggtttccttttgtgagtttatgtaatggttttgttaggatggcaaaaccaggtatccaaaggtgaaagtatccaaccatgcctaggaaggaaaggagttgttgtgttgtagaaggtgttggggtttgagagatcagttagacatgatcagcagggagagcacatgtgtttttatgaagaattat

SEQ ID NO: 468538 - DNA, 582 bp, Homo sapiens
tctctctcaagcgtggctgattctgcggcttttatgggctcagaatgggggagtgcatgctgagtgactacttttcaccatctgaaaagaagcctgatgctgcaggcagtcctagttatgcttgtaactatgcagaagagtgttcgactcaccttggtgtcacctctccacggagagctgttttgttgctcaataaaattgttctctgccttcctcactcttctcgtcagtgtgatctcatccttcttggacgtgggacaagaactcggcacccactgagcgtgggcacaaagaaggctgtaacctcgtggctctctgccctccgctggtgggggcagctgccccacacgatggaagcaggtcacgggcacccctgcctgggcgtcactgccttccccttgcctggacacgagagtccaccacgggagtggcttgcaacacgcctggtccagccgcaagcactgcacggagcctgtctctgtgaatgcacttggaacggcggactggaccccacactcacttattcacacatcccctcccaccgggagctgagcaggctgttgcagtgaccccaggacccac

SEQ ID NO: 468539 - DNA, 600 bp, Homo sapiens
gtcgccaccagcaccacagctgccgtctttatagttaatttcgatgaactcagatatatcaatttttcactttattgtttgtatttttcaggagaaccgatgtgtgatattccccaccctgtgtccaggtatctccagaattagttccttccagtgggttcttggtcttgctgacttcaagaatgaaaccacagaccctcatgcctcgctgctgactggcagttcgatcttggactgctgtgctagcagtgagcaaggctccgtgggcgtcgggcccaccgagccaggcacgggatataatcttctggtgtgccatttgctaagaccattggaaaagcgcagtattatggcaggagtgtcccgattttccagggcttcaggatctcagccttggccaagggcctttggttcccaagtgaagaaccagaccactgagggaagcaggaggacaaagaagggagaaatctcagtaaagtccccatatggtcaagatgccaggcaaggtgtcagagccctggaattgggaggagtttgaatctcagcctccgaacccggccggttaattttcttttaaagcaaagaacagtagaaactttattc

SEQ ID NO: 468540 - DNA, 572 bp, Homo sapiens
tgcaaaaggcagacccctttgcctcaagatccttgaggaatcgccacactgtcttccacaatggttgaacttccacgtcaaccattgtcttccacaatggttgaacttccacgtcaaccattgtcttccacaatggttgaactaatttacagtcccaccaacagtgtaaaagcacaggcccctctgctgcaggtctgctggtgtttgctggaggtccactccagaccctatttgcctgggtatcaccagtggaggctgcagaacagcaaagattgctgcctgctccttcctctggaagcttcaccccagaggggcacccgccagataccagccagagttcgcttgtatgagcagagcttgagtgctgtgctgggagatccgctgctctcttcacagctggcggccaagatgcccttcccagagaggagaaatctagagagtcagtctggctacagtgactttgccgcgctgtggtgggctccaccaagtgtgaacttctggcagctttgtttacactgtgagggataaaccgcctactcaagcctcagtaatggcgaatgcctctcccctga

SEQ ID NO: 468541 - DNA, 1080 bp, Homo sapiens
tggggcagagctgcctaaggccatgggaatccacctcttgcatcagcatgacctggatgtgagaggtgaagtcaaaggagattgcttgttgaacggctttgaccaaaatgctaataatgttatacacaatgaaatccaggttgaggtgttctcagatggagatgaagaacttgttgggatctggagtaaagaaatcactaagcagcaaagtgttcaagagatgacttgggtgctgttaaaatcattaagttttaaaagggaaaaagagcataaaagtctggaaaatttgcagcctgatgatgcaacagaaaagaaaaacccattttccgaggagaaatttaagccagctgcagaaatttgcatacgtaatgaggatccaaatgttaatcaccaagacaatggggaaaatgtctccagggctttctattgttgaaactttcactgcattttctatttctctaagtgtgtctttcatttccagaagttctgagtgttttttctttatggtttctttttccctggaagatttttacattcatatcctggattttttaaaaaaatatttaagttggtattcacctttctctggtatctgggaaatattaagctaccttgagtaacttaataatcaaccctccgaattctttatgtggcatttcagagacttctttttggtttggatctactgctggggagttagtgtgatcttttgggggtgtttatagagccctgttttgtcatattaccagaattacttttctggttccttcttatttgagcagactatttcttgaaattgttcatgaatttatttttgattggactgtggttttttaatttcatttttcccctcctgaggatcagactttaatgtttatactttatttttgcctaatttgattattggtgcttttaggggtgaagactctgtatgagttccttagttatagagtctttttgcactggctttcttagatgctggttgtagtagttatatactcattgtgtgggcaagtttactgtctcctattggttgagaatggcagggatctcttgaagcttatcccattctctcatggc

SEQ ID NO: 468542 - DNA, 523 bp, Homo sapiens
tttaaagccagaatttctcttggagggcatggacagtttctcacacctcctgggattagaggtggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacacagcaaaggttttaagtggataagtatgtatggggagtgggacgtgatctgcctgtctgccctgaaactgggaaaggtggatccagctgctgtccaggccttcaagaagcagagccccattcaattgtccacttctctgttgctgcccagagccagatcctgtgtgggatacttggcttttcaagggcctgtgtatggtgtgttgttgagtagaaatgtctgagatgctcctttagtagcacctgattcttttggatcagtgatttgccatttcttatatgaaaac

SEQ ID NO: 468543 - DNA, 663 bp, Homo sapiens
agctgcctttaggaactgtaacactcatcacaagcatccgcggcttcattcttgaagtcaatgctttgaaaggtgaggcgatatggtttggctgtgtccccactcaaatctcatcttgaattcccatgagtcatgggaggaacctgattgtgtatatcatcagatgatcttgacaaagtccaaaagccaccaggtctctattggaaatagttacaagggtcaagccctcacaattaccagaaattcaagctgccttatatatgtatggaaaagatatgtaacctactgcctctccaaagcaccttcaggaaaacatcctgttcactcagatgctatctatatttcagcaaatgtcagcaagtccacatactttggcagaacaaatgttacttttcctttcattactgtcctaagaggagttgtgcaatcctatagattatcacatggagctctcattggtatggggccaaggctgaatactcttttccagaggaggcaaattgtgaattagtagttcaatatggagggaataattccctgctcacgaaggacccaaactctccgtatctttacactctacaatactattatatgtcttcaattcttaacattgcttcatgttccaaaatggctgctgaatctacagcctttatgtctgctttg

SEQ ID NO: 468544 - DNA, 7751 bp, Homo sapiens
gaaaggacatttgagagctaatggagttcaatggtgaaatagcaaatgtcaccagacaaaaagtagtaagaagttatagtctgcgaaagaacatttgggagtactttgaggcttatggtgaaaaagcaattaacttcagtacttacctgactggatcgtccctggcagaatattttctggaagactgcattcggatgacccactttgttcctccaccaaaagacaagaagaagaaggataaggatgatgatggtggtgaggatgattatattcctccagagcaacagcgcaaagtgttggatccagtaccagttggagtaaccaaggtaaatattaaacattacaatgatgggattggaagtgatgttgatattaaacaaatgttacaggtcttcaaagagctacccaaaaaattacatcataaacaaaccttgagcagcggaaagggtgagctggccgagtacgtcccggattctgctttcacctctgcagccaagctcgttttgacagcttaaaaggtcaacaagttgtgaggataagtcagaaatcgctatgcaaccagattaaattttgtccacagtgtgtatagtgaatgaaaaaaggtttgatggtaattgtaaaataaaaggatgaggaaagggaagctctgtatccctgattaccatgctgcaaaaactttattggaaacaatgtttttgtagaatctgcaaaaggacattagggggcgcatagagatctatgctcaaaaagaaaatattttcagatataaactagaaagaagctttctgcaaaactgctttgtgatgtttgcgttcatctcacagtgttaaaaatttcttttcattcagcagtttggaaaaactgtttttgtccattctgcaaatggacgtttgggagctctgtgaggccaaaggtgaaaaaatgaatatcctaggatgaaaaatggaaggaagctatctgagaaactgctgtttgatgtgtgcattcatctcactaagttaaacttgtcttttcattcagcagtttggaaacattgttttggtagtatctgagaagggttgtttgggaggactttaaggcctagtgtgaagaagaaaacatcttcagatagaaactcgaaagtacctttctgagaaaatgctttgtgatgtgtgcattcatctaactgagttaacctttccctgaattcagcagtttggaatcaatgtttttgtagaatctgtgaatggatacttgagtgctccttaacacaaatgatgaaaaagtgaatatcccgggataaaaactagaaggaagctatccgagaaatcactttgtgatgtgtgtattcatctcacagagttaaactttccttttattcagcagtttagaaacactgttttggtagtatctgaggagggttatttgggagcactttgaggcccagtgtgaagaaggaaatatcttcagataaaacctagaaagtacctttctgagaaactgctttgtgatgggtgcattcatctgagagagttaaacttttctttggattcagcagtttggaaacactgtttttgtctattctgcaagtggagactgctgagttcattgaggccaatggcaaaaaagtgaatagcccaggataaaaactagaaggaagctatttgagaaactgcattgtgatgtgtgcattcatctcacagagttaaagttttctttcaattcagctgtttggaaatactgttttggtagatttctcaaagggatatttgggagcacattgaggcctatggtgaaaaggaaatatcttcagatgaaattagaaagaagcttttgaagaaactgctttgtgatgtgtgcattcacctaacagagttaaactttttttggattcagcagtttggaaaccctggttttatccatcctgcaaatgaaagttttttagctcattcatgacaaaggtgaaaaagtgaatatagcagaataaaaactagaaggaagctatctgagaagctgctttgtgatgtgtgcatccatctcacagtgttaaagctttctttccattcagcagtttggaaacactttttttgtagaatctgtggagggatatttgggagcacattacggcctacattgaaaaaggaaatatcttcaaataaaaactagaaagaatatttctgaaaaactgcctcatgatgtatgcattcatctcacagagataaacctttctttggattcagcagtttggaaacactgtttttgtccattctgcaaatggacatttgggagctcattttggtcaatggcaaaaagtgaatattccaggataaaaaccagaagaaaactatctgagaaactgctttgtgatgtgtgcattcatctagcagagttaaacttttcttttcattcagcagtttgtaaatactgtttggtagaatctgtgaagggatatttgggagcacctcgagggctatggtgaaaaggaaaatatattcagataaaaattagaaagaagctttctgagaaacagctttgtgatgtgtgaattcatctcacagagttaaacctgtttttggattcagtagtttaaagacactgtttttgtagaatctgtgtagggatattttggagtcactgaggccaaaggcgaaaaagataatatcccagggtaaaaactggaaggaaggtatctgagaaactgctttgtgatctgtgcattcatctctctgagtagaagtcttcttttcattcagcagtctggaaatactgttttggcagaatctgtgaaggaatatttgggagtgtattgaggccaaaggtgaaaaagtgaacataccaggataaaagctagacgatacctatctgataaacggctttgtgatgtgtgcattcaacttgcagagttaaacttgtctttttattcagcagtttggacaaactcctttttagaatctacgaggggttatttttgagggctttgaggactatcatgaaaaaggaaatatcttcaaataaaaactagaaagaagcattctgagaaactgctttgtgatgtgtgaattcatctcacatagttaaacctttctttggattcagtagtttggaaacactatttttgttcactctgggaatggacattagggagctccttgaggccaaagacaaaagagtgaatatcccaggataaaacatagaaggaagctatctgagtaactgctttatgctctgtgaattcatctcactgagttaaacctttcttttcattcagcagtttggaaacactgttttggtagaatctgttaaaagatattagagagcgcttagaggccaatggtgaaaaaggaaataacttcaaagagtagaaagaagctttctgagaaactgctttgtgatgtgtccattcaactcacagagttcaacctttctctggattcagcagtttggaaatactgtttttttccattctgtgaatggagattcctgagctcattgaggccaaatgtgaaaaggcaaatatccaaggatgaacactggatggaagctatctgagaaactgctttgtgatgtgtgcattcatctcggagagttaaatctttcctttcattcagcagcctgaaaacactgtttttgtagattctgcaaagacatatttgtgagcacaatggggcctatcgttaaaaacgaaatatcttcagataaaaactagaaggaagctttttgagaaactgctttgtgatgtgtgcatttgtctcacagagttaaacctttctttggattcagcaatttggaaacactgtttttgtagaatctacaaagggaagtttgggaactcattgaggtcaaagatgaaaagttgaatatccctagataaaaactagatggaagctatctgagaaaccactttgttatgtgtgcattcatctcgcatatttaatccaatcctttcattcagaagtttggaaacactgtttttgttgaatctggaagggatatttgagaatgcattcaggcctgtggtgaaaaaggaaatatcttcagataaaaaattgaaagaagctttctgagaaactactttattatatgtacattcatctgacagatgtcaatctttctttggattcagcaatttggaaacactgtttttgtagaatctatgaagggatgtttgggtactcattgaggccaaagatgaaaaatcgaatatcccaggataaaaactagatggaagctatctgagaaacagctttgttatgtgtgcattcatctcacagagttaaacatttcttttccttcagcagtttggaaacattgtttttgtagaatctgaagggatatttgagagcactttcaggcctgtggtgaaaaaggaaatatcttcatataaaacattgaaagaagctttctgagaaactgctttgtgatgtgtgcattcttctgacgtatgtcaacctttctttggattcagcagtttggaaacattgtttttgtccattccacaaatggacatttgggagtttagtgaggccaatggtgaaaaagtatccccagataaaaactagaagaaagccatctgagaaaccactttgtgatgtgctaattcatttcacaaaattaaacctttcttttcattcagcagtttggaaacagtgttttttaagaatctgggaagggatgtttggtagatcactgagtccataggtgaaaaagtgagtatcccaggataaaaaatagaaggaacttatctcagaaaatgctttgtgatgtgttcatttatctcacagagttaaacttttcttttaattctgtagtttggaaacactgtcttggtataatctgtgaggcaatatttgggagcgcattgaggcctatggttaaaaaagaaatatcttctagtaaatattagcaagtagcattctcaggaactgttttgtaatgcgtgtattcatctcacacagttaaaccactgtttggattcagcagtatggaaaccgtgtttttgtagaatctatgaagacatatttgaaagctccttgaggccaaaggtgaaaaaagagaatatcccaggataaaaactggagagaaactttctgagagacagctctgtgatgtgtgcattcacctcacagagttcaacctttctttttattcagcagttaggaaacactacttttgtagaatctgtgaagggatatttgggagtttattgaggcctatggagaaaaagagagatatattcatattaaaactagaaagaagctttctgagaaactgctttatgatgtgcgcattcatctcacaggtttaaacttttctttggaatcagtagtttggaaacactgttgttgtccattctgtgaatggatatttgggacctcattgaggcccatggcaaaaaagtgaatattccaggataaaaactagaagaaagctatctgaggaactgctttgtgatgtgtgcattcatttcacagagttaaacctttcttttcattcagcagttttcattcttttcattcagcagtttttaaacacctttttttgtagaatctgcaaagggatatatgggaattcactgaggccaaaaaccataaaagcaaatatcgcaggatgaatactagaaggaagctatttgagaaactgctttgtgatgtgtgcattcatctctcagagttgaaacttccttttcatttagcagttaggagacactgtttatatagaatctgcaaatggatatttgggagtgcattgaggcctatgatgaaagaggaaatatcttcagatgaaaactagaaagaaactctctgagaaactgttctgtgatgtgttcattcatctcacattgttaaacatttctttggattcagtagttgggaaacactgtttttgtcctgaatggatattttggagctcattgaggacataggcaaaaaagagaataccccaggataaacattgaaagaagctttccgagtaacagctttttgatatgcgcattcatctcacagagttaaacctttcttttctttcagcagtttggaaacactcttttggtagaatctgcaaagggatatttgggagtgcattgaggcctagggtgaaaaaggaaatatgcacagagaaaaactagaaagaaggtttctgagaaactgctttgtgatgtgtgcattcatctgacagagttcaacacttgtttgaattcagcagtttggaatcacagtttttgtagaacatgtgaagggatatttgggatctcattgatgccaatggtgaaaaaatgaatattccaacataaaaactagaaggaatgtatctgagaaaccactctgtgaggtacgcattcatctcacagagttaaacctttcttttaattcagcagtttggaaactctgttatggtagaatctgagaagggatatttgggtagtattgaggactagggtggaaaaggaaatatcttcagttaaaatctagaaagaacctttcggagaaactgcttggtgatatgtgcattcatatcacagaattaaacatttctttggattctgtagtttggaaacagtgtttttgtccattccctgaatggatatttgggagcccattgaggccaatggtgaaaaagcgaatatcccaggataaaaactcgaaagaatctatcagagaagccactttgtgatgtgtgcattcatctagcagagttaaacctttcttttcattcaacagtttggaaacactgtttttgtagaatctgtgaaggtatatttgggaactcattgaggccaatggcaaaaaagtgaacatcccaggataaaaactagaaggaagctatctgagaaactgttttgtgatatgtgcattcatctcccagaggtaaaactttcttttcattcaacagtttggaaacactgtttttgcagaatctgcgaaggtatgtttcggagtgcattttggtctagtgtgaaaaaggaaatattttcagataaaaactcaaaagaaccttcctgagaaactgctttgtgacgtgtgttttcatgtaacagagctaaaactttctttggattcagcagtttggaaacacagtttttgtccattctgaaagtggagaattctgagctcattgaggccaatggtgaaaaagtgaatattcctggataaaaattagaagtaaggtatctgagaaactgctgtgtgatgtgtgcagttttctcacagagttaaacctttatttggaatcagcagtttggaaaccctgttttggtagattccatgaagggatatttgggagcacattaaggcctacagtgaaaaaggaaatatcttcagatgaaaactaaaaaaaaaaaaaatgatttttgagaaaatgctttgtggtgtgtgcattcatctgggagttaaacttttgtttggattgagcagtttgaaaacactgtttttgtccactctgtgaatggacacttgggagctcattgaggccagtggtgaaaaagcatataatccaggataaaaaatagatggacactgtctgagaaaccactttgtgatttgtgcattcatcttgaagagttaaatctttcttttcattcagcaatttggaaacactgtttcagtagagtctgcgaagcaatatttggtagcacattgaggtctatggtgagaaaagaaatatcagataaaatatagaaagaagatttctgacaaactgcttggtaatgtgtgccttcatctcactgagttaaacctttctttggattcagcagttaggaaacactctttttt

SEQ ID NO: 468545 - DNA, 527 bp, Homo sapiens
acggtgaaaaaggaaatatcttcagatgaaaactagaaagaagctttctgagaaactgctttgtgttgtgggcattaacctcacagagaaactgagaagggatatttggaaacacattgagagctaccctgaaaaggaaatatcttcagataaaaacagaaagaagctttctgagaaactgctttataaaaacagaaagaagctttctgagaaactgcttcatgatgtgagcattcatctcacagagttgaacatttctctggattcatcagtttggaaacactgtttttgttcagtctacgaattgacatttcagtttggaaacactgttgtgtataatctagaaagagttatttcggattgcattgaagtctatggtgaaaaaagaagcatcttcagccaaaaactagaagaaaacttttgagaaactactttgtgatgagtgcattcatctcacactcttaagccttcctttggattcagcagtttggaaacactgtttttgtccattctgcaaatatctcagg

SEQ ID NO: 468546 - DNA, 667 bp, Homo sapiens
aattgtctggctttaggctgacaccttccttgccatccccctgatgccatctaaggccacggccatggagagggacttttgcaagattgtagaggctggagctggagagggcagagggcatgtggtggcagctaccaatgcagctcccagtgatctccacctcctggtattcacacttttgggtagtcccctcccacctggtactagtgatactttttctgggtgtgacacacagggagagagcctacatgacaccgagaaggttccacacatctctggtggtgctgagtgcaaagagcagtatctgaaactaggaccctgtggggcagtagatgccccagagagagatttgctcatgggcaaagagaactcctacttagctgcaggctccctgggagataggaccctgacacatctctcagagagaagccctgccagtgacaagcatcccctcttttttaatggaaagccatctgggaaaccaggtcatcatcagaagattgcttggtgagcttggaatcagatttaggggggatcgtttcatgatggtgcaacctgttgatggcaacaggttctaatcagctgttacccccatgcctgggatgggggaaggacttcctttgaagctggaattttgggagtgccttgctgatgaccacatgtactg

SEQ ID NO: 468547 - DNA, 688 bp, Homo sapiens
caggggcccctggaatgacacaagccaatcccagacctagagcatccctgcagtgcctgggccccgtttctcctcttgtagcacccagtgactgtgggggccactacacagatgaatatggcaggatcttcaactacgctgggccgaaaactgaatgcgtctggatcatcgagttgaaccccggggagatagtcacggtggccattccagacctcaaaggattcgcatgtggcaaagaatacgtggaagtgctggatggacctccagggtctgagtccttggacaggatttgtaaagccttcagtacattctattactcttcttccaacatcatcaccatcaagtactccagagaacccagtcatccacccaccttctttgaaatatattactttgttgacgcttggtcaacacattaataggaagatcgggggaagaggcacctgctgatgctcccctgctctgcctgagcctggttctgcatatgttggacagaggctatacctgggactgcagaaataagattgagtcatagttctcctggatcagcattgggtgagggagagggaatgtgaccctgtgacccttccagaaaaaggatataggggacttccaaagtgtttatccacctagtgcttaaaaggcagaaattatgggctcaattatgggctaagtgctttacaaataa

SEQ ID NO: 468548 - DNA, 703 bp, Homo sapiens
ggagccaaagaaataaaaataacaaggcgcctatgtccattctcctgctgactgacatgcggctccaggtcagacctttcacctctgtcaaccacgattttctcatttatgaattggagatagaaacagagaaaggagccacctctccacagagctgtgtcccaggagaatgggagcctcttctaaacacctggagtcctagagagctgaggggctgctccatcctcggagtcagagatgaaagccttgaaggaacagggaagaactgcagcgtggagaggatacagaacttagaccatttgcccaacacgggctccagtgattctgaaaaaggacttgcagcacaggagaccaagatggagaaacaaggagagaaggaggttgaaaactttcagccaaccatccacattctttgtgggatgcatattaccatagtgactcagaaggtaggtggggaaggggaaaacctgctgattctccccttctctgtggaagccagctgagtggcatgctgcatatacagatgtttctgtgactgccagaaaaaaagtcaccccatgaaaatctatagtggattttagcataaaatgttatttgcatttttatttttgtctgccactatggaaactctaactttgggttcaagccatatttcctaaatgaatgaatgtgtgactagtgtgataagatcacggaaggcatt

SEQ ID NO: 468549 - DNA, 1457 bp, Homo sapiens
gaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcaaatggaattatcgaatgcaatcgaatagaatcatcgaatggactcgaatggaatcatcgaatggaatggaatggaacaaaacgaatggaattatcatcgaatggaatcgaatggtatcaacaccaaacggaaaaaaacggaattatcgaatggaatcgaagagaatcttcgaacggacccgaatggaatcatctaatggaatggaatggagtaatccatggactcgaatgcaatcatcatcgaatggaatcgaatggaatcatcgaatggactcgaatggaataatcattgaacggaatcgaatggaagcatcatcggatggaaacgaatggaatcatcatcgaatggaaatgaaaggaggaattgaatggaatcaatcgaatggaattatcatcaaatggaatcgaatggaatcaacatcaaacggaaaaaaacggaactatcgaatggaatcgaagagaatcatcgaatggacccgaatggaatcatctaatagaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaaatcgaatggaattatcatcgaatggaatcgaatggaatcaatatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatgtactcgaatgaataatcactgaacggaatcgaatggaatcatcattggatggaaatgaatggaatcatcatcgaatggaatcgaatagaattatggaatgaaatccagtgtgatcatcatcgaatggaccc

SEQ ID NO: 468550 - DNA, 1195 bp, Homo sapiens
caaacggaaaaaaacggaattatcgaatggaatcgaagagaatcttcgaacggacccgaatggaatcatctaatggaatggaatggagtaatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaatggaaatgaatggaatcgtcatagaatggaatcgaatggattcattcaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggtatcgaatggaattatcgaatgcaatcgaatggaattatcgaatgcaatcgaatagaatcatcgaatggactcgaatggaatcatcgaatggaatggaatggaacaaaacgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaagcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatcgatggactcgaatgcaatcatcatcgaatggaatcgaatggaatcatcgaatggactcgaatggaataatcattgaacggaatcgaatggaatcatcatcggatggaaatgaaaggaatcatcatcgaatggaatcgaatagaattatggaatgaaatccagtgtgatcatcatcgaatggaccc

SEQ ID NO: 468551 - DNA, 1054 bp, Homo sapiens
caaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcaaatggaatcatcatcggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaaaggaaatcgaatggaattatcatcgaatggaatcgaatggaatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatcaaaagaaatcgaatggaattatcatcgaatggaatcgaatggaatcaacatcaaacggaacaaaacggaattatcgaatggaatcgaagagaatcatcgaatggacccgaatggaatcatctaatggactggaatggaataatccatggactcgaatgcaatcatcatcgaatggaatcgaatggaatcatcaaatggactcgaatggaataatcattgaacggaatcgaatggaatcatcatcggatggaaatgaaaggagtcatcatctaatggaattgcatggaatcatcataaaatggaatcgaatggaatcaacatcaaatggaatcaaatggaatcattgaacggaattgaatggaatcgtcatc

SEQ ID NO: 468552 - DNA, 551 bp, Homo sapiens
caaacggaaaaaaacggaattatcgaatggaatcgaagagaatcttcgaacggacccgaatggaatcatctaatggaatggaatggaataatccatggactcgaatacaatcatcatcgaatggaatcgaatggaatcatcgaatggactcgaatggaataatcattgaacggaatcgaatggaatcatcattggatggaaacgaatggaatcatcatcgaatggaaatgaaaggagaatcgtcatcgaatgaattgaatgcaatcatcgaatggtctcgaatggaatcatcttctaatggaatggaatggaatcgtcgcatagaatcgaatggaattatcatcgaatggaatcgaatggtatcaacatcaaaaggaaaaaaacggaattatcgaatggaatcgaagagaatcatcgaatggacccgaatggaatcatctaatggaatggaatggaatggaataatccatggactcgaatgcaatcatcatcgaatggaatcgaatggaatcatcgaatggactcgaatggaataatcattgaacggaatc

SEQ ID NO: 468553 - DNA, 1541 bp, Homo sapiens
gaagagaatcttcgaacggacccgaatggaatcatctaatggaatggaatggaataatccatggactcgaatgcaatcatcatcgaatggaatcgaatggaatcatcgaatggactcgaatggaataatcattgaacaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatccaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatgggctcgaatggaataatcattgaacggaatcgaatggaatcatcatcggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcaaatggactcgaatggaataatcattgaacggaatcgaatggaatcatcatcggatggaaatgaaaggatcgaatggaattatcatcgaatggaatcgaatggaatcaacatcaaacggaaaaaaacggaattatcgaatggaatcgaagagaatcatcgaatggaccgaatggaatcatctaatggaatggaatggaataatccttggactcgaatgcaatcatcatcgaatggaatcgaatggaatcaccgaatggactcgaatggaataatcattgaacggaacgaatggaatcatcatcggatggaaatgaatggaatcatcatcgaatggaatcgaacagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcgaatggattcgaatggaatcatcgaataaaattgattgaaatcatcatcgaatggaatcgaatggtatcattgaatggaatcgaaaggaatcatcatcagatggaaatgaatggaatcgtcatagaatggaatcgaatggattcattgaatggaatcagatggaatcattgaatggactggaatggaatcattgaatggacacgaaagggatcatt

SEQ ID NO: 468554 - DNA, 1670 bp, Homo sapiens
gaagagagtcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaaatcgaatggaattatcatcgaatggaatccaatggtatcaacaccaaacggagaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaatcatcttctaatggaaaggaatggaatcatcgcatagaatcgaatggaattatcatcgaatggaatcgaatggtatcaacaccaaacggaaaaaaacggaattatcgaatggaatcgaagagaatcttcgaacggacacgaatggaatcatctaatggaatggaatggaataatccatggactcgaatgcaatcatcatcgaatggaatcgaatggaatcatcgaatggactcgaatggaataatcatagaacggaatcgaatggaatcatcatcagatggaaacgaatggaatcatcatcgaatggaaatgaaaggagtcatcatctaatggaattgcatggaatcatcataaaatggaatcgaatggaatcaacatcaaatggaatcaaatggaatcattgaacggaattgaatggaatcgtcatcgaatgaattgaatgcaatcatcgaatggtctcgaatggaatcatcttcaaatggaatggaatggaatcatcgcatagaatcgaatggaattatcatcgaatggaatcgaatggaatcaacatcaaacggaaaaaaaaggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcgaatggaaacaccatcgaattgaaacgaatggaattatcatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcgtcatagaatggaatcgaatggattcattgaatggaatcgaatggaatcatcgaatggactggaatggaatcattgaatggactcgaaagggatcatgattgaatggaattgaatggaatcatcgaatggtctcgattggaatcattatcaaatggaatcgaatggaatcaccgaatagaatcgaatggaacaatcatc

SEQ ID NO: 468555 - DNA, 4076 bp, Homo sapiens
tggaatcaacatcaaacggaatcaagcggaattatcgaatggaatcgaagagaatcatcgaatggactcgaatggaatcatctaatggaatggaatggaataatccatggacccgaatgcaatcatcgtcgtataaaatcgaatggaatcatcgaatggactcgaatggaataatcattgaacggaatcgaatggaatcatcatcggatggaaatgaatggaatcatcaacgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatgaacaatcatcgaatggacccaaatggaattatcctccaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggattcgaaaggtatcaacatcaaacggaaaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggaagaatcatcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaagaatcatcgaatggacccgaatgcaatcatctaatggaatggaatggaataatcaatggactcgaatgcaatcatcatcgaatggaatcgaatggaatcatcgaatgaactcgaatggaataatcattgaacggaatcgaatggaatcatcatcggatggaaacgaatggaatcatcatcgaatggaaatgaaaggaagaatcatcgaatggacccgaatgcaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaaatgaaaggaaatcatcgaatggactcgaatggaatcatcgaatggaatggaatggaacagtcaatgaactcgaatggaatcatcattgaatggaatcgaatggaatcatcgagaatggaatcatcgcatagaatcgaatggaattatcatcgaatggaatcgaacgaatcaacatcaaacggaaaaaaacggaattatcgaatggaatcgaagagaatcatcgaacggacccgaatggaatcatctaatggaatggaatggaataatccacggactcgaatgcaatcatcgtcgagtggaatcgaatggaatcatcgaatggactcgaatggaataatcattgaacggaatcgaatggaatcatcatcggatggaaacgaatgtaatcatcatcgaatggaaatgaaaggaatggaaatgaatggaatcgtcatagaatggaatcgaatggattcattgaatggaatcagatggtatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatggaatggactcgaatggaataatcattgaatggaatcgaatggaatcatcatcggatggaaacgaatggaatcatcatcgaatggaaatgaaaggaaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaacggaaaaaaacggaattttcgaatggaaacgaagagaatcttcgaacggacccgaatggaattatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggagtcatcatctaatggaattgcatggaagcatcataaaatggaatcgaatggaatcaacatcaaatggaatcaaatggaatcattgaacggaattgaatggaatcgtcatcgaatgaattgaatgcaatcatcgaatggtctcgaatggaatcatcttcaaatggaatggaatggaatcatcgcatagaatcgaatggaattatcatcgaatggaatcaaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaaggaatggaatcatcatcgaatggaatcgaatagaattatggaatgaaatccagtgtgatcatcatcgaatggacccgaatggaatcatcatccaacggaagctaatggaatcaacatcgaatgaatcgaatggaaacaccatcgaattgaaacgaatggaattatcatgaaattgaaatggatggactcatcatcgaatggatacgaatggaatcatcgaataaaattgattgaaatcatcatcgaatggaatcgaatggtatcattgaatggaatcgaatggaatcatcatcagatggaaatgaatggaatcgtcatagaatggaatcgaatggattcattgaatggaatcagatggaatcatcaaatggactggaatggaatcattgaatggactcgaaagggatcatgattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcaccgaatggactcgaatggaatcatcgaatggaatggaatggaattatgatcaaatggaatcgaatgtaatcatcatcaaatggaatcaacaacaaccatcatcaattggtattgaatggaattgtcatcaaatggaattc

SEQ ID NO: 468556 - DNA, 656 bp, Homo sapiens
caaacggaaaaaaacggaattttcgaatggaatcgaagataatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaagaatcatcgaacggacccgaatggaatcatctaatggaatggaatggaataatccatggactcgaatgcaatcatcatcgaatggaatcgaatggaatcatcgaatggacccgaatggaataatcattgaacggaatcgaatggaatcatcatcggatggaaacgaatggaatcatcatcgaatggaaatgaaaggaaatcgaatggaattatcatcgaatggaatcgaatggaatcaacatcaaacggaaaaaaacggaattatcgtatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatc

SEQ ID NO: 468557 - DNA, 1513 bp, Homo sapiens
gaagagaatcttcgaacggacccgaatggaataatctaatggaatggaatggaataatccatggactcgaatgcaatcatcatcgaatggaatcgaatggaatcatcgaatggactcgaatggaataatcattgaacggaatcgaatgcaatcatcatcggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaaacgaatggaatcatcatcggatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcagatggaaatgaatggaatcaatcgaatggaacaatcatcgaatggactcaaatggaattatcctcaaatggaatagaatggaattatcgaatgcaatcgaatagaatcatcgaatggactcgaatggaatcatcgaatggaatggaatggaacaaatcgaatggaattatcatcgaatggaatcgaatggtatcaacaccaaacgaaaaaaaacggaattatcgaatggaatcaaagagaatcttcgaacggaaccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaaacatcgaatggactcgaatggaataatcattgaacggaatcgaatggaaccatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcgaatggattcgaacggaatcatc

SEQ ID NO: 468558 - DNA, 874 bp, Homo sapiens
gaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcttcatcggatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccttggactcgaatgcaatcatcatcgaatggaatcgaatggaatcatcgaatggactcgaatggaataatcattgaacggaacgaatggaatcatcatcagatggaaatgaatggaatgatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcaaatggattcgaatggaatcatcgaataaaattgattgaaatcatcatcgaatggaatc

SEQ ID NO: 468559 - DNA, 5489 bp, Homo sapiens
tggaattaccatgaaattgaaatggatggactcatcatcgaatggattcgaatggaatcatcgaataaaattgattgaaatcatcatcgaatggaatcgaatgatatcattgaatggaatcgaatggaatcatcatcagatggaaatgaatggaatcaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatatggaaatgaatggaatcgtcacagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattttcgaatgcaatcgaatagaatcatcgaatggactcgaatggaatcatcgaatggaatggaatggaacaaatcgaaaggaattatcatcgaatggaatcgaatggtatcaacaccaaacggagaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcaccgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataaaccatggactcgaatgcaatcatcatcgaatggaatcgaatggaatcatcgagaatcatcgaataaaattgattgaaatcatcatcgaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggagaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaataatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaaatcgaatggaattatcatcgaatggaatcgaatggaatcaacatcaaacggaaaaaaacggaattatcgtatggaatcgaagacaatcatcgaatggacccgaatggaatcatctaatggattggaatggaataatccatggactcgaatgcaatcatcatcgaatggaatcgaatggaatcatcgaaatcgaatggaacaatcatcaaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccacggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaaatcatcgaatggactcgaatggaatcatcgaatggaatggaatggaacagtcaatgaactcgaatggaatcatcattgaatggaatcgaatggaatcaacgagtggaatcgaatggaattatgatcaaatggaatcgaatatggaaataaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccacggacccgaatgcaatcatcatcgaatggaatcgaatggaatcatcgaatggactcgaatggaataatcattgaacggaatcgaatggaatcatcatcggatggaaacgaaaggaatcatcatcgaatggaaatgaaaggaaatcgaatggaattatcatcgaatggaatcgaatggaatcaacatcaaacggaaaaaaaaggaattatcgaatggaatcgaagagaatcatcgaatggacccgaatggaatcatctaatggaatggaatggaataatccatggactcgaatgcaatcatcatcgaatggaatcgaatggaatcatcgaatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcaaatgcaatcgaatggaattatcgaatgcaatcgaatagaatcatcgaatggactcgaatggaatcatcgaatggaatggaatggaacaaatcgaaaggaattatcatcgaatggaatcgaatggtatcaacaccaaacggaaaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcaacgaatggaaatgaaaggaaatcgaatggaattatcatcaaatggaatcgaatggaatcaacatcaaacggaaaaaaacggaattatcgaatggaatcgaagagaatcatcgaatggacccgaatggaatcatctaatggaatggaatggaataaaccatggactcgaatgcaatcatcatcgaatggaatcgaatggaatcatcgaatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggaatcaacatcaaacggaaaaaaacggaattatcgaatggaatcgaagagaatcttcgaacggacccgaatggaatcatctaatggaatggaatggaataatccatggactcgaatgcaatcatcaacgaatggaatccaatggaatcatcgaatggactcgaatggaataatcattgaacggaatcgaatggaatcatcatcggatggaaacgaatggaatcatcatcgaatggaaatgaaaggaatcatcatctaatggaattgcatggaatcatcataaaatggaatcgaatggaatcaacatcaaatggaatcaaatggaatcattgaacggaattgaatggaatcgtcatcgaatgaattgaatgcaatcatcgaatggtctcgaatggaatcaacttcaaatggaatggaatggaatcatcgcatagaatcgaatggaattatcatcgaatggaatcgaatggaatcaatatcaaacggaaaaaaacggaattatcgaatggaatcgaagagaatcatcgaatggacccgaatggaatcatctaatggaatggattggaataatccatggactcgaatgccatcatagaatggaatcgaatggaatcatcgaatggactcgaatggaataatcattgaacggaatcgattggaatcatcatcggatggaaatgaaaggagtcatcatctaatggaattgcatggaatcatcataaaatggaatcgaatggaatcaacgtgaaatggaatcaaatggaatcattgaacggaattgaatggaatcgtcatcgaatgaattgaatgcaatcatc

SEQ ID NO: 468560 - DNA, 965 bp, Homo sapiens
caaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcgaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaacgaatggaatcatcatcgaatggaaatgaaaggagtcatcatctaatggaattgcatggaatcatcataaaatggaatcgaatggaatcaacatcaaatggaatcaaatggaatcattgaacggaattgaatggaatcgtcatcgaatgaattgactgcaatcatc

SEQ ID NO: 468561 - DNA, 3306 bp, Homo sapiens
caaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattataatcgaatggaacaatcatcgaatggactcaaatggaattatcctcaaatggaatcgaatggaattatcgaatgcaatcgaatggaattaccgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatcttcgaacggacccgaatggaatcatctaatggagtggaatggaataatccatggactggaaggcaatcatcatcgattggaatcgaatggaatcatcgaatggactcgaatggaataatcattgaaccgaatcgaatggaatcatcatcggatggaaacgaatggaatcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggaatcatcgaatggactggaatggaatcattgaatggactcgaaagggatcattattgaatggaattgaatggaatcatcgaatgaatcgaatggaacaatcatcgaatggactcaaatggaattatcctccaatggaatcgaatggaatcatcgaatggaatggaatggaacagtcaatgaactcgaatggaatcatcattgaatggaatcgaatggaatcatcgagtggaatcgaatggaattatgatcaaatggaatcgaataatcgaatggaattatcatcgaatggaatcgaatggtatcaacaccaaacggagaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaatcatcttctaatggaaaggaatggaatcatcgcatagaatcgaatggaattatcatcgaatggaatcgaatggtatcaacaccaaacggaaaaaaacggaattatcgaatggaatcgaagagaatcttcgaacggactcgaatggaatcatctaatggaatggaatggaataatccatggactcgaatgcaatcatcatcgaatggaatcgaatggaatcatcgaatggactcgaatggaataatcatagaacggaatcgaatggaatcatcatcagatggaaacgaatggaatcatcatcgaatggaaatgaaaggaaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatctaatggacccgaatggaatcatcatccaacggaagctaatggaatcaacatcgaatgaatcaaatggaaacaccatcgaattgaaacgaatggatttaccatgaaattgaaatggatggactcatcatcgaatggattcgaatggaatcatcgaacaaaattgattgaaatcatcatcgaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaataatcattgaacggaatcgattggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgtaacgaatggaattaccatgaaattgaaatggatggactcatcatcgaatgcattcgaaaggaatcatcgaataaaattgattgaaatcatcatcgaatggaatcgaatggtatcattgaatggaatcgaatggaatcatcatcagatggatatgaatggaatcgtcatagaatggaatcgaatggattcattgaatg

SEQ ID NO: 468562 - DNA, 859 bp, Homo sapiens
tggaattaccatgaaattgaaatggatggactcatcatcgaatggattcgaatggaatcatcgaataaaattgattgaaatcatcttcgaatggaatcgaaaggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatgaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatacaatcatcatcgaatggaatcgaattgaatcatcgaatggactcgaatggaataatcattgaacggaatcaaatggaatcatcatcggatggaaacgaatggaatcatcatcgaatggaaatgaaaggagtcatcatcaaatggaattgcatggaatcatcataaaatggaatcgaatggaatcaacatcaaatggaatcaaatggaatcattgaacggaattgaatggaatcgtcatcgaatgaattgaatgcaataatc

SEQ ID NO: 468563 - DNA, 559 bp, Homo sapiens
caaacggaaaaaaacggaattatcgaatggaatcgaagagaatcttcgaacggacccgaatggaatcatctaatggaatggaatggaataatccatggactcgaatgcaatcatcatcgaatggaatcaaatggaatcatcgaatggactcgaatggaataatcattgaacggaatcgaatggaatcatcatcggatggaaacgaatggaatcatcatcgaattgaaatgaaaggaaatcgaatggaattatcatcgaatggaatcgaatggaatcaacatcaaacggaaaaaaacggaattatcgaatggaatcgaagagagtcatcgaatggacccgaatggaatcatctaatggaatggaatggaataatccatggactcgaatgcaatcatcatcgaatggaatcgaatggaatcatcgaatggactcgaatggaataatcattgaacggaatagaatggaatcatcatcagatggaaatgaatggaatcatcatcgaatggaatcgaatagaattatggaatgaaatccagtgtgatcatcatcgaatggaccc

SEQ ID NO: 468564 - DNA, 559 bp, Homo sapiens
caaacggaaaaaaacggaattatcgaatggaatcgaagagaatcttcgaacggacccgaatggaatcatctaatggaatggaatggaataatccacggacccgaatgcaatcatcatcgaatggaatcgaatggaatcatcgaatggactcgaatggaataatcattgaacggaatcgaatggaatcatcatcggatggaaacgaaaggaatcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatgaaatcatcatcgaagggaatcgaatagaattatggaatgaaatccagtgtgatcatcatcgaatggaccc

SEQ ID NO: 468565 - DNA, 2291 bp, Homo sapiens
caaacggaaaaaaacggaattatcgaatggaatcgaagagaatcttcgaacggacccgaaaggaatcatctaatggaatggaatggaataatccatggactcgaatgcaatcgtcatcgaatggaatcaaatggaatcatcgaatggactcgaatggaataatcattgaacggaatcgaatggaatcatcattggatggaaacgaatggaatcatcatcgaatggaaatgaaaggatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaaaggaaatcgaatggaattatcatcgaatggaatcgaatggaatcaacatcaaacggaaaaaaacgtaattatcgaatggaatcgaagagaatcatcgaatggacccgaatggaatcatctaatggaatggaatggaataatccttggactcgaatgcaatcatcatcgaatggaatcgaatggaatcatcgaatggactcgaatggaataatcattgaacggaacgaatggaatcatcatcggatggaaatgaatggaatgatcatcgaatggaatcgaatagaattatggaatgaaatccaatggaatcatcgaatggactggaatggaatcattgaatggactcgaaagggatcattactgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatccaatggaattatcatcgaatggaatcgaatggtatcaacaccaaacggaaaaaaacggaactatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaagaatcatcgaatggacccgaatggaatcatctaatggactggaatggaataatccatggactcgaatgcaatcatcatcgaatggaatcgaatggaatcatcaaatggactcgaatggaataatcattgaacggaatcgaatggaatcatcatcggatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaacgaatggaatcatcatcggatggaaatgaatggaatgatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcaaatggattcgaatggaatcatcgaataaaattgattgaaatcatcatcgaatggaatc

SEQ ID NO: 468566 - DNA, 4040 bp, Homo sapiens
gaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaacgaatggaatcatcatcgaatggaaatgaaaggaaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaacggaaaaaaacggaattatcgaatggaatcgaagagaatcttcgaacggacccgtatggaatcatctaatggaatggaatggaataatccatggactcgaatgcaatcatcatcgaatggaatcaaatggaatcatcgaatggactcgaatggaataatcattgaacgaaatcgaatggaatcatcatcggatggaaacgaatggaatcatcatcgaatggaaatgaaaggaatggaaatgaatggaatcgtcatagaatgtaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatggaatggaattatcgaatgcaatcgaatagaatcatcgaatggactcgaatgaaatcatcgaatggaatggaatggaacaaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatctacaaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatagaatggaaatgaaaggaatggaaatgaatggaatcgtcatagaatggaatcgaatggattcattgaatggaatcagatggaatcatcgaatggactggaatggaatcattgaatggacacgaaagggatcattattgaatggaattgaatggaatcatcgaatggtcttgattggaatcattatcaaatggaatcgaatggaatcaccgaatagaatcgaatggaacaatcatcgaatggacccaaatggaattatcctccaatggaatcgaatggaattatcgaatgcaatcgaatggaattatcgaatgcaatcgaatagaatcatcgaatggactcgaatggaatcatcgaatggaatggaatggaacaaatggaatcgaatggattcattcaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaacgaatggaatcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccgtggactcgaatgcaatcatcatcgaatggaatcgaatggaatcatcgaatggactcgaatggaataatcattgaacggaattgaatggaataatcatcggatggaaatgaaaggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcgaatggattcgaatggaatcatcgaataaaattgattgaaatcatcatcaaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcatgattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacagtcaatgaactcgaatggaatcatcattgaatggaatcgaatggaatcatcgagtggaatcgaatggaattatcgaatgcaatcgaatagaatcatcgaatggactcgaatggaatcatcgaatgcaacggaatggaaaactcaatgaactcgaatggaatcatcactgaatggaatcgaatggaatcatcgagtggaatcgaatggaattatgatcaaatggaatcgaatgtaatcatcatcaaatggaatcaaaaataac

SEQ ID NO: 468567 - DNA, 986 bp, Homo sapiens
caaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaagaatcatcgaatggacccgaatggaatcatctaatggaatggaatggaataatccttggactcgaatgcaatcatcatcgaatggaatcgaatggaatcatcgaatggactcgaatggaataatcattgaacggaacgaatggaatcatcattggatggaaatgaatggaatcatcatcaaagggaatcgaatagaattatggaatgaaatccagtgtgatcatcataaaatggacccgaatggaatcaacatcaaatggaatcaaatggaatcattgaacggaattgaatggaatcaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattggacggaatcgaatggaatcatcatcggatggaaatgaaaggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcgaatggattc

SEQ ID NO: 468568 - DNA, 1884 bp, Homo sapiens
caaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcgaatcatcgaatggactcgattggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaatcaaatggaatcatcgaatggactcgaatggaataatcattgaacggaatcgaatggaatcatcatcggatggaaacgaatggaatcatcatcgaatggaaatgaaaggagtcatcatctaatggaaatgcatggaatcatcataaaatggaatcgaatggaatcaacatcaaatggaatcaaatggaatcattgaacggaattgaatggaatcgtcatcgaatgaattgaatgcaatcatcgaatggtctccaatggaatcatcttcaaatggaatggaatggaatcaacgcatagaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgtattgaaacgaatggaattaccatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcgtcatagaatgcaatcgaatggattcattgaatggaatcagatggaatcatcgaatggactggaatggaatcattgaatggactcgaaagggatcatgattgaatggaattgaatggaatcatcgaatggtctcgattggaatcattatcaaatggaatcgaatgtaatcaccgaatagaatcgaatggaacaatcatcgaatggactgaaatggaattatcctcaaatggaatcgaatggaattatcgaatgcaatcgaatggaattatcgaatgcaatcgaatagaatcatcgaatggactc

SEQ ID NO: 468569 - DNA, 591 bp, Homo sapiens
catcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcaaatgcaatcgaatggaattatcgaatgcaatcgaatagaatcatcgaatggactcgaatggaatcatcgaatggaatggaatggaacagtcaatgaactc

SEQ ID NO: 468570 - DNA, 876 bp, Homo sapiens
tggaatcaacatcaaacggaaaaaaacggaattatctgtgatcatcatcgtatggacccgaatggactcatcatccaacggaagctaatggaatcaacatcgaatgaatcgaatggaaacaccatcgaattgaaacgaatggaattatcatgaaattgaaatggatggactcatcatcgaatggattcgaatggaatcatcgaataaaattgattgaaatcatcatcaaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactctaaagggatcattattgaatggaattgaatggaatcatcgaatggtctcaattggaatcattatcaaatggaatcgaatggaatcaccgaatagaatcgaatggaacaatcatcgaatggactcaaatggaattatcctcaaatggaatcgaatggaattatcgaatgccatcgaatggaattatcgaatgcaatcgaatagaatcatcgaatggactggaatggaaaagtcaatgaactcgaatggaatcatcattgaatggaatcgaatggaatcatcgagtggaatcgaatgcaattatgatcaaatggaatcgaatgtaatcatcatcaaatggaatcaaaaataaccatcatcagttggtattgaatggaattgtcatcaaatggaattcaaaggaatcatcatcaaatggaaccgaatggaatcctcattgaatggaaatgaaaattgtcatcatctaaaggaatcccatgggaatatcatcaaatgga

SEQ ID NO: 468571 - DNA, 597 bp, Homo sapiens
ttggcttatagaattatggaggctgacaggtctcaagatctgcaggcttccaggaatgacacccaaagccacactgcagatcaagatctcaaggagcctgctgctcctgtcacaatcaggaggccatctctgcatctgcacctgctggctccagaactatcacgcttctgctgtggcctgcatcagcaaaataaaatgctttgtgaaacaaatgaaatgccgcctctctcccagagggattcagttcccaaccagtatcatgagctgaccattgcattttctggatgttctaataaaatgtcaaatggtcatcatcaggaaattctgctcccaatatcatccataatacaggaaaaagtcagcaacaacagacttaatataaatctgaatctctatgagagaacatctttccaccatgctccatgctgagaaggataaagcctacttgatctacttgatccttcattttagtttcctcattcatgaagtggtgagtaatacacagggtttgttgtgttaaaaaagaaaacatatgtaaaggctactgcctagtgcctgatacatagtaggtattcaataattattggtatacttcct

SEQ ID NO: 468572 - DNA, 567 bp, Homo sapiens
tcagccttaatggggagcatctcatcctacttccctttctgcctgggacctcgggacactgttctccacatccttgctgtttcagttccagccattgcttacagtggccaaggtatagcttgggctgctactccaaaaagtgcaagccataagtcttggtggcttatacttggtgttaagcctgcaagtgtgccgaatgtaagagtgaaggaggcttggcagcttccaactagatttcagagaatatatgagaaagactgctgcaggggtggagcccccacagagatactctaccagggcagtgcagagaagaaagaagcaatatctgaagagataatggccaaaaattttcaaaaaactgatgaaaaacaccaatctacagaattattaccaaagaaggcacaagggagtgaggtagacaatgtgatttcagatagttaggtgctctgaggggaaaaaagaggataagctttattaaggcataatcaataaattaaaattatatatatatgtatggtgtacaacttgatgttttagtgtatgtacacattgtgaaatgattagatt

SEQ ID NO: 468573 - DNA, 647 bp, Homo sapiens
ggaggcctgtgatttaatctaacgggataagcaaaaggtcttcatgccacagattagaaatacagcttctttaaaggattggggaactcaaaagataaccaccctgaaatctccctctgcacaaggtgccaagacagcagcaagctttccgaggatttgcaaagaaaaaagtgtagctagactaaaaataatcagcatctctacaaagctttctggtgaggaaaagacaattggctcaggagacacacagagaagagaagcagacaatgtgaccacagtggcagaaatcagagtaatggggccacaagccaaggattacctggagccttctgaagctgaaagatgtaaggaagtatttttccctagagcctcttggagggatcatagccctgctgacaccttgatttcagacttccagactccagaacttttgaaactatagtataggatgacatcacagtattgaactagacaactgattatgattgcaaagggcaagaactaagaattcaaatgagggtactgaagaggcagcaaataagtgtaaaggctctattttttggtatgtaacaggaattctgtaatgtttactgaatagtaattaaatatgaattaattcaaagctaaaaaacagattgtataaacat

SEQ ID NO: 468574 - DNA, 761 bp, Homo sapiens
gcaagctgagggagccggctccggctttggccagcccagaaaggggttcccagagtgcagcggcgggctgaagggctcctcaagtgccgccaaagtgggagcccaggcagaggaggcgccgagagcgagcgagggctgtgaggactgagagcacgctgtcatctttcagaaggaggtcttatctgatgacttttattttctccatgaagccggtaaggacatctgctgaggttagcaacttgggaaagctcttcctgaagctgggtagtgttactcaatggaaaatctgtgctccattcactgctggacattcttgggtcttattattagcattttacagtgaccacggcttgggcttcccgcatgcgcagtgccctccttacccttgggaagtgagcacgcgcagtgcgtttaggaagttgtacgcatacccaactgaagctttcttcccttctccagtggagtgcacctgtgttgatagctgtggatttgatagctgtggatggtcaggagattgtcttctccctggcgcccaggcactggctgccaaattattatttttagagagcagtgtgataatcgtcaaaccatcacctgatactcctagctagattatctcctaactttaaaactttggatgaataattataaagcagcaaattggtgttgcaaagagaagacatgaaaagcagagtttagtagatattttctatgattcactcttgagagagataacagaaactgaagtgaagtatccttga

SEQ ID NO: 468575 - DNA, 578 bp, Homo sapiens
gagcccaggtatgtgatgttctcttccctgtgtccatgtattctcattgttcaactcccacttatgagtctgctggtgtttgctggaggtccattccagaccctgtttgcctgggtatcaccagcagaggctgcagaacagcaaagattgctgcctgttccttcctctggcacctgccagatgccagccagagctctcctgtatgaggtgtctgttgacccctgcttggaagtatctcccctgatagaaggcacaggggtcaggaacccacttgaggcaatctgtcccttagcagagcttgagcactgtgctaggagatccattgctctcttcagagctggcagagatgccctgcctatagaggaggaatctagagagacagtttggctacagtggctttgtggccctgcagtggactctgcccagtccaaacttcctggcagctttgtttacacagtgagagaaaaccgcctactcaggcctcagtaatggtaaacaacccctcccctcaccaagctcaagcatctcaggttgacttcagactgctgtgatggcagcaagaatttcaagccagtgga

SEQ ID NO: 468576 - DNA, 768 bp, Homo sapiens
tctttacaagggggaagagctgttgtcccgttatggagagagggaccaatatgtttgaaattcaaaacaaggacagcagtgacataggggctctcagttgctctgagagcgcccctccccagagaaacacagagccactaccaggtggtactgctgcagctgcaatggtggaggggctgtgggctgcctctggtttttcctccttggagaaatgcagatctgcctctaagtgttcagatgggggcacagaagctgtggtgaagtcccagtgtggccacgctagcaccccaagccaatgggccttgtcctgtgagatgcagtgcagagctgcagttgctaatgcagggatgcccaaggatccaaggctcccaggactccatgtatgcctgagcggcagctgtacccagactccacgtagctctctgtgtcagtctagaggccccggtggggaggttcacagggggtctgctgagccagggttgcaaaggtccatggcagaagtatggatccccagggactctcaccatttcccagcatgataaatatgaaatggtcagttatgctttagttaatatctcattaaagtaggggttacggatctagtttcggtttgggttatatcaacttaattccagagttataaaaaaacttaaattaattttaattccatggtgcatttgatggttaaatcccctataatacttctgacatgtcataatctgccctttgtgcaaacaccttaattattatatttatgattaaaatttt

SEQ ID NO: 468577 - DNA, 605 bp, Homo sapiens
tcagcgccctgtcaaaatggaccaatcagctctctgtaaaacagaccaatcggctctctgtaaaatggaccaatcagcaggatgtgggtggggacagataagagaataaaagcaggctgcctgagccagcagtggcaacttgctcaggtccccttccacactgtggaagctttcttcactcctgaagccagcgagaccacaaacccactgggaggaatgaatgaccccagacgcaacaccttaagagctataacactcaccgcaaaggtttgcagcttcactcctgagccagcaagaccacaaacccaccataaagaagaaactccaaacacatccaaacatcagaaggaacaaactctggacatgccacctttaagaactgtaacactcaccgcgagagtccgcggcttcattcttgaagtcagtgagaccaagaacccaccaattctggacacagaaggatcacgcagcaatatttgttgttctgcagcctccactggtgatacccaggaaaacagggtctgcagtggacctcaacaaaaaggacatctacaacaaaactccatctgtaggtcaccaacatcaaagaccaaaggtagataaaa

SEQ ID NO: 468578 - DNA, 1851 bp, Homo sapiens
gctgatttttgcttttgcctcaggctccgttatgacttggaaagtcattggttatattatgaggcaaaggcgaagggaatttgcaggtacaattatgatccctagtcaattgattttgagttactcaaaagagatttatcctggggcggcttggcaagggactgcaggcaccccctctgcaggaacaacctgggcatcctgggtgccatggacggcagataaacggcagcaggaggtgacaggctccagggggctagggaatggcctgaggcctggggcttgggctaccagttctgtggacccgagtgagaacttacggtgccttttccagggctgtccatggccacccagggaccaatcagcacacactccctctcctctgaagcctataaaaatccctgtcctcagccagactcgggcagacaacagcaccacctgcctgcagaggagctgcccactatgggtctcctctaaggtgttctgtcactcaataaagcacctcttcaccttgctcaccctccaccctccacttgtccgcgtacctcattcttcctggatgcaggacaagaactcagtacctgccaaatggcatggctgaaaaacacaagcagggctaaaacactctccttgcttgccatgtgatagatagatagatagagaaaactttcttgaaactaacatggtagcatgaaatgaaggccaataaactgctaaagtcacccaatctggccttcatagtggaaattatccattctcttctcattatctgactataaattaagtgtgcctatttaattagttcccgttttaacttggtaaacaggcaaatttggagaaaccattttgtaccagagctgtatgaagaactgtgattctaaaccatggattctgttttggtcttaggtcaatcacttaaaatccctgaagctttatatctttctttgtataatagcgatattcatgcctacttcatagtactgctatgaagtttatgcaatatatatattatatatcaccaaagagattcaccaaatcaagcatggatattaatgttctaactacttttcatcgtttattttacctgaaattcattttaatattctatctagcatggcaagttctgatattggtcaaagaatacaaaatttcagttaggaggaataagttaaagagatctattgtacaacataatgattatagttaataataacatattcctgaacattgctaagagaatatattagcctaatattttaagcattctcaccaaaaaagaaatgataagtatatgaggtaatgtaatatgttaattagctcattttagccaattcacaatgtatgcatatttcaaaacaacatgctgtacatgataaatatacacaatttcatttgtcaattaaaaataaactttttttctaaaaattaaagttctttagcactgaacagacttggaaatggattaggtatggttcagggttattttaactatttgaactatactgatgacatagtacttcgggaaaatatgtgtccaatatatgaaccaggcaaggtgtttgtggccattgacacacatctgatcagttttctaggacctggaagtgtacttcagggagtcactagcacctggcagcctggcaacagtagaggttattttcttctcacttgggtcactgctgttgtcataactcattctgagtagactgccaatggtgattgaagatgtccttcatattcttcttatttggagggaagtgtggctgtccatatttttctgattgaaaacagatttcaaggcttctcctagctaaatatggcaggcaagtatttcacagacttgcagatgacaaa

SEQ ID NO: 468579 - DNA, 778 bp, Homo sapiens
cgggcaaatttcctccttgctgttcttgcgataattgagagagttctcacaagatctggttgtttgaaaatgtgtagcacctcccacttcactctctcgctctcctgctccaccatgttaagatgtgcttgcttctcctttcctgaggccttcaagtcatgcttccttttaagcctgcagaactgcccctcttcggcacgtctgctgcagtttgctgggggtccactccagaccctagcccgtgggcaggaaagattaagttcactgaacctgagtctgcaccggcccctccccataggttctctgtcccagggagttgagagttctttctgtaagcccctgactggagctgctggatttcctgcagagatgcctcacccagtgaggaggaatctagagaagcagtctggccatactgtcaggggaaaaccacctacaaaagccacagtaatggcggtctcccctcccctcaccaaacctgttcccgggtggactccagactgctgcgctgacagtgggaattgcaagccagtggttcctagctttctgggctccatgggagtgggatccactgaacaagaccacttggctccctggctcagccccctttccgggggagtctaccgttctcctgtctcactggagtaccaggcgccgctgtagtgtgaaaaaactcgtgcagctcagtgcctgcctgaacagccacccagttttgtgcttgaaacctggaaccctggtggtgtaggctcacaagggaatcttctgatccgcggactgc

SEQ ID NO: 468580 - DNA, 1005 bp, Homo sapiens
cagtgggggacttgtcaacgtggcttggctatgtaccccacaaagagcaggcctactgctttttcatcgatgtacccaccattgaccgtgacattcactcctgagatttcgattcccatcatggtacctccaaatttactgatgcctcctgacaaaaatcaaaaaaggcagaggtctcgggaagctgctccactaatctcagcagctgcctctccaaaggtgatattccaaacatctgccttccaccagtgcccacatgcctgcaaacagctgcccctgggaaataatgacttcattttggtcttccaaaactctttcaagtgcctctccttgacagaactgacccagaactatactggaaagagattcttggaaaagaagttccagatgattgccctaagtagacggagtgaggatgctgctgagttgatcagagacaatcctgcacatggacctatcttcattcattcaacgggtagttaagggagacttactatacaccagactctgcacttgtgccaatcttatttctctaagacttttgagtacagttgtgtatcttctaatttttttctatattccatagtgcgtggcacaattctgggcacacagcagatagatgcacactgattgcccattggcttagctgacctcaaacatagctagtctgccattttcaatggaagagtgtaaaatgagaaatataatttacatatctctttctatacatagtaatttatgtatatatgctgagtagagcttagtattacacaggtataataagctaattaaagacaatttgaaaaagctagttaaaattttaaaatcacttttaatttatcattatttaccaaaacagccttttaccaacatttttggtttgcctttactgttttttattctatttttgtcttttagacagtattaatatatttttaatggttttatgtctttttctcttgattattatttaataggtattttaatgttattatatttgaaaaa

SEQ ID NO: 468581 - DNA, 951 bp, Homo sapiens
atataatcaagaaataactaagctgtaatgaaggaaacccaggatctgactagcccacataggtataagactttcttaccaaccagggtcccgacctctttctctgtgatacctggtcaagcatatggtaaaaatctctctatttttcctccacaagttttagataatgggagaaaaggatttacttgtgatcacgcagttggcataattctccttcctcttggtgccaaaggtcagaaacctggggagaggttgcctcaaactcttcttggtgactggtggagtcagatgcttggcttttgtggaatgaatgacaaaaaacatcagtttgagggacagcggaaagagaattgccagaaggtggaaaagagaaaactgattattagaggcgtgactctctcattaagtagctatgtgatcttgtggaaataatgctgagctcagcttcctagtcactgaaatgaaggaattcttacctgcctaatgtaagaatcacacaagatgatttcagtgaaagcactctatgaacctaaaatcgtcctataaagttagccacctctctttgtgactagttgggcatcattctagggtccggtagagtgttattatttcattgctgtttatatttcttttaaaacatggaattatgtctactagggattagacaatggatcgtttttaacattttcagttaaatgaccctatactttcctgaagtcttgtttcagtgtggtctccagaaagttcttcataaactctgaaggctaatttgtcagagctgtattatattttgatgtagtataatttgtttttctataatcccacatctttcttgatgttattacgttggtcaactattaaaaatggatacttctcttgtaatatctattcagaaacagcaaaagggcatcatagagcaaacattagacattggggtaagatgacaataaa

SEQ ID NO: 468582 - DNA, 755 bp, Homo sapiens
ttttcaatttagatatattagcttgaaggaggtgcagggctctttgctgagagctatgtttaactggggaaggaggcatgagtacagtaactgtggagagaattgctgattgcacaaaacatcctaagaagtggcacaatgctactttcacagaagtaaaagaatggtcgagaccttgtaatttggcctatgcagcaagacatgtagggattgcaaggtgcctatggcaagttgacttcaccgccaaggagctggaagaaacttttcattggcatagttacattgtagagaagattgaggttctgagagatcagtacaacaaggcagcatatagcacagtggtcaacagcctagactctggaactgttaaattaataatttctggatttaatttcaaatccttccccaaagtccattgtatcattcttatgcctttgtgtagctcccacaaatcagtgagaacatacaatgtttggttttccattcctgaattacttcacttagaataatagtctccaatctcatccaggtcgctgcgaatgccattaattcattcctttatatggctaagtagtattccatctattatgttggctgtgggtttgtcatagacagcttttatcccattgaggtatatcccttgtatgccgattttgctaagagttttaatcataaagggatgctaaattttattgaatgctttttctgcatctgaatgcttttgttttgtattgttagtctgtcttttgttgtaa

SEQ ID NO: 468583 - DNA, 844 bp, Homo sapiens
gctgctccgtgggccattgcttcaccctgcttttcctcactctccatgggtccagctgtctacctagtcagtcctaatgcaataacctggatacctcagttgaaggtacagaattcgcttcctgttttcactcctccctgtgacagctgcagactgcagctgcttctaattggctatcttatctggcaccccttgagatattttgcatttaggtataactttcaagaaggaggaagaggtcaatcgtgtgaaatgtcagagaaagtggaagataatgaggagtatagaaagtcagaaaaagattctaacaaatctctgggtggcgctgatgctgctggtagctggctgatcatcctgaggaatggtgccatatcgagggctcggtgttggtctctgctgctggcaaattggacactcagcagtggccataaccaggcagctcagccttggccaagagctgtttctcaaaaggagagtacttatctgcagaagatggcagaaccttgctccaaaatcctagaagcctctgctgtgattcacctatgggggcctgccgaaggctccaaacagcatccctatctgcccctgacatctcaagcaccattggatctgctgggtcatatggcgcaaatggcagagcagcttgtacagcagcctggacctgttgcagagccttctcctgttctggaacacactcaaaaccggcagtcactcaataaatgggcgggagtaacgcacctaaatgaggaatgtgttgcttccaaaatccaagtacacccactaggcattgtgcctccttcttggttgtaggaggggccaaattcagcaacttattttttacctt

SEQ ID NO: 468584 - DNA, 543 bp, Homo sapiens
tcctcagtcttcaggaaagaattcaggcctgtccttggaatgctacaagatatgttggaacctgggagtccccaatgggccctaaaaatgggaaccagaaggtggctgaatctgagagccagcattccaaccatgggacctcctgtggtaaggggtgacttagcagagaaggctgagccctactccaacgccccatcccacccccaacctgaaaccaatggggaacatgagaggctctgcggagatctgtggggaaaaggacaaaggatgaaaagggcaatggaatgtgagagttgccacaggtattttcctcaggaaaggagcactggaagtgtcctacaccctctgcagcagcctgtcaaaggccaagtcatcaacatatgcccaggatctctctactctggccttttcaagggctgcagtcctgccatcatgcccctggctcacaccaacatgcaaacatactctggtatctcatctctaaaaatatttttcatgccctagtttacttcccaatctttctattctgtttccttaactggc

SEQ ID NO: 468585 - DNA, 592 bp, Homo sapiens
aggaaaaccagagacctttgttcacttgtttatctgctgaccttccctccactattgttacttctcctcgctcctcaaaggatggtccccagaccggcagcctcgacagcacctaggagcttgttggaactgcagaatctcaagacctaccccagacctgcttttaacaagaccctcagattatataagcatgttggaagccaagataagtggaaagccaagcttcttacaccagttagccaagttgtgaaagcaaaggaaaagttcttgaaggaaattaaaagtgctgctccagtgaatacacaaatgatgagaaagcaaaacaaccttatcactgatatgaagaaaattttagtgatctggatagaaaatcaaaccagccacaacattcccttaagccaaagcctcatccagtacaatgccctaactctcttcagttctatgaaggctgagaaagatgaggaaactgcaaaacaattcatccagatgatctgcgattattgataatggtagccacacaaaacaacaaattttccatggagattaaatagccttctattggaagaagatgccatccaggacttttgtagct

SEQ ID NO: 468586 - DNA, 3728 bp, Homo sapiens
gtttacccttgaggaggaagaaaagaattcagaggctaaactgggcacctgtcagccacttaaaggcaattagcacagccgccagactaaagacacaggtgtcaggctgtctggaaaagggctctctaacaacccccgacccttcggggttgggagctttagttggcctggaaccagttccaactctttcactttccgtggtggtcccaaaatacacctgggagtgctcagcggacgtcttagtctcccagatatcctggttgagacaatggtcccaccagaggctccccctgcatgggttactgagtatgagacagccacatcttctgactcctgcctcctggatgctaatgtctgccggctagacttctttcctcatcttgcaagcaaggttattcccactaggcaggatcaagactccctatttagaagtcttgaattcttggagtggcacctggaagatccctgttcatggtgccctccagggtttaggcaagtgtcaccatttgatggccattttgaagggccagttccctaccatagcgtatggtcccccacatcaggacaatttaaagacagtggtcaacaggcacatggcaggggcaagggacgtttccatcccgctgatttaaaacaaataaaggcagatttagggaaattctcggatgatccctataactatacagatgttttacaagggttagggcagtcctctgatctagcatggaaggacatcatgttgctccttgatcagaccttaagtcctattgaaaatgaggcagctttagcggcagcccagcaatttggacatttatggtatctcagccagaggacaaaggccctctgggccagaagcacccaaccagatgattcagcaacaggcctgagggtggccagggcaagtgccagctcatgccatcaccctcacagagccccaggctgcctacaaaacacccacttcatctatagaaacacacgtagactaaaagatactccatgcaactagaagcaaaaaaaaagaaaaagagtagctatatttatattaaataaactataagttaattccactactgggtatatatccacaagaaaaaaaaacaatgtatcaaagagataactgcactctcatgtttattaacacactattcacaatagccaaaatatggaatcaacctaagtgcacatcagtgatgaatggataaagaaaatgtaatgtatattcacaacgaaatataattcacacaaaaatgaatgaaatactgtcagtgccacaagatggatggaattggaggtcattatgttaagtaaaataagtcaagcacagaaagacaaatattatatgttttcattcatatgtgggagctaaaatacgctggtctcatgaagatagagagtagattgattggcgattaccaaaggccagaagggtagcacggagagagcaagaacagaagttgattaatgggtataaatatacaattgagtagaagaaataagatctagtgtttgacagatcagtagggtgattatagttaaccataatctattgtgtatttaaaaataactagaaaaaaataattcaaatgttcctagtataaaagaaatatttaagggatggctaccccaattaccttgatttgatctttatacattatcaaatttgatacaaatgaatgtatcaaattatcacatgtacaccaaaaatatgtacatttatcaataaaaaataattttatgagagcgatttgaacacaagcagtctagacctaaggccacattctttcttaacatctatattattataaatactctacctggttataaataaaataatcatacatgtttaaagaaacaattggattttttaatgaccagacaagaccaacaaaaatgatcaagtatatttgataaaggacaatacaaaaataaaactgacccctaccttgtattacacacggaaaagtcagttctaggaggattgggaatataaatatgaaagataaataaaatttctaacagataacataaaggaatgtcttcatgatcacaaaatagggaaagtacagaaaggactaactacaaaggaagagattattaaaatggactacgttaaaattaaaacctctggccaagcgcggtggctcacacctgtaatcccagcactttgggaggccgaggtgggtggatcacaaggtcaggagttcaagaccagcgtggccaacatgctaaaattctgtttctactaaaaatacaaaaattagccaagcgtggtggtgcacacctgtaatcccagctactcgggaggctgaggcagaagaatcgcttgaatccgggaggcagaggttgcagcaagccgagactgcaccactgcactccagcctgtgcgacagagcaagactctatttcaaaaaaaaaaaataattaaaacctcatttatcaaaaaataccaaagaatgaaagagcaagccatgaagtagaaagattagaaagatatttgcatgaaaagatattggtaataaacgtaactgacaaagggcttgtatctagaatatataaagaactcctatgattcaataagaaaaagacacactctaacagccaataggcaaaagatttgaactagtacatcacacacacaaaaaaaccaaatagcctttaaacgtacgaaatgatgttcaacatctttagtcatcaggaaaaatgtaaatttgaaactgcaatgagatacatccatcagaaagactaaaactaaaaaaaaaaactaataataccatatgtgaaaatggaaattgaaagcagtctgaaaaagcgaaggaagcctaacacaaaataattttttgttgttgttttttggtttttctttgcagtttttacagttttatttaaacacaaaacatgcacatgagctgtctattcattttcttcactgcgcagcctggcgttggggttggtgtgactccgatggacagctgggcagctctttccacgatggctttgcagttcttggaggaaacatctcagcacaattacaaaaacttcctctctaatcaaggcttttaacatgaacagatttcttgaataaaatggaaagtttccagtacactgaaacataaattctcaagttgccatacatacaacacccggcaggaaaaaacaaaaacagcaagtttacatgatccctgtaacagccacagtctcaaactcagatgcttcctccatctgccaagtgtattctggatacagacaacatcgtggcttctggggtcatattcagctgaggctgtgggtccacagagcactcatctggctgggctatggtggtggtggctctacccaagaagcaaagcagttaccagcacattgaaacagtacattgaacatcttctaaatatgaaagtgagaaacaagaaggcaacaaaaaatgttgtcagaaagatgttaggaagtaaggacagctgtgtaaagcttgaggctgaaaagcagcttgccagcttcatttctttggcttcttgggtagtgggcaccggaacagcaatatgtgaggttctggttcatggatcatataatagacccatccctgactctgctgaacgccaagattcctccattcagattcagacatcaaatgggttttacggaccagcttggctatgtccttgggcagcacgacatgtcgatactcaaactcctcgtcgtcgtatttgtctgaatagtaaatttgtttgtgc

SEQ ID NO: 468587 - DNA, 1079 bp, Homo sapiens
ccagtttgcagcagcagtggaatgggaggaagagctcctgtatcacgtggaagagatagttacggaggtccacctcgaagggaaccgctgccctctcacagagatatttatttgtccccaagagatgatgtgtattctactaaagacagctattccagcaaagattacccaagttctcgtgatacaagagattatacaccaccaccacaagattatacttaccgtgactatggtcattccagttcacgtgatgactatccatcaagaggctatggcgatagagagggatatggtcgtgatcttgactattcagatcatccaaatggaggttcctacagagattcatatgagagttatggtaactcaagtagtgctggacatacacgagggcccctgccagcttacggcggaagcagtcgctatgatgattacagcagctcacgtgatggatatggtggaagtcagacatgtgtgttaaacaactacggaatactaaaaaaaagtttggcaaaccaaaaaggaagaagaagaagagaagaagaggaagaggaagcagaagcagaagaaggagaagaagaaggaggaggaggaggagaaggaggagaaggagaaggaggaggagaaggaggagaaggaggaggaaattgttttgtctctcggccatccttggagagcctctccctggggcccatgcagtggctgagccgagagctgaatgctggcgctggattcgacctagttaacatcgacactattgccacttggggccagttaattctttgttacgggggagctgtcctgtgcattgtaagatgtttagcatcatccttggtctgtatcagggatgtcgctggcacgcccccaccccagctgtgacaactaaaaccatctccagcattgccagctgtcctctaggaggcaaaattgctacaaattgagaaccactgttttagatctaaagaacaaactcagcattaggtcatagggtaaatagtagggacaatagaggcttccccatttaagtctgtttaccttacctccattaactaacctttgaaccagatggccctctccaaggc

SEQ ID NO: 468588 - DNA, 1466 bp, Homo sapiens
cctgcacgtcccgcacatgactgggaaagaataggggctgttcaggccctgtagggctgtatgtcaaagccagcccataatgcctgtcagccaagggcagaaattcccactgatataagaatgtgcaagaaatcaactttcaccaccgacgagcagattaagacacgatcaggaaatgagactaccggcccaggtttgaatctcagctctgataatgcttatgtctctcagaccttgggaaactttgggaaagtccctctcactaagccttggttgtgttattctttctcccaaccctgccccagccacacagagatcaaggatggtggctacggttactctggtattgctaagtactctttgaaagttaaaatggtccaaaaggtttctacagaagggagcagagatctaccgttcctggcaatcttcctagaatgggtaaggaggaggtggaatgtggagacgtaaggagagactttcctaaaattctaagatagacttaatgtcccattgatcaagattggatctcatgtccatggtcttgctaaaaggaaagtacaattgcccaacatttttagcctccactgaaggagatggactctgttgtgtaagaataaaaatgggatagttgtggagttgaattcaaatgtcacattatccatgtctccttcccaatttccttgatctgagtgaatttctctttctgttgaacccacaatgattcattcacaccttattttttaaggctttgcattctattgaagatgagtctgcattgtctgtaagattatgaatttcttgaggataggaactgactttatgcatctctgtgttcccccaaaattattaccacttcctgacacataatctgtacttaataaatgtttattaagtaaatgaaaggacaaataaaatataaattagtatatgccttattttcagaactacaccaatagtataaaaggagcaacagactaggagttagtaaatcttgattttacattgaaattattcattgtagcactatctataatataaaaggtctgtaaaacctccaagtaagttaatcaaaacaggactagttgaataaactatagtagatccattcaatggaatactacacactgtaaaaaaaaaaaaaggaaggaagatatatcgttaagtgaaaagaacaagttagaggaaagtttgtataatgaaaatatgactgagttaatgaattataggcctgaacccaaacaaaacaaaacaacaatgattaactctaggaggtgaggagaaaattgtggagatttaaaaaataatgaatgacaggaaattggtttgggaagggagagaaaaacagatgcataattatttctttcattatgaatgtacattcctgacatctctgagggctaagattgtcctgcagggaatatgattaaagttacaaaagacgaaaacaaaataaataagtcagcttt

SEQ ID NO: 468589 - DNA, 706 bp, Homo sapiens
ctctctctctctctctctctctctctttctctctctcagagaaaacatatagatagtcctgagctgttgtaacaggaggcaacacctgtcccctgtaagcctcagatctgctgcgatggcagggtgaacatgacccagagctcaggactcctgggcagtgcctggatcaacttgaagccaggatggggactgacctggtcaagctctccaggggttgagtgggcatcctgtccactcttcaaagaaaaagctgaaatggttgatggaaagaacagcagtagagcactgattggtgcattttacaatcctcttgcgagcttcagagcactgattggtgcatttttacagagcactgatggtgcattttacaatcctctttctagctacggagtgccgattggtgcattttacaatcctagctacagagtgctgattggtgcattttactatcctcttgtaagacagagaagttctccaagtcccaacttgatccaggcccatcaaagggtcagcgggttggtccaggggtccttggtagaagttgtgagttgagctcatttggggttccatttgtaagaccatctgtagcttgatggcctcgatcctggaggaaacaaatttgacaaggaggttaaaaatacagggcctgaaggtaagtaatagcaagatggctgtcacgggacatagaaaggggagaagtcatgtc

SEQ ID NO: 468590 - DNA, 556 bp, Homo sapiens
aaccactacactatcctggaacacagtgaacaggcattccaaatgcctggagatctatctgaacatggggctgagaggaccccactgcaccatgatctctctgcaggaagggtagggcagctcaggctgccaatcaaggtgagcaggtgtctgaaaatttgcctgattgtggagcagagaggacctggtgcaccagcctctgcacagaatagtgggatgggtcaggccttggaaccaggcaagtgtgtgcttcaactgcctggagatctgcctagtcatgaagcagagacggtccccttgcacccaaattgctgcataggaagggtggggcagctcaagctgctgatccaggtaagtgtgtgctccaaatgtctggagatctgcctgggtgtaaaccagagagggccccattacacctggatctctgcacaggaaggatgggatggctcaagctaccaatctgggtaagaaaatattccaaatgcctagagagttgggcctaaatcaaagaaaataagcgatgctcaagctgaatcttgaaaaggggataggtatc

SEQ ID NO: 468591 - DNA, 715 bp, Homo sapiens
taagaattcccctattaggaaagggactaagacccctccaggatgaaggatctatgtaccagggacccacagttactgacatgtggcttctgcgggttggtttcacatctgggtcctgaacctgtgctgagaaatgaggcggtaaagtcactcacacccacattccaattgtggcccacaagggaggaaattgagagcccaatcatagagaaggaacagaaccagcacatagatagagtcaaagagacagaagtaacagtagcagctagcctgggtatactacggcaagcccaatcacacaagcactcttcatgcctaaaactcaatggtcaaagcaagtcacagggcctgtcaaactggagaggctttccaagcttccgtagcaatgtgtgtagatacagtaagaggattggagttgttaattataatcaatttaccacaagtaactatatggcaatatatagttaataatatatagactcaaatattggttcatagatcttcactgacatttgttgaagatgatagaataaggacagtttaatatcagatttgggctctgtcacttactttggtgatatttaacctctccattcttcaactattgcttctgtaaaaaaagaatgtattctctttctcatagggttaaagtcaaggttaaatgagttaatgaaagcaaaatgcttagaacagtgcctgacacttggtaagcact

SEQ ID NO: 468592 - DNA, 2069 bp, Homo sapiens
ccagaaactcaatttttcacagccaggccagtatttgtggagagtttatagcctctcctcccctccccccggcttcctttctctctctctctctctctctctctctctctctctctctctctctctctctctctctctctctctctctctctctctctctctctctctctctctcactttctggctaaacacatgccggagagctcctcatccccttccgccatgggacgatacctagagaaaaaggctgtcttgagtttcaccaaacgaggatttccaaaatgtaacgaggaaagggtaatttctcgatggaagaatgcacacacaataaaagctggtatcaaatgtgaattaggtctactcaaactggctgataaaaacatcaaagatgaaagtcaggaccctcagctgcaggtctgttggagtttgctggaggtccactccagaccctgttttgcctgggtatcagcagcggaggctgcagaagagcggatattggtgaacagcaaatgttgctgcctgatcattcatctggaagttttgtctcagaggagtacccggccgtgttcatactctaaacacttcgtgtatccaggatctcacaatgcaaggtcactgtgcgccagccaaatctccctggagccaggcaccagacaactagaaacagcaggagactgcaaaattgttctaactatccaaactaccgggagtctgtgaaacctagctaagcccattccaattgccatatataaggtgtcctctatgtctctgggttggttcatttgtttatgtttgcatgccatttaaaaatttcccttatcattgttgattctgtttatgtatttgattgtgtaaaacttcagcgtaatttcaacagtcagagctaagcattcgtaaggtgtgttgaactaaagtgatttcctgggctactgccaccatttctatctctgctgatgattggaattcaacctataaaaacaataacgttattcaattatattttatttttaaatacctgataccgttaggtagttagtctacatattgctatcatactaacagcaaagcagacatgatttatatttttatatatctcacatgatagtgaggagcttaaggaatattaatttataaaaatgaattaaaattcaagtgctctaaaatgttaaggcattgttgaattattgttactgatttttactgcatacttttctcatgacatatgttagaaatgtggctaaaatgcctcttataaagtttgttcatgaagttatcacttttgattttacactactgtttgtcaattttgcctcttcattctgattattgtaaatcccctgatcctcctttaaaatatgtaaaaatatgcaatgctaacctaaacaagaacatgatgagtcaggacatacaatagctcattgattattttaagcagttgctgtgtaatatattttaaaaattaatagtacctaccaccacatgctaagccagctgccctacaccaacaaagatcaagttaatacaatttggtaaaatgattaaactgctaaaatatacaaggacagtattactaaactgttattcagctggcattaaaagagctgcagctcttttcaatgttctggcattgaaactttctggcagtcagtgattgtaaatcattccaagtgcttaagcgttcctttcactaacagaggaatacgtatgaggggatcttttacattttccttccctttttctacttttttaaggtcaatacctcttcttagaatcttttcatggtagctttcttcttcttgtaaccttgccacctaaggctagcttagaagcctttctctgtcccttcgtttaccctgtgcttttaataattataagacatgctgtatgtactgaaattgtttagttgtcagtctttatctctaaaatatgaattcattgagggtagcaaatacatattttttcaattttgattattcattaataataaatttgagatgttgttcaataaaagtcattgtaagatttggagaatggggattgagatagaaacagattattagtaaaagtat

SEQ ID NO: 468593 - DNA, 895 bp, Homo sapiens
tgagagtggagaaatgagggcgaatatgaagagtttaatgacgcattcactgagtgaggaggtcctcaaatccatctcccagaggaattctggatgggagtttttaaaaagattgtagagagtgaacagctggagaatgggagtcatttcttggtccgggcagaggagcctcaccctggagccactgccaccccagtgcatgaggagtactgtcagagtaccaacgaatttttccttgtggcccaagggcttttatgtcagcttgtggtgaatgctgcctggcctgggcctcagccttcaggacagtgggctgtcttctggctaacagcaggtccagaaatgctggacaagagtctagtcctggaattggggaccccaagagctgacttggtgctctgctctgatgtggcccagatgatatctgaagccagcacatctagagactcacccaaggccctcagtggccaaagggctcttcagttaacaggtgatgaatgctgtcaggactgggtcctttccttaaaggcagcagtttcccttctggcccaggatgtgtctagaaatgtcatctgggagttaggccctggaacgggagcctcatgcctctgcctcatgccctatcctgctatggctgatctgatatccaggatgcaagtcaaagtcctccccactcttccattccctctcctttgttagaaggaaggggtctattttggatccataagctgtgcagcctgggtttaaggaactggtgctgcgagtactcccttggttgtcccagcttatgtctcagtatgtcacatgtccccctcatactccctagtctactgtctttgggcctggctcagctctaggactgtattagtctgttcttacactgctaataaagacatac

SEQ ID NO: 468594 - DNA, 995 bp, Homo sapiens
tttcctggaaaagacatccaaaatgaagaaaatgaggaaagtacaaggtttaataattggtgtaggaagaggaaagatcatgtatgaatgcatatcagggggccagaataaatgtgacttatgtgaaagcaaactgaaaactaagatttctatgcaatcagtggataatgaatatgattatgacaacaacaatgataaaagctgtcttgagttagcagaggctttgactagcgcagggagtggagaaactaaaatcaagtttggaaccaggaaaggagcaagtattgagtcagcaacattggcaaagagtaatggtgaagaaagtgctagtgttgggaacaggaaggttagtgaggaagacttaagattggcgttctatcttaagatgacaatattcataaggaaatacaaaaatatatgtaatgtcattccttaaaatatttaagagtcaaagcactaaaattaggtacaatgaacgctgaccgtgtaaagaggattaattttatattttccacatggggaaatctgtttcataagcttttcaaaagctccagtttttctaacatttcaaagacaaaagaattccacattttatctattttttttttcatttctgcttgcaagctgataaagtctttcctgaactcacatctgtctcttcattcattgttataaactgcccggaataatcaacaaactgtagcattctagttctttttaagttcttctcatagagatatgggttcagtaggtatataatctactttcccagttaatgcaggaggtattattactaaatatttttccattgtgtgcacaagtcttcaactttctagtttttgatacaattttcctagctgtttttcagtcaatcaactaagccagtagcaggtagtttacctaatgttacagcagcacaccctttagataaaactaacagatgtaattattattaattaaattttctgtttttgcacatagcttatttttttgcc

SEQ ID NO: 468595 - DNA, 608 bp, Homo sapiens
tcatcagttaaggcaggaatcggccatctagatgttctataatggacatatttaaacacaagcataaagagagaaagaagaaagagagaaagtttcaaattaaagaagtatcaaaagatatatcaaggttaacaggtaggctagccatcagccccgagatgcctgtgaggcttgaaaagaagcagcaatggagtcaatttgcccttatttccccaggcatttatgttttggtaaaaggactggctttagggaagatggacaatttaaagacagagaaggatgaggatagggtgaaaaagtcagttttctggaagtccagcctgcctctgaaaggaggaggcctgtgtctgccatggaaggcagtggtttttggaagaaagaggctggttggtgtgggagttgtgggctgcaaggctgtgctggtttggtggagggcagggaaggcccaagatgcaatgatggatgaaaggtgcatttgctatggcagggatcctatggatttccatacaagggagtggctaggtgtctttgaacagaatattttaacggcaggacccatttttaacaaaagaagtcaaaattatatatataatatatacatatgagct

SEQ ID NO: 468596 - DNA, 474 bp, Homo sapiens
agccaacatatgggcttagtgaataagtctgatgaagcttccatagggatatcaaaaagccacgaatttaacagaaatgcaacttctatgtttggcttagtgctattcctatgccagaaaaaatacataagaaatctagagattagatgccaagatccccagcacaaaatttgtatatttttagtatcatacagaattaaaactccaggaactataactttatgtagctcatcccttaagtcatatcaaacactgcaagcttcccttggggatgatggcataatcttgggtgaagcattcaccttcagtcgagggcaattcctagagagcgatgcagctggtggccctcagctgacaatggcatctggaggaatgaccatcgactgatggaaacttagattaatttcatgtctttgctattggaccacacagccttgatcattgtatatttatagaatttgcattagtcagggt

SEQ ID NO: 468597 - DNA, 814 bp, Homo sapiens
ggtctcatgcaccatgacagccgcgcatggtgagacgagggtgaaatttgtcttggaaattcccactctgctcttccccggcagtatcagcagtcgcttagatctagaaaccataagaaatgctttcaccaaagaggagaaacctgaaggtctgggtccagagcctcagatcttacactggcagcacacggggacacagcagctggactggcagcagcagggcttgaagcagctagactggcagcagctggattggcagcagcagggcttgcagcagctggactggcagcagctggattggcagcagcagggtttggagcagctggactggcagcagaatgacccacagcctgaggaggagcagcagggcttacagcagttggactgggagcagccacaagaaccacacccacccttggagctcccacaagagccacagccccctttggagcccccacaggagccacagctggagcaggaacaggctggcacacagcagcacacaggcttgcagcagcaaatgggcacacagcagctggagccacagcccccacagccagagccacagcccccactgccggagccacagcccccacagccagagccacagcctccagaacagccacagcagcccatgattctggcggattgagagtagagcaggtagaggagcaggtgagagggaggtgcaggtgtggagccccctgagcctgggctctttatatacctgtccagaggtcagggaggacgcagggtcctttccttgtgactgtttacactatttttccagagctctatttttttcctctttgct

SEQ ID NO: 468598 - DNA, 1131 bp, Homo sapiens
taatatcttcctagggtgtccaagacacacagagccacggaatctcacaggtgtctgagaattcctcctccttggactcccagaggatccagaactgcagccggttctcgctttgctctccctgtccctgtccatgtatctggtcacggtgctgaggaacctgctcatcatcctggctgtcagctctgtctctcccctccacacccccatgtacttcttcctctccaacctgtgctgggctgacatcggtttcacctcggccacggttcccaagatgattgtggacatgcagtcgcatagcagagccatctctcatgcgggctgtctgacgcagatgtctttcttgttcctttttgcatgtatagaaggcatgctcctgactgtgatggcctatgactgctttgtagccatctgtcgccctctgcactacccagtcatcgtgaatcctcacttctgtgtcttcttcgttttggtgtcctttttccttagcctgttggattcccagctgcacagttggattgtgttacaattcaccatcttcaagaatgtggaaatctctaattttgtctgtgacccctctcaacttctcaaacttgcctgttctgacggcttggacctatggcggcggcagctgtcactgggcctagcccaggatgtggacctggggactccccagaagggcaggagcgggaggctcacggagcgtcggcggaaggcacacaggatgctaaagctttacaaaggcctctcggaaggggaggcgttgggactccctgcggggcccgaccccctggaccccactgatctgaacggggcgcacttcgacccggaagtttacctggacaagctgcctagagagtgccctctggcccagctgatcgacagtgagacggacatggtgcagcagatccgggctctagacagcgacatgcaaaccctggtctatgagaactacgataagttcatcccagccaccgaaattgacaaacagcataaaactgtatgaggaattgcaggaaacccagaatttcccatataaccttgtaaaagaagaacaaagttggaagactcacaaaaaaatgtatatacatatatatatatatacatatatatatataaagttgtattttc

SEQ ID NO: 468599 - DNA, 2167 bp, Homo sapiens
gtccaggtcctgagcccccttgccctggatggttcagtctctcctgtctccagacaagagcagttgcaggcaggaagccggcagtgcctctaaggcctcctccctgtccttctggagacctggcatgaacactcccttccacctggtgcaggtggcacctcatagcactgtaccaatgtacccctgtccccactcccaggctgcacgtctgcaccccagtgaacagacaggtttgaatccctgttcatgccgagctgcctgacttctggtccagccccggctcccagcaccttgctctggcccagcccctgtcattagcctgactttgcttttgagtctgcctggtggacttggtctctgcaccaagatcctggggaccgcctgggacttggctgtgcatcctgaccacggtgtatgaggaactgcccaggacgcgggctctgaaccccatcttgtgagcaggcgtcctctgcaggccctgcttgcctgtacacctggctgtgggagctgggctcccacatcctgggaggaccaggcagacgcttgattcagtgcaaatcctggggccgcctccaacctcatgctaagtgtctccaccctactcctcttcccacatattgcaaacctgcccaagccacaggacaaaagggctcccatcttttcagggctcattgccttgagggtgcttgggcaggaatcaggcctgatgggcaccctgggcactggccatagaggccacagctgtagccccagccacagcggcaggctctggctgtatgatgtgcacaagttacagaagctccctgagtttctggggttggtgggagcattgcaggactgccagtgcagggaggtctccagccttcaaaagagagtgtgtgcacaacgtcctctcagagccaggcacagggtgcacggtggtgaaattgcaccaggacatgccaagcccatctttagttcagaattcctcctcatctgtaggggaccatccatcatccacattgcacagttctgagaatgagcaccagtgccatcaataattccaccagggcaacaggtgtaaaacagggattgtcctagcaagccggaccatatggctgccgcccttatctgtgcaatcggctgatttgcagggataatgagatattcgatgagaaaggttttgtgacttagagcagcaccagaatcagtgccaagccatttttgtagctcacttatttgtcccacaggcagtgtcctctggcgatgtgctttgctgtttgagctctgaaaggtggtgctggagaggcttatagagaggggtaccccatggcttgtgagcccacccagggcccaggcttgcccagaggcagcacggaaaatggaaagaacaggggctttggggctggacccgtccaggttccctttagtttcccaccccacggcttcatagctgagcacagatattggttgttggtgctgtgtttctccaggacctgcctccttaggtcttggtaaggataatctgcccttctaagacacactctaaaagcactggtcccttctgctttccagcctccctggaagctgggcatgggaatgtggattgactcagccaatcagatgagcctgccctgagtcatttgtccaatcaggtgtcctttccctgaaagtcttgcccaatcagatgcacctgtcctaaacagggacagtcagatgcagccactgtaaattgtgtccaatcagatgtctgccctgaactgtggatcggaagatgtctgccctgaactgtggatcggaaccatgggaaaaggaggctgagactgggagaggccagtgtgacctggtggcccgtgtctggggccggcagggcatatgtccacgcacacctcctgtcaccagttccgcagcgttttcccttccttctggccatgtttgtgctgccctttatttttctaatacatttctgttctgcttatgcaagacagaacctgtttttctcttgcttacaactaaagaaccctggctaatgtgctgcatgagctagagcagttcttgccattctctgagccttacacagttatcttcacaatggaacaaggatccctaccctgcagggttttttaaagatgaaggagcatgctttctgcatagcaccgcatccagccacgtagccctggagcagctg

SEQ ID NO: 468600 - DNA, 1085 bp, Homo sapiens
ccacttgtgggtgtaatcaggcaccccctaatgattaatgacatgtcccaagaggatatgctccagagcaccctcctgggtggggaaacaggggatcaagcggcatttgcagggaaggactggggagtggagctgctgggccgtgtggagtcgtgtgtccctcagtggaggagggacaaaccatgttccagagagtggctgcgcgttggacctcctctccagcgtcggatgagggctccacttgctccactcccttgcctgcttctgttcccatctctcttcttggttatcttcatcctggagggtgggggaggcgctgtctcattgtggttcgaaagatttgatttgagcatcagcaatgtgcccaaggtggtgatgttacttggtgctgcccctgctgagactgtggtggacaccgaggctcagagagagcgtgggccctgctgcggctccaggcccttaagccccctggacttacctgggtggcagcagcagtcctgcaccctgcaacgctgtagaaatgggcacagtgtctttcggttcctgctcctcttcctttgcctccacctggggtccctgctcctctccctgtgcctccccctggggtccctgctcctctccctgtgcctccgcctggggtccctgctcctctccctgtgcctccgcctggggtccctgctcctctccctgtgcctccgcctggggtccctgctcctcttcctgtgcctccacctgctgttccgacctggttacccagtgagggaatggggaagaaacctctcctaccatagcaaggattcctggtggcaacaacgtcctagagctttgcaaagctctcggtctttgacgttgacgaagtcgattcatggaaactgctggaaccctttgacgacttggattgactgtattcatccagggaacaagattgtgttcagcatgctcatttctataaatccttccatctcggccaaagatggtctaatcatcttagagcaatgacagccctttctcgtggaatgggcacgtttgctctgttcactgcagcccctggaaacagccacatgatgcacatggatgctaactgg

SEQ ID NO: 468601 - DNA, 663 bp, Homo sapiens
ggctccgtcaccaacatggggtactgctctggggcgacgtggagcacctgcacgggcatccacgacctccccgagccctgtgagctatttcagaaatggccactaagaggttttagcaaagtacctgcaagatgtgatggcctcgatgacgttgatagtgatgatgatgacaatgataatgatgactatgacaatgattatgatgacaataatgacaatgacaatgacgatgacaatgatgactgtgacaatgatgatgatggctgtgacaatgattatgacaatgatgatgactatgacaatgatgatgactatgacaatggcgatgacgatgacataatgatgacaatcatgatgatgactacgacaatgatgacgacattgacagtgatgacaataatgatcaatgacaatgatgatgaaaatgataacaatgacaattatgatgatgactatgatgatgatggcaatgatgacattgatgatgatgataatgacaatgatgatgatgacaatgatgacattgatgatgatgatgacagtgacaatgatgatgacaatgataatgacaataatgataacaatgacagtgatgacaatgatgatgatggattgtcttgatatgcaaggcatttcccccacgtaaatcagcaaatacccaat

SEQ ID NO: 468602 - DNA, 748 bp, Homo sapiens
actctaccacatgctcatgtgcacaggcaggtgtgctcaaacgatggtcagcagcttcactcaaggaggaagagtgaggccaaccctggctacagagaccagttataaggactgtgatgatgatgatgatggtgataatgaaggcgatgacaatatcagcagcatcagtagtatcctctcccacttattgatggtgccaaactggtggaagtggatcctcataaagttcttcatccttgtcatcttcatgctgagtggtgtgatggttaatactgagtgtcaacttgattggattgaaggatgcaaagtattgatcctgggacatcctgagtcacatcacggccagttggctctggctgtcatttggtacaaaagtcagcagggtgatggggtgactgggctatttgtggaaattctcacccaccagcagtctggccctagagcaacaggagagagcaggccctgtgcagaagcacttttccagcctctgcttgtgtcacgtttgctacttgcattatccaaagcaagtcacgtggccaagttcaaattcaaaggtgtggagactgaggactctaaagctacaatgaagagcagcatgcattcagagacagaaggagtatggcccctttgcacactaccacatggatttcaggctaggctggatccagggactcagtgatgtcttttgggcttggtttcctcccccttggctctgcttctttcttggtcagatccactctcaggccag

SEQ ID NO: 468603 - DNA, 602 bp, Homo sapiens
cagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatacaaataataaatctattctgctaagagatcacacatgg

SEQ ID NO: 468604 - DNA, 615 bp, Homo sapiens
cagcagttccacacactcgcttctggaacgtctgagattatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatacaaataataaatctattctgctgagagatcacacatgattttcttcagctc

SEQ ID NO: 468605 - DNA, 1022 bp, Homo sapiens
acccctgtcacacatcctgtgagagggggcttagggaactcccatttgtttcaaggggatctatggctattcgttcaggaaacaccatcatcgtgactgcaatctggatggattccactcggcatgagcccatgtattgctttctgtgtgttctggctgctgtggacattgttatggcctcctcggtggtacccaagatggtgagcatcttctgctcaggagacagctcaatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccatcaccatcagagctatcatagccataactccactgagttggatggtgagtcatctacctttctgtggctccaatgtggttgtccactcctactgtgagcacatagctttggccaggttagcatgtgctgaccccgtgcccagcagtctctacagtctgattggttcctctcttatggtgggctctgatgtggccttcattgctgcctcctatatcttaattctcaaggcagtatttggtctctcctcaaagactgctcagttgaaagcattaagcacatgtggctcccatgtgggggttatggctttgtactatctacctgggatggcatccatctatgcggcctggttggggcaggatgtagtgcccttgcacacccaagtcctgctagctgacctgtacgtgatcatcccagccaccttaaatcccatcatctatggcatgaggaccaaacaactgcgggagagaatatggagttatctgatgcatgtcctctttgaccattccaacctgggttcatgaacacaatatctgttcagatccagccaatttcaaagatgccttagagatctgcagagcttagtttacctggtgctacaggaattcattctaagatgaaggtgt

SEQ ID NO: 468606 - DNA, 1157 bp, Homo sapiens
gtccctacacgtctggctctccatcccctttggctccatgtacctggtggctgtggtggggaatgtgaccatcctggctgtggtaaagatagaacgcagcctgcaccagcccatgtactttttcttgtgcatgttggctgccattgacctggttctgtctacttccactatacccaaacttctgggaatcttctggttcggtgcttgtgacattggcctggacgcctgcttgggccaaatgttccttatccactgctttgccactgttgagtcaggcatcttccttgccatggcttttgatcgctacgtggccatctgcaacccactacgtcatagcatggtgctcacttatacagtggtgggtcgtttggggcttgtttctctcctccggggtgttctctacattggacctctgcctctgatgatccgcctgcggctgcccctttataaaacccatgttatctcccactcctactgtgagcacatggctgtagttgccttgacatgtggcgacagcagggtcaataatgtctatgggctgagcatcggctttctggtgttgatcctggactcagtggctattgctgcatcctatgtgatgattttcagggccgtgatggggttagccactcctgaggctaggcttaaaaccctggggacatgcgcttctcacctctgtgccatcctgatcttttatgttcccattgctgtttcttccctgattcaccgatttggtcagtgtgtgcctcctccagtccacactctgctggccaacttctatctcctcattcctccaatcctcaatcccattgtctatgctgttcgcaccaagcagatccgagagagccttctccaaataccaaggatagaaatgaagattagatgattactattttcttctctctcaaataagctcatggagaaggtgtttaaatatggtaggctgcttcccattaggaactttacaagcagtttgaagtattaggcactgtgctctccaacttttgtagttccaaaggaattctaagaaagtatacaactctaagtcctaaaaggtggaaaatacaaaacttacaactaaaggatatttgagctacaaagaaggcttgatgcatatgaggactctgtggaaataagtcttccctttcccacagaaa

SEQ ID NO: 468607 - DNA, 1113 bp, Homo sapiens
tcatttctggcccaaatgagcgctttttcagaaggtgaaggagcctatgaagatcaacaaggagaatttccaagagtcatgtcagcctccagtatcacctcaacacatccaacttccttcttgttgatggggattccaggcctggagcacctgcacatctggatctccatccccttctcagcatatacactggccctgcttggaaactgcaccctccttctcatcatccaggctgatgcagccctccatgagcccatatacctctttctggccatgttggcagccatcgacctggtcctttcctcctcagcattgcccaaaatgcttgccatattctggttcagggatcgggagatcaacttttttgcctgtctggtccagatgttcttccttcactccttctccatcatggagtcagcagtgctgctggccatggcctttgaccgctatgtggccatctgcaagccactgcactacaccacggtcctgactgggtccctcatcaccaagattggcatggctgctgtggcccgggctgtgacactaatgactccactccccttcctgctgagatgtttccactactgccgaggcccagtgattgcccgctgctactgtgaacacatggctgtggcagttctacaactctcctctcaggaggcccgctacaaagcatttgggacatgtgtctctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctacggcgttaagaccaagcagatccgtgacagtcttgggagtattcccgagaaaggatgtgtgaatagagaaaagatggccatgtacaagccaagaagagtggcctcggtagcaaccaattctgcttgggtcttggacttctatcttctagaattgtgaagaaataaatttctgtttattaggccccccagtttgtattaccttttatagaagccctagaaaactacttttggcaccagaaagtaaggtgctactgtaactaatacctaaaaatgt

SEQ ID NO: 468608 - DNA, 1478 bp, Homo sapiens
gcctgccacatagataacggcactgattgaatactctgtaggtatggagtccccatgcacttttaggggagacaaagtcttccttttgttgtttgctgacatcttggctgtgaaggcaggaaacaaacaaaagacgacgacatgtaaggaccggacaaagcactcataccaaacaggttcaagggtgttgggcagaagaccagataagcagagtcagatggtgaatggaattagaggagccatgtcagcctccaatatcaccttaacacatccaactgccttcttgttggtggggattccaggcctggaacacctgcacatctggatctccatccctttctgcttagcatatacactggccctgcttggaaactgcactctccttctcatcatccaggctgatgcagccctccatgaacccatgtacctctttctggccatgttggcagccatcgacctggtcctttcctcctcagcactgcccaaaatgcttgccatattctggttcagggatcgggagataaacttctttgcctgtctggcccagatgttcttccttcactccttctccatcatggagtcagcagtgctgctggccatggcctttgaccgctatgtggctatctgcaagccactgcactacaccaaggtcctgactgggtccctcatcaccaagattggcatggctgctgtggcccgggctgtgacactaatgactccactccccttcctgctgagatgtttccactactgccgaggcccagtgatcgctcactgctactgtgaacacatggctgtggtgaggctggcgtgtggggacactagcttcaacaatatctatggcatcgctgtggccatgtttattgtggtgttggacctgctccttgttatcctgtcttatatctttattcttcaggcagttctactgcttgcctctcaggaggcccactacaaggcatttgggacatgtgtctctcatataggtgccatcttagccttctacacaactgtggtcatctcttcagtcatgcaccgtgtagcccgccatgctgcccctcatgtccacatcctccttgccaatttctatctgctcttcccacccatggtcaatcccataatctatggtgtcaagaccaagcaaatccgtgagagcatcttgggagtattcccaagaaaggatatgactcatgggtctgtgtcctctggtagcctgtggattgaatgtgctgactgtgctgtcttctcacagtgccctcacccctatcagtaacttgacagagacttgacccatgggtctccaggtgacttcaccgaaagacacaaagatgcttccaacttcatttgctgaagagaagactttgaaaatctgagtttcttttcttagtcattgggaatttggtgaactatctactcaggacctgggaccacttgttattctcctagttttgcacctttttggttcaggtcttctaaattct

SEQ ID NO: 468609 - DNA, 750 bp, Homo sapiens
tcgtctcctcggctccgagtccctgcagcagctgaggtgcctgtgtctctctggttcccagtggccgccatcatgctctcctccacactcagggtggctgtggtgtgcgtgagcaatgtcaacaggagcatggaggcccacagcatcctcaggagaaaagggctaagtgtccggtcttttggaactgaatctcatgtgaggctaccaggaccaagacccaatcgtcctgtagtttacgattttgcaacaacatataaggagatgtacaatgacctcctcaggaaagatagagaacgctacacccgcaacggaatcttacacatcttgggaagaaatgagagaatcaagcccggtccagaaagatttcaggagtgcactgattcctttgatgtcatcttcacctgtgaggagagtgtctatgacacagtggtggaagatctgtgttccagagaacagcagacctttcagcctgtgcacgtgatcaacatggaaatccaagataccctggaagatgccaccctgggagctttcctcatctgtgagatttgccagtgcctgcagcagtcagacgacatggaagacaatctggaagagctgctgttgcaaatggaggagaaggcaggaaaaagctttcttcacaccgtctgcttctactgaacatctgggctggctttgtccccttcctcagtaagaacttaggcatgggactttattggataattctgctgatagaccttatggttaattttt

SEQ ID NO: 468610 - DNA, 669 bp, Homo sapiens
agaagattggacgtgggaaacatacccatggtcagagtcatcaagaacctcaccactagatcaaaatctgaaacagcactggcaaatctcacagatgaggaaagctcccagggtggcatcttccagggtatcttggatgtccatgttgatcacgtgcacaggctgaaaggtctgctgttctctggaacacagatcttccaccactgtgtcatagacactctcctcacaggtgaagatgacatcaaaggaatcagtgcactcctgaaatctttctggaccgggcttgattctctcatttcttcccaagatgtaaattcacaaaatttttcaccaatacaaaaaaaatcccattctcaaaaacatatctgcttatggtattttaagagttattctacacaacattttctgcatttgatattactggaatcataatgattctccagagaaggcagcaattgctgcaagcctctgcctactttaatatgccttcagagttcaaaatttgtactgacagatgcctcagtgtttcttttttctcatcactctagtccagtatttctccattgttttaatcaacccccacttaaggagacttctcagacatttttccctaatcgcttccccataaaattttaatagcatagatatattgtgtatttgtttatgtac

SEQ ID NO: 468611 - DNA, 963 bp, Homo sapiens
tcgtctcctcggctccgagtccctgcagcagctgaggtgcctgtgtctctctggttcccagtggccgccatcatgctctcctccacactcagggtggctgtggtgtgcgtgagcaatgtcaacaggagcatggaggcccacagcatcctcaggagaaaagggctaagtgtccggtcttttggaactgaatctcatgtgaggctaccaggaccaagacccaatcgtcctgtagtttacgattttgcaacaacatataaggagatgtacaatgacctcctcaggaaagatagagaacgctacacccgcaacggaatcttacacatcttgggaagaaatgagagaatcaagcccggtccagaaagatttcaggagtgcactgatttctttgatgtcatcttcacctgtgaggagagtgtctatgacacagtggtggaagatctgtgttccagagaacagcagacctttcagcctgtgcacgtgatcaacatggacatccaagataccctggaagatgccaccctgggagctttcctcatctgtgagatttgccagtgcctgcagcagtcagacgacatggaagacaatctggaagagctgctgttgcaaatggaggagaaggcaggaaaaagctttcttcacacctccggatttattgtgagaagcatctgcaaagaccttccactgagtactgtttgtgtgacttttgtacacatcacctggaaagagactattaccaagaaaatattttatgggaaatgagaaggactaacatttttaaaagcactgaaaaatggttggcattgtgctaggtgcattacatggcataactaatttcatgcttatatcattctacaagaaagctagcccaccatgacgccattttccagatgagcaaaccgagctgataatggactgctggaaaaatgatttgtttaagggtattcagcagataaataacattgt

SEQ ID NO: 468612 - DNA, 513 bp, Homo sapiens
agaagattggacgtgggaaggctgtttgaccatgcattgtgccacaacccatggattccagcccaatccctacttattcaccctttctggtccaaaaccaggtttcatcgtttatcactataattacaccctttcaaactcctgaagcatttctgcaccttgctcttctgtcacatttgcattgtccatgtccaaacagacagaaaagagaaactcaaccaccttgtcatgtttttccaaatggattggctggaaaaagtagtatctatgggacagtctcacttttatcttcagaagagctctcacaaaaaactacactcaggtttgtattcccatattttaaaacaattatctatgccaaatatcctcaccccatccccaatcatgatcctgactgcccactgccagctgatggccttatcttaagccacattgacagaatagagataaactgtcagtgaggaaacaccacactgccctaccaccaaaactttcacttatatatttggacca

SEQ ID NO: 468613 - DNA, 727 bp, Homo sapiens
cttcagttgcttcaggccctctggatgtatacatgcagctcgtttggaagacctgggtataggtggtcgtctcctcggctccgagaccctgcagcagctgaggtgcctgtgtctctctggttcccagtggccgccatcatgctctcctccacactcagggtggctgtggtgtgcgtgagcaatgtcaacaggagcatggaggcccacagcatcctcaggagaaaagggctaagtgtccggtcttttggaactgaatctcatgtgaggctaccaggaccaagacccaatcgtcctgtagtttatgattttgcaacaacatataaggagatgtacaatgacctcctcaggaaagatagagaacgctacacccgcaacggaatcttacacatcttgggaagaaatgagagaatcaagcccggtccagaaagatttcaggagtgcactgattcctttgatgtcatcttcacctgtgaggagagtgtctatgacacagtggtggaagatctgtgttccagagaacagcagacctttcagcctgtgcacgtgatcaacatggaaatccaagataccctggaagatgccaccctgggagctttcctcatctgtgagatttcagacctttcagcctgtgcacgtgatcaacatggacatccaagataccctggaagatgccaccctgggagctttcctcatctgtgagatttgccagtgcctgcagcagtcagac

SEQ ID NO: 468614 - DNA, 1485 bp, Homo sapiens
accagcactgtgacagctggcagatggggcactgagagccggaggaggaggaaacgctaaattttttttaaaaactcttctcactgaaaaccttatgtccatcgcggagctgtctgcggtggcggcggcgcctctggtctcccgcggcccggagcccgcagcaccgcctctccctccctgccgcagccccgcagcccagcagcgccccagacacacgccgtcgggcaggagccgctcgctctccggaaagtgacaacagaattcatcgaagtgaagaatttcttaagaagataacaaaaagagaaagaaaatgccggaaccaatcaacgtaacagtaactacaatggatgctgagctggaaatttgccattcagcccaaaacaactggcaaacaactttttgaccatgtggtgaaaatagttggtttgcgcgaggtctggtttttggggctgcagtatgtagacagcagaggttattctacatggcttcaactaaataaaaaggtgacgcagcaagatgttaaaaaagagaaggatcctttacagttcaagtttagagctaaattctttcctgaagatgtttctgaggaattaattcaagaaataacccagagactcttcttcttgcaagttaaagaagccatcttaaaggatgagatatattgtccgacagaaactgcagttcttctggcttcctatgctgttcaagccaagtatggagattataacaaagaaattcataacccaggctacctggctaatgatagactcctaccccaaccaaaagaagcagcagagtggcttgaaaaggagcgtcgagctgctgaagaggcgaagtctgccatagcaaaacaagctgccgaccagaagaatcaggagcagctagcagcaaaacttgctcaattcactgccaagattgtacttctagaagaagccaagaagaaaaaggaagaggaagctactgagtggcaacacaaagcttttgcagcccagaagacttggaaaagaccaaagaagaaaaacgaacatgatgaacatgatgagattaatgctaaggctggtgctgaattatcaaatgaaggggtaatgaaccatagaagcaaagaagaacatgtaacagaaacacagaaaaatgagcgtgttaagaagctacttcaggccttaagttcagaattagcccaagccagagatgaaagcaaggaaacacaaaaggatgttcttcaggctaagaatgttaaaacaggccatggtttgtattgtgccgtctacaagtggcataaacacaggaacccctttccctgttcctggcctgtggacctttctgtgaggcatggggtagcaggagagaacaacaatgacaacgccctttcaggctccctcttctcatgaacagctccctctacagcacagagaacagtctctccaggcctctctggaaagcagcattttaaattgcctcacaccagctcctgtctagagtccagcc

SEQ ID NO: 468615 - DNA, 795 bp, Homo sapiens
tgtcaacaggagcatggaggcccacagcatcctcaggaaaaaagggctaagtgtccggtcttttggaactgaatctcatgtgaggctaccaggaccaagacccaatcgtcctgtagtttatgattttgcaacaacatataaggagatgtacaatgacctcctcaggaaagatagagaatgctacacccgcaacggaatcttacacatcttgggaagaaatgagagaatcaagcccggtccagaaagatttcaggagtgcactgattcctttgatgtcatcttcacctgtgaggagagtgtctatgacacagtggtggaagatctgtgttccagagaacagcagacctttcagcctgtgcacgtgatcaacatggacatccaagataccctggaagatgccaccctgggagctttcctcatctgtgagatttgccagtgcctgcagcagtcagacgacatggaagacaatctggaggagctgctcttgcaaatggaggagaaggcaggaaaaagctttcttcacaccatgagcaaaccgagctgataatggactgctggaaaaatgatttgtttaagggtattcagcagataaataacattgtatagataagcaccttttaaataaacttccttttctcaatttgagtggtttctttttaattttttaaatatacaggcatgggctcccctccttcatgaccctccagctccacttcacctggatctgacgatactggacttcatcttggtagtaacaactttcacatttttggtatcagaaactttcaaagttgt

SEQ ID NO: 468616 - DNA, 607 bp, Homo sapiens
gggcaactctgtgagggtatcttaagatcccatctcagagccttcggctgcctccctaggatgctcccttcccagacctatgtcaacatctccttcttccaaccgcctgctcttctcatgattggcatcccagggctggaggcggttcatggctggctcgccatccccttctcctccatgtacactgtggccctccctgggaactgcctgatcctcctggctgtgaagaggaaccccagcctgcaccagcccatgtgctacttcctgtccatgctggcgctccccaaagcgggcctcaccttgtccacactgcccatcaccttggctgtgctctggtttgaccaccggctcatgggcttcaatgcctgcctggtccagatgttcttcctgcactcctctgtggtggagtcctcagtgctcctggccatatcctttgaccactttgtggccatctccaaccccctgcactatgcagctgtcctcacaaatagtgtcatcatcaggattgggctggccattgtggctcaagttaccttgtgcctcttcctgtgccatttccggttaagagtctaaatttctgccctggtgataacatcccatcccactc

SEQ ID NO: 468617 - DNA, 1178 bp, Homo sapiens
aataggaacagctccagtctacagctcccagcatgagcgacgcagaacacaggtgatttctgcatttccaactgaggtacggggttcatctcactggggagtgtcggaaagtgggtgcaggacagtgggtgcagcgcaccgagtgtgagccaaagcagggcgaggcattgcctcacccaggtagcgcaaggggtcagggaattccctttcctactcaaagaaaggggtgacagacggcacctggaaaatcgggtcactcccaccctaatactgcgcttttccaacagtcttagcaaacggcacaccaagagattatatcccgcacctggcttggaggatcctaggcccaaggagcctcactcattgctagcacagcagtctgatatcaaactgcaatggggcagtgagtctgggggaggggcacccgccattgccgaggcttgagtaggtaaacaaggcagccaggaagctcgaactgggtagagcccgccgcaactcaaggaggcctgcctgcctctgtagactccacctctgagggcaggacattgccaaacaaaaggcagcagaatcctccgcagacttaaatgtccgtgtctgacagctttgaagagagtggtggttctcccagcatgcagctggagatctgagaatggacagactgcctcctcaagtgggtccctgacccccgagtagcctaactgggaggcaccccccagtaggggcagactgacacctcacatggccaggtactcctcagagacaaaacttccagaggaacgatcaagcagcaacatctgctgttcaccaatatctgctgttctgcagcctccaccgctgatacccaggcaaacagggtctagagtggacctccagcaaactccaacagacctgcagcttagggtcctgactgttagaaggaaaactaacagaaaggacatccacatcaaaaccccatctgtacgtcaccatcatcaaaggccaaagaatgcctctcctcctccaaaggaatgcagctcctcaccagcaacggaacaaagctggatggagaatgactttgacgagttgagagaagaaggcttcggacgatcgaactactccaagctaaaggaggaagttcgaacccatggcaaagaagttaaaaaccttgaaaaagaattagacgaatgactaactagaat

SEQ ID NO: 468618 - DNA, 1347 bp, Homo sapiens
ccctcttcagcagcactgcttcagcaatgccccagaagccctacaaggcatccatctctggcccctgggccttcagcagccgctcctacaccagtggtcccggtgcccacatcagctccttgagcttctcccaagtgggcagcagcagcagcttctggagtggcctaggcaccagcatgagtctgggtggtggctatggtggggcagtgctggacctggaccccaatatccaggctgtgcatacccaggagaaggagcagatcaagaccctcaacaagtttgcctccttcatcgacaaggtgcagttcctggagcagcagaacaaatgctggagactaagtggagcatcctgcagcagcagaagacagctgggagcaacatggacagcgtgtttgagagccacatccacagccttgggcagcagctggacactgggccaggagaagctgaaggtggaggcagatcttggcaacacgcaggggctgctggaagacttcaacgataagtaccaggatgagatcaacgagcggacagagatggggaatgaatttgccttcatcgagaaggatgtggatggagcttacatgaacaaggcagtgctggagtctcacctggaagggctgactgacaagatcaacttccccagagagctgtgtgaagaggagatctggaagctgcagtcccagatctcggacacccactccctggacgtggatggcatcatcgcggaggtcaacgcccagtacgaggagatcgcccactgcggccaggcaaggctaagagtctgcaccagctccttcagccgcaccagctcctccaggaccatggttgggaagctggtgtccgagtcctctgatgtcctgcccaagcgaacaactatggcagtccctcccagcctaccccctcttgcagctgccccagagcttgtgggggaggctgctgtgcaggaaagcgcagggaacaggagacccacttgaggctcagccctcctccacagcccacttgtgtggggagtagctttcctttgtatatcaaaaacttggaacagggtgtggatgccttttatttctttttcttgcctaattgctctggctagaatgttcagtgctatgttgaatggaaatagtgaaagcaagcatccttgctttgttcctgatattagaggaaatgttttcaatgtttcaccattgagtatggtgttcactgtgggtgttttatatatggctttttattatggtgagggtgtatacttctatttctagtttgttgagtgtttatttttatcatgaaaaggtgttgaattttgtcaaatgcttttgctgttagaaggggaagggtctgtatacc

SEQ ID NO: 468619 - DNA, 1107 bp, Homo sapiens
agaagaaaacagctttactgaagcagtggcaacgtcacagctccgtgactgctcctgccatgcagggctacctcataggcagtgtgctgagaaagccctacaaggcatccatctctggcccctgggccttcagcagccgctcctacaccagtggtcccggtgcccacatcagctccttgagcttctcccaagtgggcagcagcagcagcttctggagtggcctaggcaccagcatgagtctgggtggtggctatggtggggcagtgctggacctggaccccaatatccaggctgtgcatacccaggagaaggagcagatcaagaccctcaacaagtttgcctccttcatcgacaaggtgcagttcctggagcagcagaacaaatgctggagactaagtggagcatcctgcagcagcagaagacagctgggagcaacatggacagcgtgtttgagagccacatccacagccttgggcagcagctggacactgggccaggagaagctgaaggtggaggcagatcttggcaacacgcaggggctgctggaagacttcaacgataagtaccaggatgagatcaacgagtggacagagatggggaatgaatttgccttcatcgagaaggatgtggatggagcttacatgaacaaggcagtgctggagtctcacctggaagggctgactgacaagatcaacttccccagagagctgtgtgaagaggagatctggaagctgcagtcccagatctcggacacccactccctggacgtggatggcatcatcgcggaggtcaacgcccagtacgaggagatcgcccactgcggccaggcaaggctaagagtctgcaccagctccttcagccgcaccagctcctccaggaccatggttgggaagctggtgtccgagtcctctgatgtcctgcccaagcgaacaactatggcagtccctcccagcctaccccctcttgcagctgccccagagcttgtgggggaggctgctgtgcaggaaagcgcagggaacaggagacccacttgaggctcagccctcctccacagcccacttgtgtggggagtagctttcctttgtatatcaaaaacttggaacaggg

SEQ ID NO: 468620 - DNA, 2577 bp, Homo sapiens
tcgggctcctggttgccttagtaacccctcggctttctgttcctggacggtggcggccgccggctctatgatggagcccccgaagcccgagcctgagctccagcggttttaccaccggctgctgcgtccgctgtcgctcttccccactaggacgacgtccccagagcctcagaagcgccccccgcaggagggccggattctgcagtccttccctctggcgaagctgacggtggcgtcgctgtgcagccaggtggccaagctgctggccggcagcgggatagcagcgggagtgcctcctgaggcccgactacgtctcatcaaggtcatcctggacgagctgaagtgcagctggcgggagccgcccgccgaacttagtctgagccacaaaaacaaccagaagctgcggaagcggctcgaggcctacgtgctgctgagcagcgagcagctcttcttgcgctacctgcacctgctggtgaccatgtcgactcccaggggggtcttcactgaatcagccaccctcacccggttggccgccagcctcgccagggactgcacactcttccttactagtcccaacgtctaccgtggcctgcttgccgacttccaggccctgctgagggcagagcaggcctctggggatgtggacaagctgcaccctgtctgccccgctgggacgttcaagctgtgccctatcccctggcctcacagcactggcttcgcccaagtgcagtgctctaacctcaacctgaactacctcatccaactcagccgtccaccagagtttctcaatgagccaggaaggatggatccagtgaaggaattgaagtccatccctcggttgaagaggaaaaagcctttccactggctgccctccataggaaagaagagagaaatcgacatcagttcctcacagatggtgtcgctgcccagctatcctgtggcccccaccagcagggcttccccctcgcctttctgccctgagctccggagaggccaatccatgccctccctgcgtgagggctggaggctggcagatgagttgggccttcctccactcccatctcgccccttaaccccgctggtcttggctacagagagcaaaccagagctgactgggctcatcgtggctgaggatctgaagcagttgataaagaagatgaagttggaggggactcgctacccaccactggactcaggcctgcctcctctcctgggggttgtgacccgtcacccagctgcagggcatcgcctggaggagctggagaagatgttgaggaacctccaggaggaagaagcctctgggcagtgggacccccagccccccaaatcctttccacttcacccacagccagtgaccattactttgaagcttagaaatgaggtcgtggtccaggcggctgccgtacgggtctctgatagaaacttcttagactctttccacattgagggggccggagccctgtataaccatctggctggtgaactggatcccaaagccattgaaaaaatggatattgataactttgttggcagtactaccagggaggtctacaaggagttgatgagccatgtctcttctgaccacttacattttgatcaagggcccctagttgagcctgcagcagataaagactggtcgaccttcctgtcctcagcctttctacgtcaagaaaaacagcctcaaatcatcaaccctgagctggttggactttactcccagagagcaaacactttacagtccaatactaagaagatgccctccctcccatcactccaagctaccaaaagctgggagaagtggtcaaacaaggcctccttgatgaactcatggaaaaccaccttgtctgtggatgactacttcaagtacctcaccaaccatgaaacagatttccttcatgtcatctttcaaatgcatgaagaagaggttcctgtggagattgtggcccctgccagagagtccctagagattcagcaccctcccccattgctagaagatgaagaaccagactttgtgccaggagagtgggattggaacactgtgctagagcacaggctaggagctgggaagacaccccacctgggagaaccccacaaaattctgagcctgcagaagcatctggaacaactgtggtctgtgcttgaggtccctgacaaggaccagctgcgggaggcattgctggcgagactagagtggtttgagggacaagcttccaatcccaaccgcttcttcaaaaagaccaacttgagctccagtcacttcctggaggagaatcaggtccgaagccatctccacaggaagctcaacttaatggagtcttctttggtttccctcctggaggagatagagttaatctttggcgagccagtgatcttcaaggggcggccctacctggacaagatgaagagtgacaaagtggagatgctctattggctgcaacagcagcggcgggttcgccacctggtctcggccctgaaggatccccaccacattcctatcacactacattaaattgtcacctcttttagttctcaaacactattaggaagaagaaaattaattaaatttttaccagttac

SEQ ID NO: 468621 - DNA, 507 bp, Homo sapiens
cagggtccttacctgagtgactggatggacaaaggctcctctgccgtctccctgcaaggaaaggggccagcatggcagccgaatggaagaatggggccctggggctcagatgggatgaaggaacttcattcatccttcaatgcccagttcacacattactacctcctggtgcctccagacagaatccattgttctcgttggcgctcccgtaatactttctacatgttcaattttagcatctactcacttccccacaaatatttatcaagtacctactttatgtcagagtccttccagactgcccgagaacagcaggagcccagagcccggggaccaagggaccctctttacacgggtgggaaaagaggccttgaggagccctgccttcacctctcagctccgcaggcgtcggaatccgatgaggacgcagcggccatcttcgcaggcgtcgtcctggcaaccggccccgccctcgcgtaacgcccaatagtgcccgagcacagggaa

SEQ ID NO: 468622 - DNA, 3279 bp, Homo sapiens
cccacatctcagaggggcaaggccaccagcccacagggtctggaatgagcaaaggcgctgccacccctctctgtgtgtcgttattcctgagtcagtcaccccaaaagtcggttatcgaactacttccaggcgcgactggccggggcggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactgcctcctggtcaacagccccacagaccaatggctgcacctcagaagaggactgaatagcgggtgttgcccccgagtgctcagagtccctagggaagctcacacctgcgcaaccttgtccagagtcccctgtgtatcctgccggcacctcctccagggagcctctgagtcttgcctagttgagcagcagcccccatccctgtcctccacagccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtatgatgcgttcaccaagtctttatttccgaagtgctgttggctctattggcctcagtgaactgggtggggtcggaaagattgtacccccttgacaggtgggatgactgaggccctgagaggggtagggattggtgggcatctctgtgctgggtcctctggaccacatgatagctggggggtactgacctgcaaggaatcctgagctcctgggcagagcacctagttggatggacaactattgctctcccactccatgagcccctgggctctcaccagcatcctctgcctccccaggatagctcctccttggaaatctggccttagagaggcagtcagtgtgggcagggctttggcgaccccaccaattctacacacggatggaggaaaggcctgcttcaccacacacctatactaccctgcccgtcccagagaaaagcaagggttttctgcccacctgcctttgtgaacattcactgagcacctattagatattaggtgctcagccagcacagggtacctgctcagaagccaggggctttttggcatcaaggaggaagacaggcaagatatgaccttggttgctgaaataagccacagggcagaccccaaggaaggattcattcctttgagcactgttcacagacagctgccccgagccaggccctgcctggtctggagactttgaaacaaaggagacacagtccccgctcccaaggccacaggaagccaaatataacttgtgatacgtcttgtgagggccctgcagaagcatgtc

SEQ ID NO: 468623 - DNA, 1842 bp, Homo sapiens
tctgctacattgtcaggagcaggtctccgttgcacagcaccctgacctcactcttcctggcacacaaaaacaaggcatggcaaggcataacgggctgggccaggctatgtggctggcagcgcagacagaacgacccttggacaggcagacaaccctgcacagccacggctctgagtgtggcatgtgcaagctgactgtggacctgggggtggtctgccctggcctgcccatgtccaagtcctcctgggaggctgtggtggctgtgcttatgtgcctgtgcctaaatctgggaatgactaccctagtctgcgcatatgaagaacaggtggagagcagcagcaagattgtctgtgggaggaacccccagggcaggcctgtgggaggagaccatgaacacccccacttcccagctgaggaaactgcatctggagagcccaggcccactgcccacggtggcacagccaaacagcggcggaagcaggagtggacttcagagccagcactgctgtgtcccctcgctgccctggggagagcctagagcctgccccactggactgcctgtggctctgctgcactcatatttcacccccaccaggaatttgcagtgttgagaactaacttgaaaagcaggaggctggagcccctggctgcccaaccacctgcagtgcctcagcatctgtctcctttggaattacacctgacagcgcatggagcaaacagagggatacagttcacggggacaatgtccgcgtcaccgctgtgggaaggtgccccttctttcctatggaatcacgattgtgagcattgtgagtgatttctctccatttggctgcatttctcaacaatttctggccccgtggctgtgctctggagagctggggctcccagaaggctgactgccagccagaaaatggcttctgagcaacatcagggaacaggaaggagaattcactctacttttgtccctgtatagaaagccaaaacagtggtgggatgtgtgagcttttttcagaaataccttttggctttgttgtactcagagagccagcactaaaccaacaccttcatccacagctttaagaagagagcgtgtgatcggcaactgactttgttgagagggactgttaggctgtggtgatggacacgggggcagggtggccagggacaatcaactttggtgttctgctttgttaagggggttgggaatcttccatgaacagaccagcctttgctcatagtgggcctcctcccagaacccatggatccacacatccccagacctttgaacaacttaagaaaaacaaatcacctcttcatccagaggaatttagcccagacaattgccatgggatttgggcatttcaaggctgttataaaagaggcacagacagaaagccaaacgagactgtgacacctgtctcccggtgctgacaagtgtcggtgatgggctgtggagcaagtccctctgcaccctgggcctcagtttccctacctgctccgcagttgttctccatggatccatccatttctgacttgtacaactggttaattccaggctggaacataatcccagtcctagctttatacgttaacactgaggacttcttgatgcattcagggacaaccaacactgaactgtgacgctgaaattaaaataatcactttgtagatttgatgattgtaagtttattgacactgaacttttctcacttatcgagggacctgcattgcttctcaagcctggagtgttttgcatgacagcgtttaaggttgtgggctttagagtctgagaggactgggacccaagctcagttgcgtctccttgtccctgtgtgaccttca

SEQ ID NO: 468624 - DNA, 1164 bp, Homo sapiens
gggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaagaacatggagacttttactcttttgatggcccaggacacagtttggctcatgcctacccacctggacctgggctttatggagatattcactttgatgatgatgaaaaatggacagaagatgcatcagccaacactgaagctttgatgtacccactctacaactcattcacagagctcgcccagttccgcctttcgcaagatgatgtgaatggcattcagtctctctacggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttgggtaattgagataaagcatgtaaagcacttagctcagtgcttggcatagagtaatcacttaataaatgccctccattattaacttgtacttaatctaagttatatgtgttgcaaaatgacatatttgaagatgtctcatcattttccttatctatatttacagga

SEQ ID NO: 468625 - DNA, 1601 bp, Homo sapiens
actccgcctgtggatgaggggtcttctcagctgggatattggagcagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcagctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaa

SEQ ID NO: 468626 - DNA, 758 bp, Homo sapiens
ctagagcagggataccattgccaccactgccagcagctccagcccggaaggacccctgtccctctgccgacgctgccgtcttgattgtgaggcctccccagccatgtggaactatgaatcaattaaatctctttcctttttaaattacctggtctcagaaatcttctctgaggattatagccagaacccctcagaaaactctatcttaaaagctacacaactagagcttctgtttgttttcttccatggctttaaggctcagcttgaggtcataagcccccatcaggtcccccagtgtcttctgttactgagctcttctagcgccctgctgtctacgttggatgaagctgacttgatcattgtggataaggtttttaatgtgctgctggatttggtttgccagtattttattgaggattttcgcatcgatgtctgctggagtttgctggaggtccactccagaccctgtttgcctagctatcaccagcagaggctgcagaacagcaaagattgctgtctgctccttcctctggaagcttcgtcacagaggggcacctgccagatgccagcaggagctctcctgtatgaggtgtctgttgacccctgctaggagatgtttcccagtcaggaggcatgagggtcagggacccacttgaggaggcagtttgttccttagcggagctcaagcactgtgccgggagatctgctgctctcttcagagctgacaggcaggaatgtttaagtttgctgaagctgtg

SEQ ID NO: 468627 - DNA, 583 bp, Homo sapiens
ggaagcgggagggatagcttcaggagatatacctaatgctaaatgatgagataatgggtgcagcacaccagcatgtcacatgtatacatatggaacaaaacatgcacattgtgcacatctttccttctaacagacaggaccctcagctgcaggtcagttggagtttgctagaggtccactccagacctgtttgcctggataacagcagtggtggctgcagaacagtggatttttgtgaactgcaaatgctgctgtctgatcgttcttctggaacttttgtctcagaggagtacccggccgaatctctagctgaatgctgggagaacgactgctctcttcaaatctgtcagacagggacacttaagtctgcagaagtcactgctgtctttctgtttgtgtgcgccctgcccccagaggtggagcctacagaggaaggcaggagtccttgtgctgtggtggtctccacccagttggagcttcctggctgctttgtctacctaagcaagcctgggcaatggcatgcgtccctcccccagcctcgctgctgccttgaagtttgatctcagacttctgtgctagaaat

SEQ ID NO: 468628 - DNA, 2645 bp, Homo sapiens
aagtcatcggtcagacacccttcctgtgccctctggtcagaggagaggccgggtccccagagaccacagcatctatacccagctgttggagataacgctgcacttgcagcaggccatgacggagcacttcgtgcagctgacgagcagacagggcctgtcgctggaggaaaggaggcacactgaggccatctgtgagcatgaagcccttctgagtcgcttaatatgccggatgatcaacctcctacagtctggggccgcgagtggcctggagctccaagtgcctcttccttctgaggactctaggggtgatgtcagatatgggcagagggcccaactctctgggcagcctgatccagttccccaactgagtgattgtgaagctgcctttgtcaaccgcgacctatccatccgtgggattgacatctctgtcttttatcagtcgagcttccaggactacaatgcctaccaaaaagataaatatcataaggacaagaacaccttggtggtctgggaagaggtcttaaaggctgaatcagccagccatgtggtgatggccatggccatgaccctccaggcaggaggaacagcacacgtgaaaccttcaagatgcgaagggctaggagtgattgggaaaggaggtccaatggccagaggtttcattaaccttggcaccagtgagaacaagctctgcatggatctgatgactgaaagagtaaggatgttctgggctgtgttgggacccaccccttcaaggcttagtccccctagcgtgctcctgagctatggtagatacagggtgaggaaaggggcccggaagccacaaggtctctctgggtctgtttacagcctgcgggaagaagtggcccggttcctgacctactactgcagggcacctacccgacttgacccagaaaatgtggtggttctaaatggctgctgctctgtcttctgtgccctggccatggttctgtgtgatccaggcgaggccttcctggtccctgctcccttctatggtggctttgcctttagctcccgcctgtatgcaaaggttgagttgattcctgtccacctggagagtgaggggaaaaaggtccgaggccttgtgctaatcaaccctcagaatcctctgggtgacatctactccccagactcactgatgaaatacctggaatttgccaagaggtataacctacatgtgatcatagatgagatttacatgctgtctgtgtttgatgaatccatcacattccacagcattctgagcatgaaaagtttgcctgatagcaacaggacccatgtgatctggggtaccagtaaggattttggcatctctggcttccgctttggtgctctgtatacccacaacaaggaggtggcctctgctgtgagtgcctttggctacctccacagtatttctggcatcacccagcacaagctgtgtcaactgctccagaacacagaatggattgacaaagtatacctacccaccaattgctaccggctccgggaagctcacaagtacatcactgctgagctgaaggcattggagatcccttttcacaaccgcagctctggcctctatgtctggatcaacttgaaaaagtacctggatccctgtacatttgaagaagaacggctcctctattgccgcttcctggacaacaagctattgttatcccgtggcaaaacctacatgtgtaaggagccaggctggttccgcctcatctttgcagatgagctcccccggctaaaattggtgtcatctcatgtggcagaagaggagggggattacggggagggtctccggagaatctccaacccatctgtgcactgggagaacaagatggagccaagggaagctgtggccatgctcagcggggaggagcctggcctcttcaatttctgtgtggtggcctgggattcaatgtgagtttggaggcctgttagcaggaccccctcttgctctgctgacagtatttttcttttttcctttttgcccagtaaattccgttcccctcacccttcaatgtgtccatgttcctaatccttcctggtggtgtgacaagaacctggttttagctgaactaaggagcaaaattctgcaacaaaatgagtttttttgatcagtcaatctaactgtttatcaactgtattgaacttttcaaagaaccaactttcagtttcattgatttttctcttgtttcgccttcatttctgctcttatctttatttctttctatttactttgggtttaatttgctcttttttctagcttattaatgtggaagcttagatcatttgttttaagttggtttcaaatatatgcattacaagctattcatttctcacttagcattattttagctacattccataaactttgatctgctggtttttaatcattcaaaatattttctaatttcccttgtgatttctttttttaaatcaatggtttgcttagcatatgtaacttagtttccaaatatttggggactgttcagctttctttgttaatgatttctactttaatttcattgtgactagagaatgtactctatggtttcaatcctttgaaacttattaagacagtttatggccagatttgtttacaacatgtggtctatcttaatgtttcatttgcactt

SEQ ID NO: 468629 - DNA, 657 bp, Homo sapiens
gcccactgtgctgcccttcctcggacctgggctgtcgggagagctggaggcctgtgcattttgtctttttgcagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctgatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccgggggtaagtgagctctgtggcctgccccgc

SEQ ID NO: 468630 - DNA, 1904 bp, Homo sapiens
tgcggcccctggaatgtgagggacagcgccaggacctggaccccaagctcttctgacagccgtccaggcagcacctgtgccggaggggtggagactccgtgaggaccagtatgggccgggggaccggaggaactcggcacaactcagaactgagagagggctgctgccagggacctgaggaggggcaccaagggcagcggggggagagggcagggcactgtgttttgggttgggggaggacttactgttcctaggagggagtcgggtatgtctggctacagaaacagtgctaacggatggaaatgttcaagtctgtgtggtatcaggctcctgaggtgtcggagccctgaagaatgccaagggcctgtgaacacagtgaaggtagtgggagaccggccagaggggacctgcttgtctgtccagcttagtcgcatccccatctacctgtgcaggaaaggccagtggctggaagtttggggcagcttcacagaaagggtagcatctaagctggcttttgaagaatgggaaggagttggtcaaacattggagatggaggattccattccaggtggaggaaacagcatgtttgaaggcacagtaggaggaggcctgggggctggtggaagagtgaggaatttagcaagaggaggtgaggctgaaaacagggccaccacaaaaagttttgctggaaaagcaggcaggagccacctcatgataggctggggatgacacagtgacatttggaatctgtctggtaaacattgctgtcctgaaatcagattagatcaactaagtccagtcactttaagtctgttcagacaggtaaagagatttggctgtggcccatccaagtggacacttcctgtgggaaagggagctagtgtctagcactttggatatgccaaagagaagcctctgtgtccttcatgaaccacatccactcccacctctgtgcctttgcatctagcacccactgcctgagaagtccttccccttctgcatcttgttaatttctccaagatccagctcaggcatgttcctagagaagcctcgcctgaagaccctatgctcacgccatcatagcgtttgtcagactgaatgtattgtatctatctgtgttcttcactaggctgtgagctccttcaggaggtgactttgttttaagtcatgtaccaggcccatgaatgtgtataatatttgacatacaaaaagttcaataaataaatgaataatgggaagtaatattactgtagcagtcccccagtattcatggtttcaatttctgaggtctcagtttcctgtgattaaccttggtccaaaatgttaaattggaaattccagaaataaagaattcatacgttttaaattgcacatcattctgagtggcatggtgaattctgttgccatccctctctgtcccatccagaatgtaaatcacccctttgtccagtgtgcccacgctgtagatgctccccgcccgttaatcacttggtagctgtctcagtgatcagatcaactgttgcagtattgcaaggcttgtgttcaaggaacccttattttacttcataatggcaccaaagcacgagtagcagtgccagcaatttggatatgccaaagagaagccataaagtgctttctttaagtaaaaaggtaaaagttctcaattaataaggaaaggaaaaaaatggtatagtgagtttgctaagatctacagtaaggatgaatcttctatttgtgaaattgtaaagaaggcaaaagaaatctatgcatggtctatgtagggttcagtacaaactgtggtttcaggcatccactgggggtcttggaatgtatcacccaaggatgaggggggactactgtattactaatgataataatgtttactgcctgttatgccaagtgcc

SEQ ID NO: 468631 - DNA, 583 bp, Homo sapiens
gtgacaaggcagctggcgtcctccagagtttaaggggaggagaaatagtctccctccacctcttgatgggggatgctgcaaagtcacaattcaaagagtatgaattcagggaggatggaaagagtgtggcaaattttgtaatctaccacagtttactctttgaccataattattcacattgctcccacaggaaaaatatgcttaccaccattccaagacccccaaacacctcttgcaattatgtcatcaggcttgaagaccaggatcttgtggttcacatcaggtttgtatgtgacattatggatgttgttcttcttaatcctgacaccgatgaattaaagacaagatcatggctgtttttacaatttgccatacctcctcagaggccaccctcatcacaaagtgggaggccatccttcccttccaaattttatctttatgtgacatatgtacatatcaaaaatatatagttttttcccctgtgagttctatatgtttttaaatgaactatttcatacatactacataatttgtgcagtataaatgtaaggtataaagaataggatgcttttgtacttaccac

SEQ ID NO: 468632 - DNA, 667 bp, Homo sapiens
ggaaccacttcacacttcctaggatggatacaattaaaaaacagaaaataagtgtcactacggatgtgaagaaactggaactctcatgcgttgctggtatgtatctgaaagaatggaatgatagctgtacacccatggtcatagcagctttattcacaatcgtcaaaaggtggaagcaaacccagatgtccgtcaagagaatggctaaacaaaatatggaatatgcatttaataaaatattcagccataaaatggaacagaattttgatacacactacaacatggatggacttgaaagcattatgctaaatgaaataagccagacacaaaataaatattgtcctagtcctccatgcccctgccccacccctcctctccttctgctatggtgtgggactaaaaaggcactcgtctggaagtcaggtggcctgagctctagtccagattgtgctaaggtatgaccctggacaaatcactttccttgtcagaccctcgaattcctcatctgtaggaggcactgctgatttgtctgccctccccactccagaggagttaggaggtctcaaaggttgtaaacgtgctttataaatgatacagactgtatcatgtcagttattctaagcttgtttgattagtcattctataagtcattatggaatggcatcat

SEQ ID NO: 468633 - DNA, 797 bp, Homo sapiens
cacactgacacagacacagtggacggtgctgtgacagagacactgcagtggggataaaatggtgatcaagagccaactctgccctcgaggagtttgggtctgtagcaccatgactgttaatcagagatgtccactgccattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccggaaaggggaggaggatgtgggtgctccaaacccatgtgttgctgcccaaacagatttactctcagtgcagcaaacagtcctgttcctttcatggaagttcctggcgaatggatctttgttgtaaaactgtgtatgtgttggcc

SEQ ID NO: 468634 - DNA, 1206 bp, Homo sapiens
tctccacctggttcagcccacctgcctccactcctgcctccaccatgtccatcagggtgactcagaagtcctacaaggtgtccacctctgaaccccgggccttcagcagccacttctacaccagtgggcccatgggcagcagcagcttccggggtggcctgggcagaggctatggtggggccagcggcataggaggcatcaccactgtcacggtcaaccagagcctgctgagcccccttaacctggaggtggaccccaatatccaggctgtgcgcacccaggagaaggagcagatcaagaccctcaacaacaagtttgcctccttcacagacaagatacggttcctagagcagcagaacaagatgctggagaccaagtggagcctcctgcagcagcagaagatggctcagagcaacatggacaacatgttcgggagctacatcaacaaccttacgcagcagctggagactctgggccaggagaagctgaagctggaggtggagcttggcaacatgcaggggctggtggaggacttcaagaacaagtatgaggatgagatccataagcttacagagatggagaatgaatttgtcctcatcaagaaggaggtggacgaagcttacatgaacaaggtagagctggggtctcgcctggaaggactgactgatgagatcaacttcctcaggcagctacacatctgcggtgctgtccatggacaacagccctccctggacatggacagcatcatcgctgaggtcaaggtgcagtacgaggagatcaccaaccacagccaggctgaggctgagagcatgtaccagatcaagtatgaggaactgcagacgctggttgggaagcacgggaatgacctgcggcgcacaaagactgagatctccgagatgaaccggaacatcagccgactccaggctgaggctgagggtctcaagggccagaggacttccctggaggccgccatagcagatgcccagcagcgtggggagctggccgttaaggatgccaacgccgagctgtcggagctggaggccgcccaggagcgggccaagcaggacatggcgcggccgctgcagcagacagagtcccgcttccctttctgctccactaattatccttttaactcgcactggtgtatttttgccgcacgatctgcagttttatttttatccacctctcggtaatggtattggggcc

SEQ ID NO: 468635 - DNA, 514 bp, Homo sapiens
gctcagccttgattgcagtgaaaaggaatacagggagaagcaggagaggccacatcatgcaagccgagggcatggctgtggctggcaccgggcactgcggagcagtcggcaggaagcttgtgtcactggaccaggctccaaaggtcatggcagtctttgtggtgcggctggaaaagcaaggcccagagggcactggacagactgttgagaagattcaaggggaggaggaatctgagggagcgcagttcgagctgcccacgtgtgcgtgtgtgcgtgtgcgcgtgcacaagtgcgtgctggtggtgtcgggagggaaggcagggaacaagcgttgtctctgcctccaggaagatgtggttggcgggggtggaaagtggcctctggaggatgagtcaggaactcctggagtgagaagggctcaggcctcacccagcagtgacctcagagagggtgtgcaaggtcagaagagcctccagctgagctcagcactgtgacaacagactttccaaaatac

SEQ ID NO: 468636 - DNA, 671 bp, Homo sapiens
ttgtctgtaagagccaaaaagtagaaacgacaccaatgtctatcaactgaccaatggaatattattcagccataaaaaagaacaaagttctgatacaggctacaacatggatgagccacaagggatgaggttcagaaaagcaggaacacttgcagcacccaaacctccactttttctcctcccctcacaccaccactgctcccctccagctacctccctggggaagaaggtgtctgatcaatccagtagaaccaaagcggagagaggtactctccagggcaagactgtggcatcctcaacacagaccccccgcgctgacacacgcctggcagccatccaaacaaggcagcaagtttgctcaggagccttccggagtactgagtggagagcagcccatggggatagaacagaggctgccactgagctcctgctcctgctggatcagactcctgctctggatcagaccactaccgccctggctgtccaggtccagctgctgacacagctaggtgctcaccctgaaacaggaagtccccacagctgacccttcagtccttcgctttacctgcagaaacccccaagctcttgtagctctaagtcccctgagagctactcacaagttcaagttttcaggctgagggtcatcaaagcccctctgttcatttgcagaa

SEQ ID NO: 468637 - DNA, 744 bp, Homo sapiens
gattggaatttaattaccttcgccagcgaatgtttggagaacctctctccatcaattgattctgaagtcagatttttattccgagatacttaatggcacttgggctgatggaagcctgggagcaggtggacctgggccacaaggagccctttaacaacaggctcttgcctgtcacggatgagatggacgtgtgctccctgcaggcccgtgcagctggggcctgtggcgcccccagcatggagacggtgctggaggagcagcacaggacgaggaagggcttctcttgcaggctcctcagtgaggtgtcccgcagcatccagcctcctgcagcagcccagagagtggcctgccagagagttccacccacaccggcacttcagcaaactttcctgcagccagggcgcctcggctgtaccatctctaacaaggtttgggtctcagccctgggtgttggggttgcgggaagacgcttccaggtttcttcctgccttcgatgctcggcctcagccctagaggtagaagtgttccttagtgggcgatctcctgtcacggttactgggtgatctcctgtcatagctactaggcgatctcctgttatagttactaggcaatctcctgttatggttagtgggctatctcctgtcatggtgctagtctgagttttgttaaaggtgcctttgaagaactattgatatggttaggctttgtgtccccacccaaatctcatcttgaattgtaatcccc

SEQ ID NO: 468638 - DNA, 2443 bp, Homo sapiens
gcctttaggttttccgaaggtcaacaatgaaaaacagaaccatgtttggtgagtttattctactgggccttacaaatcaacctgaactccaagtgatgatattcatctttctgttcctcacctacatgctaagtatcctaggaaatctgactattatcaccctcaccttactagacccccacctccagacccccatgtatttcttcctccggaatttctccttcttagaaatttccttcacatccatttttattcccagatttctgaccagcatgacaacaggaaataaagttatcagctttgctggctgcttgactcagtatttttttgctatatttcttggagctaccgagttttacctcctggcctccatgtcttatgatcgttatgtggccatctgcaaacccttgcattacctgactattatgagcagcagagtctgcatacaactagtgttctgctcctggttggggggattcctagcaatcttaccaccaatcatcctgatgacccaggtagatttctgtgtctccaacattctgaatcactattactgtgactatgggcctctcgtggagcttgcctgctcagacacaagcctcttagaactgatggtcatcctcttggccgttgtgactctcatggttactctggtgctggtgacactttcttacacatacattatcaggactattctgaggatcccttctgcccagcaaaggacaaaggccttttccacttgttcctcccacatgattgtcatctccctctcttatggcagctgcatgtttatgtacattaatccttctgcaaaagaaggaggtgctttcaacaaaggaatagctgtactcattacttcggttactcccttactgaatcccttcatatatactttaagaaatcagcaagtgaaacaagctttcaaggactcagtcaaaaagattgtgaaactttaaaaaaggagattacacttcaaaatacattttcacttaacaaatatgcattgaatgtctatatttcaagtgctaaattggcccttgaagattaaaataggaaaagtatatgtcttaatttcaagaaaactatagtctagaatcaaggaaagatatataaatggtaaatttatgtaataaatttacaaaaaacaaaataatattttaattgttattagagaagagtgaatggggatctgaaaaggaacagttggaaagaattagttctgttttccataaattatttgaaatttaagaagcaaaacagattgtttatttagaagagtaggaggataagaatttagagtgaaaaaggaaaccagatcataaaagtaagtaattacaactactgagttagctgggtttcatgagtcaagaaattttcagaattgttttgaggagaatgtagtatcagcattgttcttcagcatggagccctggagactatgtttccatcgaggagtgaataatttttcttctcctccattttttcatctatatttcaaatgtaaccattgcaacttccctcctttcataagaggaaaatgaaagaatatatatttagtctacttttctccaaatgaggagaaaatttttaagatttttgtcaacttaatatgtccattttctagtttatggttaaaacaggtttctagagacaagtttagaaggctttcattctcctagacaaaatctattgtttcttttcttaggtgacattttaagttaatggcatgagatctgttttctctctctttgatagtttctggtaattttttccttcctatcatgattttattttcatccttttgtttcactttattagatattagaaaagaaaattctgttatctggctctacttctttaactttcccccagatttttgctttcgtttgtaacataaaccatggatgaccattttataaagtaaaaagaatataaagtgtcaatgcaatcttatatctagaatgttccaaattatgagtcttgaaaaacaactagaaatagactatcctaccaaaaactttacacatggattcaaggcaatgacaacttgaatttgaataggtagtggtagtgtccaatttcaatggaagtaagcacttttttttaatctgagcatttgtacacagtttaataatatcttaaaaaattgcaggagctttgttactatttggggtaaaagtggaacacaatctggtattttcacatgctttatatgtggtaatatgttgagtaaaatgaggtacttctcaagcatttaaggaacaagctggattgaactgattatgagagcaaattatcagagccacagaaggtattggagaatgtataatatttttgaaaaagtattttatgtaaagctgttgctattctgagtatcttgttttctttggttgctagctagagattagtgataatattcaatatattccaaatttaatgcact

SEQ ID NO: 468639 - DNA, 1019 bp, Homo sapiens
gcctccccactcatgaagggtctctttggttacagacggcatgaggtttgagggtctctgtccctcatgtctagagtctcatcctgggaattaactcccaagatactgttaatacttagggatcaagatgacccagctggtagatgtcagtcagccttctccagcatctccagtgcttattcaagggatcacaatcaaaatgtccatggcggaagggatgaaggttaggcacaggcttaccgacaatggttcccctcaccaaggctggtctggctatgccatggctgagtttgccatattgaggacactcggcagcctgtggagagactcacatgaggaagagccaaagcctgccagcaaccatgcttctcaggacactgtacacataagcaaaacagaggataatctcatgttaggtgggatgattgatggtgattatattattgatatagggttgtcatacaatgggagcaggaaggtgctcactttaaaacccaagagggaaaacatagtgatcctaaccaaaccccaaaccaaccaagccaaaccaacccccaagggattgtctggtgtgctggttgcaggggaaaaccagtagagtaagaccaccaaagactctattctttaggaatgaataattgggttttccccatcagatgtctcacatctgtaggaaatgtggtattgcgtttagatccagaagttgtgggtttgaaccctggtctcctgtgtgatctttggcaatacacttaaactgtttgagtatatcaacatcttatgtaaaatgtaaataataatttttccatctgtttcgcagggttattgtgaagattgagtgaggttagtgttgagaaaatgcttttgaaactatgaagtgttctacaaacattataggtgttaaaaatgaaactggcatgctgacgaatgtcagctgttactggagtctagttgagggcacctggggacataggctagctatttctcatttctttggctgacagagtgataaaagaaggtgc

SEQ ID NO: 468640 - DNA, 486 bp, Homo sapiens
tcttggaaaaccaggcttaggcaatgatcagtcacctggtgtccagtggtcagctgttcagtgtatactgttgcctacaagcagcccaagagcagtttcacaaaaggatcttgattgtttgccccaaagggcaaggtttggctcccaaatctgtgattcacctcttggatttaccgcaggctccagtgccactgacactgagcctcttacagtctgctgggcagttgggaggcccagtggcggaactgcagcgtgggccactgggagagcatttgcttcctctggcttttaggacatccgataagtgggttgaagcagccaacccaaaaggactatatgtcgcttcccaaatccagataactacaagaggtcttttcttactgtagggagcaaaagacacaacaattgaccagcattaatgttaaaatagaggtcatgagattgacagaatagactctttgtggcaataatatatcaaattatgaa

SEQ ID NO: 468641 - DNA, 878 bp, Homo sapiens
cgcccctctttcatccccatcttcagtataccacaattatgtttattatgtcccataaccgaggggccgtcatggccatgaaggagaagagctgtttggctatagctgcagacaggcgcttcgggatccaggcccaaatggttaccacggacttccagatctttcccatgggtgaccggctgtatatccatctggcccggctcgtcactgacatcgagacagttgtccagtgcctcaagttccggctgaacctgtgtgagttgaaggaagactttatggtcagtggcacctgtgcagaacaaatatatgaaatgtgcgagtccctctgggagtgcaacatggatccagaacagctgtttgaaaccatcttccaagccatgctgaatgctgtggaccgggatgccgtgtcaggcatgggagtcattgtccacatcactgagaaggacaaaatcaccaccaggacactgaaggccctaatggactaaccctgttcccagagcccacttaaaaaaacaaaacaaaacaaacaaatatatatatatgtatatatcctttcttaaaaaaatcaaaataaaacattctatcattttgtttaaatgttttatacactattttttcctattgtatgattagtggatctcaaatataaaaatataaaaccaaaacaacataatgaacacccaaatccattccacttagagcttatcattgttaatactttgaaagtcactatctgtagcccacacttaaggagtagggggttatgtcttccctccttgagggcaagctacctacacttttttatatttacatatttttacatattttatttatatattatttatatattacatatttacatattttttggagttttt

SEQ ID NO: 468642 - DNA, 401 bp, Homo sapiens
gagaacgggccatgatgacgatggcggttttgattgagtttacgttaagtattgagacccagaactctgcctcttgggcaaagccaagcataaagcagcaagccctcccagaattagacggctttccacggacaggagaacagatacagcagacacagaatgactacagaaggcgaaaacaagcaaaaacaaatgtcactccatctggttttaagccaaataagccctccaaccctaaccaaggcaaaggagaactgcctttccacagaacacacctgactggtttcagtacttgttttcccacgagtacccttgaaactcattttaatccaaaaatgaaaactatgggacaagcacggtggctcatgcctgtaatcccagcacttgtgggaggctgaggc

SEQ ID NO: 468643 - DNA, 622 bp, Homo sapiens
gcacagctagtacaaagcacgcagaagaaagtaaaagtagcttgttaagtccacttgcgcgctgtctctctctctctctctctctctctctctctctctctctctctctctctctctcttccctagcggaatgctttccttcttctactcctgcccttggacatcagactccaggttcctcggtctttggactgtggaacttgcaccagcagtctcccgggggacctcaggtcttcggcctcagactgggggcttcactgttggcttccctggttttgaggcttttggacttggactgagacacactactggcttctctctttccccagcttgcagaaggcctatcttgggacttcttgtaatcgtggtaggcacccaagctggtgaggggcagcttgaggaaagaaagagacaagtatccctggtctttactgtggttagggaatgggaccgggatgaggaaggagagaagctgctgcagaaagataagagcagcaagcagagaggcctcctcaaaacaaggaggaaaatctaagtgagttcagaacatttctttccactaataaagagaacataaatgttaatgtgatcctgaatattaaaataatctttgtttaaaatg

SEQ ID NO: 468644 - DNA, 809 bp, Homo sapiens
ataatccattgctctgagcaaatgacattggctcacagcattaggaaaatcgaggcagtgaggaggtgtggaattcaagtaattttacaagtggatattctttttggatatgggcttagatgcattggctgtaaaaatatacacattggaattcaagtaattttacaagtggatattctttttggatatgggcttagatgcattggctgtaaaaatatacacattgctccattttcaatctggttgtcagagtgtttcatcaagtggaatgtgagaattctggacagtaaaacatacagcactaagcagactctattggttggatgcatattggatgtttatcctggaaccaattacttaaccaagtctgacagttgtggtcaagatactaaaagtgacacttgtaaagtggagatgaaaaagacatggctttctaacaaggagaagactgagctccaaacaagtcataatcctagagacaggtacctgggcaagatgccagtagcacctctccaaaactgtgacagccaagtgtctccaaacattgttagatgtctcctggggggcataatcattcccagtggagaagcactgatttagaataataattaatgaatcaacatttaaatgaatttaaacaaataattattagatccaaatgaaaagccatccatcataaggtgatgtgtagcaccttttgcggctgcaagttttaagttgtcaccttagggaatatttttcttaaaaattagtattaacttttgaggtagatgcagacatttcttctgtatatttgtgtctttctgttt

SEQ ID NO: 468645 - DNA, 514 bp, Homo sapiens
cggagatgatcataagatttcctttgaaaaaaataactaactcagagcctagggctatgggggtctacctggcactgggttttatgggggtctacctggcactgggttctacctggcccactggggtgggcctggttttagtgtctgagatgacctgttctaaggcagtttcccactacaacgtgcctgaaggaaaacagtggcagctggaaaaacccttttcaaaatctgtatcctcagtgaaaggcaattcagcagtcgtttgcacaaatacaaaatctccagtgcaaatacaggatcatttcaattacctcctagaactggctaacagttatcaacaactgaaacatgacatttcattcaaaactagcggggaccatgagtgtggaggagcaggaaagaaccagccaaagactcaggaagccccagagactcaggaagctcacaattatgccagccactccagccctgcagctgaaatgcccttaataacagtgtatttttaaacatttct

SEQ ID NO: 468646 - DNA, 570 bp, Homo sapiens
agggttgctaaacagggatgcagagaaatgagtttggttgtcaccttcctatcccacaagattgttgtgggagagaattatgccatcatacccagcaggaaacagacactgaagacctcagtggaagagctgatcctggaaactggccccactgacttcatcgtatcatggtttaggtcctgcacactggactgtgaaacaatggcttacatctgtaaagggatcaatgcctctattcagaaatcacaggagctcaacgcaggaataaaaagtgatctttattcccaagtgtcaactctaattgattggcagtggctttttggagaactggactgcactgaaaaggacttgaaggggtttggagtagggaaatatgccattaactggccacacagtgagtaaacggcaaaattcagggctttctgacttcagagcccatatgcttgaccattatatgatactgtttatgagctcacactgagctgtttggtcttgatccatggctagactctgatctctgagaaagttatgaatgaccctccaaaccatgatacagtcccccttgtgctg

SEQ ID NO: 468647 - DNA, 876 bp, Homo sapiens
cagccgtgctaaggcatgtaaacaatcatgttatcagcaaacagcaacagtttgatttcctccttactggatagtcagacgtgtgacacggcactggcttcccctaaaacaagcattctacgtgaggatgctgctgcttctttaaagcctcagaaaagcaccaattctgccatattctactggtcaacacggtcacgatcagcccagtttcaaagaaagggaatacatatacctcctctcactggagaggaatgtcaaagaaattgtggacaagcttattccatcacggggcccttccaaaagcctccactggcacactgtacttgcctcctcgtgacatttaaactgaattgtaaactgcgcagtcttagtcaatattgtgacctccagagccagcacagcatgattgatgagtatttattcaatgggtaaatgaatgaaaattaagaaggtttgccttatattttataaacccccaaggcttctgggaaacggaaacaagtcacccagatatattacctaaattaaatcactaaaatgagttactaagagaggtgccatagaaatgtgtatatatgtatacatttataaatgatacattatatatacacaaatgtggtagttttatagctatatgagagaacagaaataataatgctacaattgaataactcattacttatgtagtgcttaccatgtaagcccatcatgagaattgcctcagtacaagaaattcagatctcttatgggatgaattgtgctcctcaactcctcaaaaaaaattcatatgttgtagccctaagctccagtagatcagaatgtgattatatttggagacagagtattaagttaaagtgaagccgttagcacaggccc

SEQ ID NO: 468648 - DNA, 578 bp, Homo sapiens
tctaaagatctgtgacaattcttgaatttctacgttttggtaccagaatgatgctggcattcaaggagcatccctgggaaagagaatacgcgcctaggggtaggtctatagatggccccccagtaatagacctaagaaatgagatagacagcaacacgataatagtgggggacttcaatactccaccaacagcactgcacaagtcatcaagacagaaagtcaacaaagaaacaatggatttaaaatataccgtggaacaaatggacttaacagatgtatacagaacattccattcaacaagcacagaatatacattttattcaacagcgcatggaacttactccaagatagaccacatgataggccagaaagcaaacctctataaatttaagaaaattaaaattatatcaagcactctctcagaccacagtggaataaaactagaaatcaactccaaaaggaagcttcaaaatcatgcaaatacattggaaattaaataacctgctcctgaataatcactgggtcaaaaatgaaatcaagatgaaaatttaaacattcttctaactaagtgacaatac

SEQ ID NO: 468649 - DNA, 571 bp, Homo sapiens
ggtataacatgacccctgggttcagcccaggaccactggctattgatatccacagatttcatatttacactgcctatgaccctaaaagaagatggtgtgcaattctgcagcaggaacaactgatggatggagccagtcaccgggatagagttgaccccatttataatctgccacgcaatatgcaatggataaatgagactggggtgaagaacacttctgggctcccaggagtaaaggcactgaagtcaagagcttctggaagaacttttgcaagcgcttgcttttcactcacacccatgtccttgccaagggctggctgccggtcagacctgggagagaacccagagcaggagccatcctcctatgccttctgtcttttcagctcaatcagcagcagcaggaggaaagagccaatcgactctgcacttcagcacctctcaggaacagccactgcccaaaaagaaggattttgctacaacctcaagttcagcccagccccttgtgcccaagaacaactgcagcaatttccacagccactgggaaccattcgatagtctctcttctgctccat

SEQ ID NO: 468650 - DNA, 749 bp, Homo sapiens
tgtctgatggaagagggagtcattctctggaaggacatcatattccatcaccactgaagttgccttgtatattaccatggctaaaacttcctaccctcagccattatgtcagcaggcagtgaaggctacatggctgttttcagcaggtgctggttctaccctgaaagctgccccctggtctagacctcagcatgccttgccacataggaaagtcctccagaaagccattgccattttaaactctggctcagtgttggggcttctctcagtgacacctggggccaggactggtatttgtttatcccgtgtcctcactctcctttgcagtcagaccactagaggtttctgggtcttgaagggaggtgtcctttcaagaagggacttagaaggtgcagtctgggctagcaagagggttgtggaagaggaacagagagccatgcttagagcaggttcagtgtctagcaaggaacttcagtgcaaatggctgtaagggcataaatcctgcaagccaggaatagtgaagtggctgccctaccagagagcctcaccccttgggttaggggttggggtggaggaacatgtgtgcacgtgtgtgtgcatgtgtattcatgcatgtgcatgcttgtggaagtgtgtggtgttcacaacacttgtgtacgtgcagaaatacaaatatgaaacttggaaaaactgccatgggaatgaaaacccatgaaagtctgacttctatatgaatgggaggtacctgc

SEQ ID NO: 468651 - DNA, 1123 bp, Homo sapiens
ggcacccggctggtcagcagcgcggccagcgtctatgcaggcgctctatgcaggcgctgggggctctggttcccggatctctgtgtcccgctccaccagcttccagggtggcatgggcctgggggcctggctgcggggatggctggggaacgagaaggagaccatgcaaagcctgaacaaccacctggcctcctacctggacagagtgaggagactggagactgagagccggaaactggagagcaaaatctgggagcacttggagaagaagggaccccaggtcagagactggagccattacttcaagaccatcgaggacttaagggctcagatcttcacaaatactgtggacaacgcccacatcattctgcagatcgacaatgcccgtcttgctgctgatgactttagagtcaagtatgagacagagctggccatgcaccagtctgtggagagtgacatccataaactccgcagggtcattgatgacactaatgtcactcggctgcagctggagacagagattgaggctctcaaggaggagcttcttttcatgaagaagaaccatgaagaggaagtaaaaggtctgcaagcccagactgccagctctgggttgactgtggagccagatgcccccagatctcaggacctcaccaagatcatggcagacattctggcccaatatgacaagttggctcagaagaacctagaggagctggacaagtactcgtctcagcagattgaggagagcaccacagtggtcaccacacagtccaccgaggttggagctgctgagatgacactcatggagctgagatgtacggtccagtccttggagattgacctggactcaatgagaaacctgaaggccagcttggagaacagcctgagggaggtggaggcccactatgccctgcagatggagcagctcaacaggatcctgctgcacctggagtcagagctggcacagacctgggcagagggacagcgccaggccaaggagtatgaggccctgttgaatattaaggtcaagctggaggttgaggtcaccactaccaccacctgctggaagacggcgaggacttcaatcttggtgatgccctggacatcagcaactccatgaaaa

SEQ ID NO: 468652 - DNA, 538 bp, Homo sapiens
atatccagtttaccttctaaatcgggagaaatgaacacatggaaaaggcactaaccaccggaagcaggggccggcgaactatggcccgggagtctgccacctgttttacagataaatggagcaaagctactgtcagaccacaggaaggcagagagggtacatggaggataaatcccctgactgttccttctcccactcctgatctacttctggtgaccactattagctcaactcaccagaaaccagccaacaaagttgtctgggtgtttctatcaataaaggtggcttcccagacctcagagcaagacacagaagggcagagaatggacctaggagcaaaagtagaagaaccagggcatacacaagaaagtagggagaagggtacccatcacccaactccaacaattaccaatatttttccattcttgtttcatctctctctgattttttttctggagtattttaaggcaaatcctagaaaccatattgtttcacccaaaattagcttagtatgcatctacaataaataagaactgtt

SEQ ID NO: 468653 - DNA, 727 bp, Homo sapiens
gcagtggtgaacaggtttgatgtggctcctgttagcttatgggcatgtaagggaggcagacagtcagcaggtaaatgagaacagaaaacgattctcaactgtggttttgccagatggtttttctctttactgaagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgctgttggtcttcgttgctgatttaaaacttcgatgccattttaggtggtttctcgtaaatttaattcagtacctggcagattatgttccagatgctattgcaagtgcagtggggaaccaaggaagagtggtgaagtagaggatggaccaagtgctctgagaactagctaacagaacagttaatgacagggagagggaggtaaggtttcagacaggaagtgaaggttgagctatgcctttgctcttcagttggcagagcaggaagatatttcagggagagggatagta

SEQ ID NO: 468654 - DNA, 657 bp, Homo sapiens
tatcacttccgtagcccagcagcagatgggtagatgggggcgatgaggagtgccagtgacaccatctgttcctcaggcctgttcctcatctggccttgaatgagcccagcggtctcaggactgtccagggcccatctgcttccctccgtcaccctgtccacccacagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatcactttcatgggacaggagataaagaatgcaaaataatcagctagatttggcctagtaccagctgtcaagaaggtgtgagagcctccgatgggacagtcttcaagggctgctaccccaggcctcacctgccctagattgtttccgaaggaggaaaaacttccccc

SEQ ID NO: 468655 - DNA, 679 bp, Homo sapiens
ctgcagtgggtggagagcagctccagctcacctttgcagggtctttatagaggtaataatcaagttaaaatgaggtcattaagcaaacacaatgtactgactctaaaacaggtacgaccagttgctgccaggccctcaaagacacagtgttctactgtggaattagccatacataatgggcccattgaatcaggcagcaggcactttcctctctgggctgcacagatagaggagttgggcctagaccccagggactggtggaccctggattttcagacccaagtgacttgcccatggccacagaagaactggtggcagatctgcttcctatctgtagctctttccactgctcacatggccacttgtgttcagcagctggtgactagaccagctctcagttggcagcagcatagcaaatacagactcctgtggacatctagtaatgctgtgatatggatgattgagcccactctgtgctatgcacattacctacatcagctcagtaattttaaaattcaaagcctatgacagatggctgttattatattaatggccttctcaatccctaagataaacttgatttttcacccccataacttacttttctttgtgttttgtatccccatctcagtaaatgctataatcctgtactcagttgctcaagcccataagtttggag

SEQ ID NO: 468656 - DNA, 532 bp, Homo sapiens
cattggtcagagttgacatttgcaatgaagctgcttccctatgcctgctgctctccaagaagacgtcataaccacaagagatctgaatcagcccattttttcccctgtggcactgtgtgctttggctgcctggccagaaagctgggactgtatttacctatcattttgatactatcttggggtgtaattggaattgagctcttagtgtggaaattcttactcagaacacaaaggattgaagagtgcttggaggctgaactctggaaggactcttccctgaggcctcttggcatctggctcttgtttcttggagcggtggcaggggcgcctggaacatgcttgtccaggaaatcttccactcagttctgctgcctccatgtcccagatgatcacagaagcctcctgagaagggttgaatcccccgtcgcctggggatcccaagaaagctgcagaggaaagactttctcttccaagatcagaacaaaggacggttagcattgtgcccagtagtgccaaaaggtgagggagatct

SEQ ID NO: 468657 - DNA, 708 bp, Homo sapiens
agcaccaccccctgctccaggcgccccgtcccatcgaccacccaagggctaaggaatgcgagcgcacggcgcaggactggcaggcagctccacctgcagccccggtgcgggatccactagggattgtaaatacaccaatcagcaccctgtgtttagctcaaggtttgtgagtgcaccaatcgacactctgtatctagctgctctggtgaggacgtgctcaaggtttgtgagtgcaccaatcgacactctgtatctagctgctctggtgaggacgtggagagtctttatgtctagctcaaggattgtaaatacaccaatcggcactctgtatctacctcaaggatggcttgtaattggcttaagccagtcactatgcactggtctttccaaaataagcaaacaatgcaatctaagacaactcagtggaaggagatattggaacctctgagggggtaagagttccacaagacactctctttcctgaagagtggctataaggactagaggtatgacctggttggcagccattttattaccaagagtggggtgcctggggctgccaggaatccactttgtggagaataaaaccagtagagcagagagcagagaaaaaatatggagagaaacaagtccttagttgaaatgagttgagctgttggatcaaattatacataaagtcagatttcaccgtactttcagttaaataaa

SEQ ID NO: 468658 - DNA, 3066 bp, Homo sapiens
gtctgccctcctcagacctcaactgagccttcagccgcccccagaatccctagtgctgactcgggccaggcagcgtcaggagtctcaagaaaacaaaccctggagattggcaggtctgagagcagggcggggggccacaccagtctcgttcaccttctatccccagtgcttagtctttggcacgtggccatggtccctctgaatgagaagcgtctacggatagcagcggcaggactatttgccctgctagtctcccctcctcagacctcaattgagcctttagctgccccagtgaacatcacagtggttcccaggggtgcctctacagcaccttcatgccgtctccagcccagcagtccccagctgctcctgcatgctggaggtggggctgctgggagcctggccagctgtgggagagtaggaagaagtgggtccctgctgacctgtccttccttaagctttgtcctggaccttttccctctgaaccttgctgccgacgaagatggagcacctgcggaagctctgtactccatccagacaaacagtggaagctgcacggatagtcctccccagggctggagctgccagggctcagaggctaccacaacacagaactctgggcctcactacacacgtgtcctggcctcatcctgaagcttctcacttttctaagctatgcattcagcgattcctgcagggggagcactagtccagaaagaaggcccgccatcagctgcccagtcccgggacagtgcagacctggctgtgatctgcctcctttcctcagagccccaccctgtggcaccgtcaagtgaggctcctttgtgatcgctccctcacgagttgtaaagagcggttctcttctctgttcacaacgtggggccatttgccatgcccttcagtcccactgtccacactagtttaggtgtagccctcacctggactcctgacatcctcctaacaggcttcaccccttctgttgtcccctgaaatccattctgtgccagatggctgagtggtcactttaaacccatcagatgtcatcactcttacacttaaaacctgccacgaggctcaccataacacctgcgctccttgtcccagcctccccggctcagtgggccccctctcctccctgcactttccccaggcatgctgacctccctctgttcctcaatcacattgaactcccttctgcacaagaccttggcaccaactctttggtcaccctagaatacacttcccccagatccacatgtggctgcgcagggttcagccccagtgtgaccttctcagggaggcttccttgaccactcaacccaaagtcacagagcatcttttttacatatcacacttgctgaaatgatcttgtttggcattgtctgtgtactcccactggaagacaagctctaggagagtgtgaaccctgtttgtcattttcactgtggggtccccaccttctggagcttgaattcccttctctttagagctctgcgggagctatatctttgtcacggttctgaatcttttcaacaaacacttttgttaggcaggaggtccagcagccccttgcttttggttttcaaaacttaactaagattcacaaattagagctcagatccaatctcagaggacagagaatactccagttgattggcttctctttctttgatgtgaagccctttcatttctcctacctgcctgctgccttgccccacgccatctgcctccaccctccacagacgggcccctggccccagccctactcccttgccacccatccatcaaaggaagacaagatcggctcaggagcccctgagcttatctgaatcaaagaaaactaggaaaagaagatacaaacaacatgcagggaggggaacagggctatcagaggccctggtcacagaagaagtcagccaagaagcgtgccaggtgtctgtgagggcgcgcaaccctgacccagtgactcacagcgtgatggactcactcttggtcaagctttcccctgcatgaacagcacccactgagccagggagactctaggggaaagtcctagagagctatgtcttaacaccagctttgccttgcaatttttaaggtgtctgcatctgtttattcccttgtctctttatctcctctttaaccactgcccccaccccctgccccaggtgatatgagaaagaaaataatagcaatgtgagccagacactgttctgagccttttaaatgcttagaatgtttcattcacacaacaaccctgtaaaatgagaactattattccctttttttcacagaaaactgggcaccggggaagttatgtaacttgcccaagttcgcataattagtaaggagaactggaatttgctcccaggcaatcttattgcagagtgtgtgctcttagccactctaccactttttctctagtaggataatggaggcgaacaagcctgttaactgtgacacccccatgtaagcattcattgtttttcaacctcttcttccctggcttctagcatcctctgtgtctctattcgagtttttctgccctggggcacagaggtgcccaggtggacccctaccttctgggaaccaagcacccagtgcacagcctggcataacaggtgcacaggtgtttatacagctggactccacctaggagggtggttgaggaatgagggaaggaggataaaatggtggaaaagctggaattcatagagattattgatcattctattagtaataaaaaatagctaatgtttactgagttgtaattccatgtcagacatggtttgaagcatttcaggtatcaaatgaaatggttatgctgttgataagggtaagattatatatcagataagttgatatttggaaagcttatgctgtccaatctcacagatggcctccagggatcctcgcctcctggtatccttatccgtgcttagtcccagcccaaactgagtcaggggtgacctgtgtgacgccagtgcatcgtgacttcccccttggtctcttggatcactcactctgagggaagcctgcccccatgcagggaggacacttaggcgg

SEQ ID NO: 468659 - DNA, 591 bp, Homo sapiens
ttaccatcaaaatgtgggcatctcatggcattttattgtctttgagcaagctgttctttccaactggaatgcttctcattccaaattgttgccttcctaaattcaaacttttgcttggccttcaagggcccgatgaaataatttttcttgccaaccccctccccccacgacagctgggagcaaccctcacctctgcttcaatctgtactcttccaggctggctgcctgtactctgcctgccaacgtggggctgtgggggcagcatccctcacaagtctgcagatgtggacctgggcttttgtgaaaaccaacacccagttcctgccatatccccaggctctttccacaggagagaagtggcaggaaggaacgcagccctgacactcaaaggaactcggggcatcctgcctgttcgtgtccacactgcagtaggtttatttacatcagcaccaccccaagtgtgagtaatgtgctattgaatatttagatcatttatgttcattgccaacacgattgcaaaaagcatccttttagccaaagttgtatgcacatttctttgcataaatgaagagaagttaccaggccaaaggg

SEQ ID NO: 468660 - DNA, 940 bp, Homo sapiens
tgaagttaagcatgaccacgggtcttgctttggacatgcaatatgtctgcatgttgggttctggagatgcagcagggaacaagacagactcgttcctgcctctctatcactttcaattcaaaggaaagggaagttgatacagtgaaaatcaaaccaaaccgacagcaaataaaaacaggctctacctctcccccatccaaacctgagccagacttgggaataaatgtgaatgagcatggccatgctgaacttctgcgctcccattcccttccatctgacacacattttctgagcatcttgcaatatgcctacaatgtgcctggctgtgagcttagcgggattctggaagtcagagaatgtgaaatgatgatgatggggatggtggtaataatgatagtgatgatcgtggtagtagtggtggtagtagcgatgatgagggtgatgctgatggtgatggtgatgggtgataatggtgatgatagtgatgatgatggatatggtggtgatgatgctgatggtgatgatgatggttatggtggtgatgatgctgatggtgatgatggtggtgatagtgatggtgaggatgctgatcgtgatgatgatggttatggtggtgatgatgatggttatggtggtaatgatgctgatagtaatgatgatggttatggcagtgacgatgctgatggtaatgatgatggttatggcagtgacgatgctgatggtgatgacgatggtggtagtgatggtgatgatgctgatggtgatgatggtggtgatggtaatgatgattatataatgatgattgtggtgatggtgatgatgatgtttattatagtcatgatggtggtaatggtagtggtggtgatgatgatgatgatggtagtgatgataatgataatggtgatgagagtgaggatagccaagatatattgagcactta

SEQ ID NO: 468661 - DNA, 626 bp, Homo sapiens
tcaatttccatcccacatgcatgtgggggcatagtgacacagctgataagacccccgagggcacctcccactcacccactaatcaaccctctggggaagcatctggaccacaggggatgatcaatgacagagtagttgctcagctccacacccacggtccatctggagagacacccttggattcaagactaaaggcttccaggaaaagtggcgaggctcaaggtcatcgttcaaatttacagagttttggactcaggaaggtgatgctggagatattgtcatgcttctgcaatgctggtagctgtgtcaaagaacatctccggcaacagccatcacatcttgcagccttcaggtcagcttggaaagaagccacagcctcgtttcattcctgcagccctagcaagcgctggaaagctatgaggttgctgaatgccttcttccagcgcatttcaggtcctcccttgcctcctccttctttggcctattccaaagttcaagatcccttccctcaatgctatagcttcagcatagccattgttgacttttatctcaagggaccaattgccactgtcaactcattcagagtggaactgtttggagttctgctttggaaatcataattccct

SEQ ID NO: 468662 - DNA, 763 bp, Homo sapiens
agcagcgcctcatcagccaagcctattttttttccataaacctaaagccatggcaaagggacagcaagactcagccaggatggcagcagactcattggttgctgcccctttgaggaacttttctactttaactcttccctgcctctgccgttcagcatcaaaatgttattctctttttcaggactccctagacaaacaagagaggcgttcactcagcaagaaggcagccaagccaggaagacagccctcaccagaacccaactatgctggccccctgatgtcagacctccagcctctaaatgatgaaaaacaaattcctgttgtttataagccaccaagtctgtggtattttgttatagaagctcagaggaaagaagcttggatccactactccttcctagaagtagcacctgagatgcaaattcttgtcaataagtacaccatagggactatttgtcaattggtgaagtatgaacaaactctgtagattaaatcataatagtgtgtctgtatccatatcattcctcttattttaatagctgttctgcagtaatgtaagagaccatccttgtttttgggaaataaacactgatgtatttaggagtaaggtgacattaaaccttcaactgattctcaaatggcttagaaaaaaataaaagcaggaggataaaaccaatggggtaaagtgttaacatttggggaaactgggtaaggagtatacagaaatttttttgcaacttgtgtacaggcctgaaattatgct

SEQ ID NO: 468663 - DNA, 764 bp, Homo sapiens
tgatgtacagaaatcagaggttactcagtgtgaagacaatgaagatgaagacctttatggtgatccactttcacttaatgaataaaatcctgcctttgttccctagaagcctgctctctaaggactctaaggaagcattcttgctggagtcatctggagccacctatctatgccactctgccccatggggccctacatggagactgaaaagaaaacaaacaaacaaaacccaacaagctgctctgcaaccacaatactcactgctacgtgtgtatccagcttgttcttggacaggctttgcactggacacccaaaacataccacctggggcctgcttggatcaatcctggtacctggaccacttccagagccgaggtcctatttgcagtccagtagttgggcattgcacactgctgtatacaacagctgcttcacacaggactgcagaactgaactgccctcatgttgcttcaccttctgtcttcttcactgtgcactggcttaagaaaatagcagagctttctccaattctccaccaagctgactcaacataaagcaaagtttcaaaaggtttgaaagggaataaaggtgaaagtgaagggaaaattaagctcacaaatgaaaatgaaagataaagtagcctttcttttctctggcctgattaagcttagtactctttcgttgatgaaaagaggatccaacatgaggattttaagcttgtgctgtccatggtggcttcatatctagaaggtatttttaataaa

SEQ ID NO: 468664 - DNA, 1246 bp, Homo sapiens
tcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagcattcattgagcacctactgtctgccagagtaataaagcgctgtagaagcaaagcagaaggaaggtgtgttttgactggagggaccaagcaaggctttgcaggggagagagcctgatactgaagtgactgtgctttcgatagtgggaaggaggcctggaggcaggagagaacggacctgttcagggaagggtgagaaatgccccctcctccctgagcccatgacccggcaatacccttcttgtctgtataccctctcgtcttgtttcttgcatggtgtgtgcagcagtacttgacattttgcagataccttttgcttgtttataattctcaggaccgctctttaaggtagctcatgactgcagtattcatcttatgtggaagggtcatttgtacaggggaaaccacagaggaaactgagccccagagaggcaaaggcctttgccaagtgctataatggcatattcaaaagtttttaaatctcccaatatatattttaactaatgcaaccaaatccaaatttaactcattccactgaaaggcattgtttttctccgaagaaggtaggactgaatcatccctaaagttccttccagctctgccagtctgtagtctgacagtcttgattctgtaaccctcccaagaaaacacaagagttttaagcacctttgtttctttgaggatacccctgtgtgtactccactcttctgatgtctttctggactcctcgatccttgtaaaattgattctgtttattggaggtgaaattcattgggtgattcctgtgtacaacgtaaaagttctgtcattaactgaatagccataaaaagcctttaaatctccgtaaagcagctgttagatgagaaaacttagttccttaaagcttttcaaatgagcacagcacaaaaagaaatgaaggtgctgctgaatgt

SEQ ID NO: 468665 - DNA, 839 bp, Homo sapiens
cagtccagttcatagcagcagaagcagtggccgccagggatggggaaacaaggtgggagttgggcagcttgtgtttcatgggtagagtttcaggttgggatgatggcaaagtcctggaaatggctggtggtgacggctgcacagcagtgtaaatgtgcgaatgccactgagctctggaatggaaaagtgatggtgggaatcggaggagccatcttgggctgtgcaacggaacccgtgaagtattgcagagtgaaaaggcagaggcaggctgggccagcaatagcttcacaaagagctgccaaaccaacttgggccttcgtaggaggaagaaatacacttcgatcagcagcagctttagattctcatagcagtgcgaaccctattgtgaactgtgcatgtgagggatctaggttgtgtgctccttatgagaatctaatgtctgatgatctgaagtggaacagtttcatccccaaactatccccacctgaccaccccatccggagaaaaattgtcccatggaagctgtccctggtgccaaaaaaggttggggaccagcagttcacagtagccatctccctatggcggtgagcaataaactcaactttgccttatgaaaaggttctttcactggtgtttgagagaagccggcatttgacaatatatgtcaacctaaacaaacaaaagtattttagggctttgctactcagagtgtggggttggtttaaaatgcagggtctcaggccccacctcagtcccgtagaatcagaatccgcattttcacaagatgcccaggtgactgtgtgcacattgcaggctgtggtcttgggcattattcttct

SEQ ID NO: 468666 - DNA, 795 bp, Homo sapiens
gaccaatattagtaaataacacataaattgtttcaactggctttatttttggaagattatagggagacaaggctcagctcagcactcctggtctgcatgatcaaactccggagcacgggtattaggcccacagctttgttctctagcctctcaaggcctgcaggcatgcagagtgcaagagttgaggcttgggagcctccacctagatttcagaagacgtatagcaaagcctggatatccaggcaggagcctgctccaggggaggagccctcacagagaacctctactagggtcttgcagagcgaaaatctggggttggagcccccacatagagtctccactggagcactgcctagtggagctgtgagaaggtggtcattgtcctccagaccccagaatagtagatccgccggcagcttgaactcaggttctgcaagaccagtaagcactcaacaccaatgccagccaatgagagcagccatgggggctaaactctatagtctcaggggcagagctacccaagtctttgggagaccactccttacactcgcatactttggagaatggcccaaatctagaacactgagcaccaagtactggcgaagatgtggagcaacaggaactctcatggctggtgagaatgccaatgatactgttaccttgtgacattttgtaaccattatagaagagaatgaatggattcttagaaacctaaacatactcttaccatataatccagcaatcacatactttggtatttacccaaagaagttgaaaacagtttagctaaagttc

SEQ ID NO: 468667 - DNA, 477 bp, Homo sapiens
ttgctaaatgaaagaagccagtcaaggaaagaggacctacttggaaaggactgtctttaatttgctgaccgtgggcatctggccttgtaaccaggccactcccagcctacgggcagaacggagctgctgggaggacacaggcagggtgactcagttcccgtgctggaaagaggaacttgggtgtctgctccggaccttgtcatctctgccccggagtggctcctaccagtttcctagcctagaaaatgaggatgataacatttcttcactcatcggattatcaggacttatcagtgcctttaatatatcaatgagcattgtgaatttcttcacttaccggtttgtcatggggaccaaacgactacagacaaacaaagccctcagagcagtgtcagaaacgtggtaagcactcggtaaacagcagctgctgtttttacccaaagactggtagacaaggttactattggcaatgtttat

SEQ ID NO: 468668 - DNA, 672 bp, Homo sapiens
cgccgagacccaggtcgtccagtttgacagcccctaaactcccgaggctgcttttgaccctgaggtacgttgcaggtcctggcagacctggagaagccgccaaaatgtttctcagtcattcttctaaaaatggctttgtccttggctctggggctggccaccgctggataggggcagagaaagcagcctgtggcttcacgctggaatgtcattacccgggctgtggggcgacctcacaggcaggcaagctcgagctgggcagccaaaccagtgccgttgtccaagcagacactggctatcatcgctctgctacgtcacgctgtgtgagtctaccacgtttgtcctgttcacctgctaacagatctgtgggtaattctcaagattatggctgtgacaaagaatcctgttacaaactttccaggatgtggcttttggtgaacacatgtacacatttctatggggcgtaccaggagtggaacagctgggtcacaggaaactgcccaactatcttccaaagcaactgcaccattttacatcccgcctgcaccgtatgagagccctcgtagctccctgtcctcgccagcacctggtacagtcagtccttttcatttcagccatccttgtgggtgtgtaccagtggaaatgattattaaacacccacaataaaaaatc

SEQ ID NO: 468669 - DNA, 1154 bp, Homo sapiens
catccgcttacccaagccagaaatgtcggcgtcctcctcctccacatccagtcgatacccaagctctgccagtgctacttcccaaatattttttggacctaatgctgctaagggctccctctgctctccttggatggttggtcttggaaaccagccaccatgctgtaaggaagcacaagcagccgcctggagaggccacgtggctttgctcaagaggctccggagaagtggcctctgtcctgccaagttatggaatgccaccttattgtggaatggtcccatgcagaacacacaccaccccacggaaacacccactccaggtgggggccagaaatccgttgtcttcagtgacttcctaacccaggccagtgggatggtgaagctattgggcccaaccgctgaggattcaacaagggagattgtgaacgctccaagaacagcaggttccacactgaaactcagtagccactttgaaccaaactgtgtgtgttttcagaagtatttcttcttgctgaagacccgagggactgggctttttgagggtcatttctccagtggatttagcctgcctgggaaaagttttagacaagcagcaggggacaggggaaaatagaatcctggaagatggctcctgttctgtgattgcattttaaaaatctccaaataaattctccgctgtggaaaggtggacatctgttcaattctgcacttaacaaataataagaatttggaaggggtggattttgttatggattcagaattgaaatttcatgctttaattatttttaaaattttaatcattttttattaaaacataacttacacataataaaatgtaccggtttgatgtgtacagttgaatgagttatgacaaatgtatatacacccagctaaccaccaccacaatcaagattccaaatatcgcaatctccccaatcacataattattctgagatttaactacatgattgtgtgtgttaattgtttttttgggttgctgagtactattccattgtatggacatgccgtaattagtttgtttatccatccacctgtcgatgaacatttgggttgtctccagttttaggcaattacgaataaaattgctgtcaacatttgtgtacaggtctttgtgtgaatttgtaagtcttcac

SEQ ID NO: 468670 - DNA, 896 bp, Homo sapiens
gagaagaggggagagctctgtccaacagctgcccctgaggtccttggcaggatttaatttaattccccccaggacatcctgggattccagtgagggcatctggagggaagccgtcacagccggagcgaccgtcactaggggcagcgtccctccggtgccgggagcgcgccaagctggtgttcctgaatgcttggtccaattgtgtgtgtctccgaggccgttgtgtgtgcaggacctcactccagtgacccacactccacttggcggtgtccacatcagcaggacgttcaccagcctgaagagaagtaagtatatcaatgataatagtaatgatcttctccatcactatcatcaccatcaccatcatcaccatcaccatcatcatcaccatcatgatcaccatcaccatcattatcatcaccatcaccaccaccatcatcatcaccatcaccatcaccaccatcatcaccaacaccatcaccaccatcatcatcaccatcaccatcatcactaccatcatgaccaccatcaccatcatcatcacatcatcaccatcatcacaccaccatcaccatcaccatcatcaccatcacattcatcaccaccaccatcaccatcatcatcacaccattaccatcatcaccatcaccatcaccatcatcaccatcacaatcatcactaccatcatgatcaccatcaccatcatcatcacaccatcaccatcatcacaccatcaccatcaccaccatcaccatcatcatcacaatcatcactaccatcatgatcaccatcaccatcatcataccatcaccatcaacatcatcacaccatcaccatcatcaccattaccatcaccatcaccatcaccatcatcatcatcactaccatcatgatca

SEQ ID NO: 468671 - DNA, 553 bp, Homo sapiens
cttggcttttctgtgtgaaaatgcctcatgaagaaagcaagtctatatttccggttgcccacgggtgtcttttaactggcctgtgcaggccaagataggcaaatacatgtgctcctaccatctgtgtcgtgtggtgccttctgggagtgtcctgggcctcatggaagtttgggttcctaaccgccaggaggccagcgggcggcagaccccaccccaggaggagggagcaccagcattccatctccggaccctcagagctggaggggcgatgcccatacagtgtcaactctgcactttctattccaaagacacaggctcagggagaagttgcttctgggggaggagggcccactttcatttagatacttttacaaataagcacccgatgtatccaacatttttggaacttagcaattttggtttagagtgcccagattttccatttgaaataaactgtcatgggacctgccgtggccagtgctcaccttgtactgctggaataatttaacaatttttttcaactgccatcatcatcatgccattttatgtcttc

SEQ ID NO: 468672 - DNA, 1664 bp, Homo sapiens
agcgccaagggtatggtaaataacactggtattgactggttcatgccctggcctccccaagccctccatgcggtcgcaaagtcctttctagggtataatccaatgatcccggcagaaaatatagaaaatgtggtgaagcatgttgtcttggttcaccaatccgtggaccactacagccaacagtttctacagaaattgaggcgcagcaactatgtcactcccaagaactaccttgattttattaacacctattcaaaattgctggatgagaaaactcagtgtaatatagctcagtgcaagcgtctggatgggggactggacaagctgaaggaggccaccatccagctggacgagctgaaccagaagctggccgagcagaagatcgtgctggcggagaagtccgccgcctgcgaggccttgctggaggagatcgccgtcaacaccgctgtagagggtggctctggctgggcccgagtgagcgtaggaagaggcgatgagaggcagaaggaggagatcgcagggagccgatccccgctagggctcaagccaacctttgaggactgcactctgctcagagccggggccgcgagtgcatctcctctgagcccaagctttactcaccccctgtcctaccctgcagccgaggagaagaagaaactggcagaggaaaaggccatggagatagaggagcagaacaaagtcattgccatggagaaggccgaggccgagacgaccctggcagaggtcatgcccatcctggaggccgccaagctggaactgcagaagctggacaagtcggacgtgactgagattagaaggagatcagtcttcctggccccacacacgggtctcgcagccgagaggctccgttcctgggtcagtaatgggcttccattctgggctcccgctggagcggtgcatgttccctgtgcttcctatttctctgcctctgtgctgcctgtgaaggctgagcagcgctccttgtccaagtcgtttgctaagcccccgaagcaggtgcagacggtctgcgaatgcatcctcatcatgaaagggtacaaagagctgaactggaaaacagccaagggcgtgatgtccgacccgaatttcctgcggtctctgatggagattgattttgattcgattacccagagccaagtgaaaaacatcaaagatggtatcggatggaacaggcaactgatggtcaccagaggaaaacagcagccccatgacgtgacccagggagagtggctggggatgcgcggcggcagccgcctcttgaagactcttaataccacaactgaagaaatggaagctgtcagcaaagccgggctggggatgctgaaatttgttgaagctgtaatgggctactgtgatgttttcagagaaatcaagcccaaaagagagaagatgtacatgtacatgactgcatctgaatatactgctttctgcaatctggagattcaatactgccgaaatgactaacgaaaaggcctgtgggccacatgacctaccacatttaagagacactatacaaggatccgatgaattcaggcctggaaggggctttggcaaataactaagccagccctctctttgtaaaaaggaggaaaagtatctgaagtgacttaccaaaggcttgttagcagagatgtctggattaaaat

SEQ ID NO: 468673 - DNA, 1380 bp, Homo sapiens
ggccaggaggaaggggccaggcctgagaggctggtcaaacgccaccatgccttgcagggaagggaggttccacacgccctcggcttcttccagcctgagagccagcagaactgagaccgtgcccttcaaaaagggaagctctgtcagccaccacatcgtgacacttgtctcggaagaaaatgcagatcagcggaatgtgcacaaagacagagatagttactacagcattgagagggacgagaagatgggtgcacgctgcatcaccatcagtccggggctggctgttgaggtggagcctcctggcaggatgctcagcgatgtcacaggcctgggctaccagggagctgctgccccagcccagaatccatacagagccctagctgcaagggatcctggaaacatggtcgttggcttctgctgttcaggaagacggaccaggaagagtgggagacacatgcagcaggcccagccaggtgtctcccactctgccctccagagagctgcctccatgttgagtcttgttcactgtgggaccccaggaccaacagaaaacgtgtttgttgagtgattcaatgagatagccgagtttggaggtgaacccagatctgtcggattcgaatctgtggatcctttccactttaacttgctagagggaccttccccctgggattttagagccctgtcaacttttcacgtgcaatgctgggcttacaataattctggcaggcaccagagaggcctggaggacccttctgagccagggggaccagcagcattcatttttaaaatgagagatccagtatgactggctcggacaggcagaagccagagggaacccaggagggacaaacaagctcagttctaagaccgcaggtcgcacccactctggacaggcctttggggtctgatctccccttggcccaggtctgagcggggcggtttgggccagggctgctttagagttggatgcagcaacagtcaccactgcagtgcaggctctttcaccatctgtgtgtgtgtctgtgcgtgtctgtgccctgggaagaagggaaggggcaggggttggctttccaggcccaagcagaggggcgtcccctgcacctgcccttgtcacatcctcccccagcccccacccagaggcaacctctgctgtcaatttgtcctgtgtcctccccaacctctccctggctcctgccatatgtccctccctgaactgcccactccatccactgttctcacacggggctctttgctgttccaggaatacaccaggcacattcccaccccagggcctttgcactggcccaccttgaaggtggggaattttttccaggagtggctggaatttgatctgataccatggttgaccatgtgaacttg

SEQ ID NO: 468674 - DNA, 905 bp, Homo sapiens
ggcaccgacagtgggcgcgtatggggcagtcagcacgcaggaggggctcttacgccttggcaaggttaaagctagtgtggtaaacctggttttggctaatgggggaatacaaattggggctggaggtggcatctctccagatacgagagacccggcagaacaaaactgggacccccaaatgggacaattgtgaagacttttatgaagagccaattcaaagacatgtgagtggaacaaagaagaaccagttaggagctgtgtgggacccagaggagcttggggagataatggtcatcagagctcagctggaccagcaggacaagaccactgcagacagcacagtggcatccagtgaagactgcagccactgtcagcccacgccaatgaggaaggagatgggcagacacccagtgctcaccttcctctgccttctgatctcctgccagtgcctcccatgggctgaaagccccagaaaccagacagcaaaagagtccatgctgtgctccatgcaggcacagggcagagtgaaccagacagcaaggcagtccatgctgtgctccatgcaggtcagcctctcaggcacagggcagagtggagaaggcatctggaggcacaaatggggagtcccctccagatgcctctgggaagctgcagtgattccctctggcgacgtggagctatcctcatcactaaggtttctggaactaaaagagcagtatccatggccccaaagtccatcgacttgtaaggtcagccaagtcagcgttggctaagactgatttttaatgtggatactctacttcttggcactcagaaccacctgtttcaaaaaaggaggacgatatgcaatgaagaattggaaaaggaagcatattacgttagtgattgtgactagtgtgacagga

SEQ ID NO: 468675 - DNA, 1146 bp, Homo sapiens
agatgggatggcggctgggcagagacgctcctcactttccagactgggcagccaggcagaggggctcctcacgtcccagactatgggcggccaggcagagacgctcctcacttcccagatgggcctgtctgtgtctgtcctctgcaaagccatgtggctctacctggcggttttcgtgggcctgtactaccttctgcactggtaccgggagaggcaggtgctgagccacctgagagataagtatgtgttcatcacgggctgtgactctggcttcgggaaactgctggccagacagctggatgcacgaggcttgcgggtgctggctgcatgtctgacggagaaaggagccgagcagctgaggggccagacttcagacaggctggagacggtgaccctggatgttaccaagacagagagcgttgctgcagccgcccagtgggtgaaggagtgcgtgagagacaaaggactctggggcctggtgaataatgctggcatctccttgcccacggctcccaatgagttgctcaccaagcaggacttcgtgaccatactggacgtgaacttgttgggggtgattgatgtgactctgagcctgctgcccttagtgaggagggccaggggccgtgtggtcaacgtctccagtgtcatgggccgggtgtcactttttggtggaggctactgcatctccaagtatggcgtggaagccttctctgactccctcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgaggggtgg

SEQ ID NO: 468676 - DNA, 1129 bp, Homo sapiens
gctttattgctcacacaaagcctgtttggtgatctcttcacacggacgtgtggaaagggagagagcagccgtggtgttggtgacattacagcagtcgcagtaatggtagcccccatgctgctgcccaactcatacctcgcacacctctattgtggttcaatgcctggtcctagtccacaagaccaacgggtgcacctaagtccactccattcgaaagaagttgattataaacctagctcagccgccaaatcgactgtttctgtgcacatgtgctccaacttgaccttctcttctgttatggtggatgaactgccttcatattcggtcagtcgtcaacgacttctaaaaacttgccctggaaagcatcaatgggcagccacggaggacgctgccacagagcatgagtcaattttctcaaaacaccatgggatgcctggcattttagatggagaccagcggcaattcctggccaaacatctgtcttgggaaactccaggatcagggtgacagtccttacgtttatgctgccagtactgattattttcagcaaatatcagtgttgatatttgggggattttattctactaatgtaatcaacttcatggattactaatctttgtcctccataaattgaatacattggaatacagatgcaattcacttatgctccaaaatcacaaaattgaacatagtcatgatttaattaatattttaatagcagtcacaagcaacatttgatctctttttggttctgttataaatgatttctaaactgtgttttctgcaagtaaggttcatgaaacacctgcctcagaattggctatcaaattgatccatatacctttttgggaaataggcaccgtcatatgtacattgctgatggagataaaatattgcacaatccctagtaaggggaatttaacagtatctatcaaactacacataacaacatgcccataaatgtgtgaatttaaagaattatcactttttcagtcttcgtcgattttttttttccattttagcatctgtattccttttgcttctgacttgaactagtaaccattagtgactataaacaatatgtgagaatttaaatattaaaaactttaaaatactaatgctactcttt

SEQ ID NO: 468677 - DNA, 511 bp, Homo sapiens
aggtaattccaaaattctatccagacagctgcttcgggataacggagaacatgtctccattaagggccaatggcaggtcaaaagctgttttccaaaaggaaagtagctatctacagaggatggcaggtgattctcctaagggggcctaccaaaggctttacacacatccctatttgccactgacatttcagacaccattggatctgctgaatcatatggctcaagtggcagagaagcttgcacagcagcttggacctctagcaaagctttcttttgttctgggacccactcaaaacaagcagcttttaaggttacttgggcaactgatccagaagagagagagagagcaaggaggatgccacaatgccttttattatttagtgttgcccatcactgactgtccctctgccacattccgttcataaaagccagtcaataagtaaagccaacccttatgaggaggagaatttaactacacttttcaaaggagtttgtcaaagatcagatggtc

SEQ ID NO: 468678 - DNA, 1229 bp, Homo sapiens
agcacctccctgactgcagctggcaccatggcagtggccactcctgataggccaccactagcaagcaaaaaccaaatgcacttatttagatgtgggaatgagacaaccagatgggataggctcccccgaaaaactccaactagccagcgcagtcgggtggagccacagagctttgagctatttgcagcagggaggagcctggcccttcctcttgctgtgtggaatccggaattccagtggctggaaataatagcaaacagaagaaagaagtggaagaacccacttaaggctcagaacgaacaatttcttctaagaatcctacatccagataatactactccaaaaataaaaactgaattaataccatgtaaacagacactattagaatttgttgctagcagatttaccttacaagaaatactaaaggaacttctttagcctgaaataaaataacactatcccataaattaaattaatagaaagatacaaagaatatcagaaatgttaaatatgtggattgcttaagtatggggaagattgcataggctgaaaaggagacaaaagaataatcgtgaactggcacaaaggctagtttagatgatggtaatcttctgaaacaggattgtagtaatggttgtacccctatatatattttctgaaatcaatgatttgtgtacttaagtgaaagataaattttatggtaactaatttatatctcaataaagctatttaaaaattaatcaatgcagtccatgatatttacagaataaagaagaaaacacaagtgattatgctaaagatgcataaaggcatttgacataatttaatattcattaatgataaaatatctaagcaattgaagaaactaagaaaacatccttaacctggcaaacagcagaaacagatttctctgatgtcatattacaatgtggaacatcttttcttatccttatttgccatctgtatatcttctatgatgaggtgtctgttgtggtctttggtccatttttaaaattaggttattttagtattgttgagttttaagaggtttttacatattttggaaaagagttctttatcagatgtatcttctgcaaatatattcttccagactgtggcttatctttaccttgctttggcagtgtcttataagaaaagaaatttttaattttaatgaagttcagtttatcaattaatttttcatagatcatgtttttggtgttgaatct

SEQ ID NO: 468679 - DNA, 1335 bp, Homo sapiens
tgtgctttatatctatctaaaaaattgcctttgtaagtaaggttctgtggcatggtggtgagaaacttgttgaagggctttgaccaaaatgctgatagtgatagggacaatgaagtccaggctgatgtggtcttagatggagatgaggaactgttgggaactggagaagaggcatctcttgctatgtctggatgtccacccagaattttggtgcaggggcagagtccacctggagaacctctgctagggcagtgcagaagggaaatgtggggtcggattcccccacacagaagccccactggagcaatgcctagtggagctgattttgttatctatttgggatccccagagattccatatgaatggatgaagttttgctctgtccccaagctggaatgcagtggtgcaatcttggttcactgcaacctctgcctcccaggttcaagcgattctcctgtctcagcctcctgagtagctgggattacaggtgcatgccaccatgcccagctaatttttatatttttagtagagactgggtttcaccatgttggccaggctggtctcgaactcccgacctcaggtgatccgactgcctcagcctcccaaagtgctgggattacaagcatgagccactgcgcccagacttaatgatcattctttaacagccctttcttgatttgtgtgtttgtatgtgtgtgtgtgtgtgcgtgggtgtgaatgtaatgcatgtagtggaggtgtttcttatatattatttttccttttccttttttcttatgtctattactactccattttataacatttatattctatattagcaaaattgttatctcaaatttaatgtttgtaaggttcttgtcactaaccaatctatctttatagtttctctgtcagcagtttttttttataacagagttatttacttttttattcatgcttcttttcattcatcatcttttggtgtgtttctctctgtagtggatatcatgtttgctcatcgtttgaaatgtcttgttatatataacatttgtaagaaacatgttgaaattttatgctcacattttcaagctgcatttcaagctctttctcttggtctgtaataatcaatttataaggttatttcattcacaaactaaacttaaaaaattctgatatggcatgcttgttcatttgtatgtctggattctggtcatacttactctttatttttatttgtacacataaattatacttcatgaatatatattttcattcattaagaataaataaaacattaataaatcagcattctcttactttcaaaggacattgctattgattgccattatttat

SEQ ID NO: 468680 - DNA, 814 bp, Homo sapiens
ttttgtttgtttgtttttgagactgacctcaggacatggtgccctgcatcctggctgcttcagctccagcctttgctagatgccaaagtaccactcaggctcagtccattgctttagagggtgcaagccccaagcctttgcagctcacgtgtggtcttgggcctgcaggcacacagaagtcaagaattgagaatggtagatccacctacaacttgcaccaggcacctggaaaagccacaaatactcaacaccagcccatgaaagcagccaagatggggcttgtaccctgcaaagccacaggagtgcagctgcccaaggctgtgggaacctacctcttgcatcagcatgacctggatggaatggttgtagcaggtctcaggcaagacccagtggctgtgctggcttcaggtctgacccagcacaatcatagcagtgacgatcacaggggtgcttgtgtcactccactctcagctttaggtggctcagaatggagtgggaggctctgtcactgttatacatatgttgataagctttatggtatcccgcaattctcttaggttcttccatttttctaaattcttctcaattttgctttcagactagataatttcaaataaactaatttaaaattttctggtgattcttcttgctcaaatctgctgtagacactcacaaactagtttttcattcatgtcattgtacttagcccctccataattactgttttgtcactttatataagttctgtttctttatcaatatactctatttattgagacattgttctcatggtcctttagctctttgttcatgg

SEQ ID NO: 468681 - DNA, 704 bp, Homo sapiens
gtagatggatgccctacattgaggatggccctcaacatgaacttcctgggttccaccctcacaaacaatttacttctaaaaggtcccacttcccagtgctatcacattagaacttcagcatataaatttggaggaaacacaagcattcattccatggtacaccccttctgcttgtggaaccaaggggtgggctctaaatgcaaatgtatgaatccttataagatggcaaaagaggctgtagagggagatttgacagtacacaacagaggagaaggcaaagtgaagagagattccaatatgctggccttgaagattgaactttgccctggaaaaactctgtccctggatcaacttaactattcgcctctctgcttgtcctctactgaattactgatcactgccagacaaaattcacacaggcttctgggccgttactgcaagttcacaatggatacttgtactgatttcagtgttgctacttagaagcccaacgtcatttcagatttcagtgttgctatttagaagcccatgacaaaaacatgttagtttgtaacatgtttttgtctctctggatgctttcataatctcatctttgtccttggtattctaaatttttatgatgacctgccttggtggagatctttttaatttgatttttcttctaatgggtgggtacttttagccttgatactataaacttctaa

SEQ ID NO: 468682 - DNA, 1916 bp, Homo sapiens
gaaaaccagtcaggcgtgagagctcaagagatgggtgttcaggtggtccccaagtcatttgacagggaaccaacgtgctcaatgcagatccacagagaaaaggagaatcaagatctaaaggacaagtatgaacaaaagtcaggggagtctcatccagcctggctcctcagcagtgagcacagatatgcagttgtcccactgctaaactgggtggggttcctggcagtggtggtggtgcgctacagactgactgatcttcagcccttaagtgacacacatgggcaccaaatgtggacccaggtagaccagtcctcaggtccagggttgtgtgcctatatgccaacagtgatggtagtgggccccagtcaggttctgagaattagaaatatcacttttacatgggtgccaacagtggtggtagcaggccccaagtgggacagtccatgttcagttcccttggctgtgttatataaagaatttccaatttcttctgggctcacagcaattgtgagaagtaggcagtcatcagtatctgggctcatcatggattggctggtatagaaaatacaaaacaaaatttaaaataaccctttctgaatctgtcagaccttgaactccatttaaagttagacagagtcatgtgattttaagttctgggtttgcaaaaagtttatcaacaaagataaatcttaggaaattaaaacaagctgtccagaactttagcagttaaactttaccagtgtaatttggtggctttgcaacttttcccacagtaacctttagaatgtgaaaggtggaaggtaaggatgaggaagaagagggagtaagaaacaaaagatgtctatgttgaagaagtatccttaggatattctgatacatggtaatgaccctccatgactctggtacctcatcattaccaatgtgagaattattaacttgatctaatattcttcacaactaatatacctgagagaaataagtctatttaatttttaattttggggggaatatacacattttcttttgacttttagcaatagtgaattggttagacacttttctttaacaatatatgaatcattaatacatcatcaacaatatagtcatctggagtttgtcatattttcttatattcttggcactttttttgttcttaggcatttctggctgttattcaagtctgatcttaatattactgattcagttttggggaatataaattctgatatttccttctttgatttctgttactcttccatcttcttaactttcctcattcacatttcacttagattatgcagtttgaatcttggagtcgggtctgttggggccagttatttaactactcttattctcagcatttacactagaaatgaaaggatgagaactatgttatagggcttctgcaggattacacaaatagacagtaagatgccagcacagtatcaaacatagttggtcttaagtatataatatattagctttattttcaatcactaactcaattacaaggcagaaataagcatattcttttttggaaaaaaaaattctaagataatcagaaaatacattatagtagggcataccatcctggttttaatgctttgcatttgtttttatttacttttggataaagaaagcagatgagggttaggtttattgataatttcattatttataataatagcaaaattaagatttatttggcatttaaaggatacattgccaagtacttttatgtcatgtatcttaattactatgattaataataaaaactaaatgtgcaaggcactttacaaattacttttgtttaaattatctcattctactcttaaaataacctatgaactcattatataaactgcgtggcattaagtctttattttatcaaaatgacaaaaccatgtctcagagct

SEQ ID NO: 468683 - DNA, 776 bp, Homo sapiens
gccgcagtcactcaatgccagtctgtgaaagcagctgcaggagtggtaccctgcagagccacagggatggagctgcccaaggccttgggagcccacccctttcatcagtgtgacctggatggaacagcactttgccccttggtggaggggatgtgtttcactggtgggaaacccacttctctgggctgcccagattcctcagaactaccaggaggaaaggctaagtctgctggtccgcatagactgcagccaccacttcccctaggggctcaggccaagggagatccaggttctgtccctgagcctctggctggagttattgaagttccttcagggacgccacacccagcagttgtgagtcccagtgctggctgctgcccttccctcaaggagttcaaagggcctagacagcacgcagctgcagctgtggtgctggttgacactccccacgattgtcttgagatttacccagttgcctgcaattcacagggctccacaacaggggctcaggagtctggggtactgcagggaactggggatttgttgggcctaaccaaggcagtcagtcagtgtgcagccccgcactcgaggtccaggagggaacgatgcttgatatcaggacgcaagccgcctccagcccaagcagcccctctagatattttataatgtattttagcactttggaaatagatatgcctttgccgctcagttttttaaagtttactttctttttttacattaaaaggaaatatttcatataaatatacataagtaca

SEQ ID NO: 468684 - DNA, 694 bp, Homo sapiens
cggggtgaggccatagcttctttacttatgtcattttttttctttgagtatgctcagcgcgtgccatcatggggccatgttcttcccctttgctcttggagaatagacaaagctacccagcccagccacagcctcataatcttgttctacctccctctccagcctcaactatttccaggctccagctcaagtcatacatcagcccgaagatccagtggcggggagtgggggtgctgagttggcaaagtaaacagctcagcaatgtcaacttgtcccaggttccattcatctctctgcatggccatcctcctcagaatggcttcttccttagactagtggtcccctgttggtggggaattgaaaaggagcatttcctgcctttcctaagtccctccacagtctatgggccctatgctcacacagacccccatggaaacccacccacagtctgcactcccccgttcccagctgcacagacagatcaacatgcagaaacagatgcacacaatgatgccaaactcaggttccaaccacgtatcaagaaagatgagaaattctgaaatagtatcctgaatctgctatgcatgggtttttcaaaagaaataatacttttttttcacaattattgaaatcttttatttgctttaagactttagaagctttgagaggtgaggaagaaagattcttggaggtg

SEQ ID NO: 468685 - DNA, 758 bp, Homo sapiens
aaagtcaggccatctccttccctgaagtcaggccatattctcctctactgactgagtctgggaactttataggcacaggatggggagtgtgtgctgattggttttgaacattctctggctctcagcatgcagtgtacagaccaggagcacactggccagcagatgtcaggagttcctcatggaaacctaggctctgggctccggactgaattccgtgggagagtaacaataaacagctggcctgtgaagcccctctcctcaaggccaaatctccctcacatgaccccaagatacgatcaggtgggggaccacaggtttcctaggctcgtaaagacatttagcatccccccaaaacctgggcagccaaaacagaacactgactcttttgaccctgaatctccaggtgatggaaaacattctttgcactcgcatcttttcacggtagcgcactcaggctcccctcagagtgtatgggcccgacgctgtccaagaaaacccacgactgccaaccctcatcccagccagggaaattgaaatgcttgttccaaaatttcccagcatttctgttgaatctcctctttttaaaaaatatatttatagtgtttctacagcttgccttttcctactggtatttttgttccaacagttatattgaggtattatcgacaaacaaaaactgatattttttatgtgtgcagtgtgatattttgatattcatgtgcgttgtgaaatgaccatagtcaagctaattattggtg

SEQ ID NO: 468686 - DNA, 769 bp, Homo sapiens
cgcggtgggcgagggctctggtgtctcattatgcagatgctgagacgtgttacagattggttgttcaagaagaaaagtgagatcatttaccaaaatggaaataagacagaaaaagcctggcagcggcccctcctggctgcccactctgccctcacctccctgggctacacccacatgctctccaggagagcacagcgtgtccaggagcccacagttcctgggataattgccatgcagaggccctggctgctgggcctttctgagaagttattaaaaaagagaacactttgctggcttctgggttcagatggtttatgtcaattacattatcttcagaggaaagaaaaggatgaaacaaacaaaaacaaatcaaaaggcacctttagcacatggctctattcacagcaggaaaaatctcccctagaatgttcaccttgctcttctccagtcaccttccaggaacacgaccatatcttccccacacgactcctgctcttctttctcgcctcgactttaatatcatgtctttatttttaatagtttcttaaagttttattgaggcataattgacaaaattgtatgcatataaggcctgaacatctcccaggaagggaatgacagagcgagaactggacacaactgcctgcagaagccgccttctcaggaagctgtccccctctatggctggactaacctgggcccatctccatggtctcccaatcccttcttttgccagtaggttcagagatggagctgtcattagctttgc

SEQ ID NO: 468687 - DNA, 510 bp, Homo sapiens
gtgtgtgtttttccatccaacagaattatggcagcagcaagtaagaaggtaatgatcctgagaatcagcacccaagaccagtggtcagtccagcaggaaagagataaaggtggcatgggacaagcgccaccctcacctctggggaccatcccccagacaccaagcagtggcatgcgtcttgcatggggctgtttaaggggtctgtataatgcacaactccagacgcgtccctcctttgcttttgggaaagctgtcagatttaaaatactcactctgtcaaaccctgacaaaatgaagccagggaaaaccatgagaggagccccttatgcatatttgcctgataatgagaaccatctcaggagaccgccagaaaccacagccctgcaccaaggccactgcaaccttagacacaacattgacaccttatagctgtcggtgagacccaaacttagctctccttctgaggcccttcggggactagtactgatcatcttgtgtttttatcacccg

SEQ ID NO: 468688 - DNA, 729 bp, Homo sapiens
gaccgtccatcaaccacctcacttctcagtcaggaaaccaagaaatgtaacaggatgagctgcagacaaaacccctcagacaccaggttaaagaaggaagaggctttattcagccgggaggttggcagacttgcatctcaagaactgagctccctgaagaaagaattcctggcccttttaaaagcttacaaccctgagggggagccaagaggctggcaaggcattcttcacagaaagcttattccagaacaagacgcacagcgtggggggaagtttccagagagccacccagaggacaggaggcccacggtgctggactcacctgcacgcctgcagagcaaaggggatgtctccacatcccacactgtcaagtttgttgagctcctttcttgttttatgaatgggagtggtgactttaaaatgattcacatgttggaggtgaaaccagcagtcttggatgttgcattcataactgagcaagctcactgggattggaaagcagattctgaagatgaaacctagttgttggcctttttaaaaagcaatgttaggctagattaatcatttgcaaatggtattctgccattttatcttagttcatactatattttatgttttttgttggcaataacatttctgaaataatttttataatatgtaaaatttatatacagaagagaaataaatgaaatcttctcttggtggtttttagggtcagaaaattctatt

SEQ ID NO: 468689 - DNA, 658 bp, Homo sapiens
cagcctggatgacagagcaagaccgtatttcaaaaggagaaggaggaagaggaagaggaggaggaggagaaggagaaggagaagaaggagaaggggaagagaaacaaaacaagaatcattttctggaacagacccttctgcagcaagattatgtgaaagctgtagagacttcaggccagcagccctcccggaagactcaagatgaaaagggcactgacttttgttatgataatgtcagagtgtcttgtggacatcaaggacagggaattagccacccctcccttaaggacaagctggaaccaacgcttttatttctgcttctctctgatagagaaaagctctgtttctcagtgcatgtctcagccaatgaccaccaactttcccaagcttatatcccttcttttcaagaagaaagctaagacagagactcgatgcctaaatttcattcctgcagcatagagttgaataatgttgttgttgttgccaatatttgccttttcactggaagggactccctttagtgtttaaaacagggcaaatctgctggtaatgcatcctctcaggtttttgtttatctgagaatctcttatttccccttcattttggaatatctcttttccccttcatttgctaaatatggacttattggttgacatat

SEQ ID NO: 468690 - DNA, 745 bp, Homo sapiens
cagcgagtgcagctagagctggagccggaagccgggcagcaccatatgctgggctttcaccagataatcaactcccaatcccttctggggcaccaggaagacctggaagaagattattccaagcagagagcagcaattgcagaaccctgttgtgcttccatttcatcctccattatggcccccaggaaaaatagatggacatggaaagtgaccagtgaccacgccagagacaaaatcaaggatattggtgctagattggatgtgaacagtggagaacataaaggcattagggacaatccccaagattctggcttgtacagtggaacatatggagatgccattcaaggtgaccatatgggtgtccagactctccctgcggattcagagcttcgacagggagctgagccagatcaagggctggaggatctctgtggcctccaacagaagaggcctggagcacagcccgggcgtttcggaagagcttgatggttacctttcattccccgtttcccaattgtgtttttcttagattagccatttgttttctacttgcaaaagtcaacacaagtttcctgagtgccttacaagtatggacccatgaatatctagtatatgctttgagttataatacaagatgtttttatttagctggtcaatatttcttttttaaatgattgcagctttggccacagggagctctttcacttagcccctgtctccctttcacatatttccatcaatgtac

SEQ ID NO: 468691 - DNA, 744 bp, Homo sapiens
cgggataggggagtgtgtgctaactggtttgcgagtatgcaaaaaaggttaaagccaccagtcagaggtggacagagtgtaaaggcagttagtgtagatatatgtgaaataggtgaagggtggggatccatccaaggaaagcacaccaaacaggaagacgggttctcaatccagtctgtcctctcgccgttgtctgactccatcctggctgagaagacggtgattgtcctggatgaccgagtcgccatcgtggagctgggagtgcagctcgtagctggcatgtctctctccctgcagccacaccgagcagacaaaagggccatcgtctccacagccgctgccctggatgttcttctgtccccacagcaggtgagcattccaggggccctgcgtccctggttcgcgatgaagaaaagagtcaagtttacttcctacaccagcatcctctgaggggacagtgggccatatacaactctgtcctgtttgacagtgatgatatcatcaagtgggtctgccaaggtacacttcagtgtctgttgtttccttctttgcattcataagttcttatcatttagctcccacttctaagtgagagcatgcagtatttggttgtctgttcctgcattagtttgctaaggatgataacctccagaaatcttttgtatatgaattggacaagaagttttatttaacatgtgagtgtacaataaaaaagtactagtttataaatgatttttagataaa

SEQ ID NO: 468692 - DNA, 915 bp, Homo sapiens
gttccttggacctttgcccagcgggatatggattcctggatggctgaccctagctgtgtatattatatttcatgggtgatttgtgcaggcttagagtttgtcagaataaccccaggacctaggagagatggtagagtaacacttaatgttgttcttagttttgttcctgtctctgccagaaagacactcaatgagtgccagatggagaagcgtctctgtttcccaggcaaagaccaaaactgtatcctgaggtttgagtttctgagccaggtgatgtcatcctccagcttggccggcctctttctgggagcctctggtgtgaaagagagcagatttattaaaaatcatcaacttcaaattatttggatggaaacattgccaaatcatagagatgtttgctaccacccgcacaccaagcagctgggtaactagaagtgcaggatcagcttattcacctccgaaagcctgcatgcaaccactgaggccgcctctattttttacatagttctacttggtgtatgtaaccccacagagaaacctggaagaatgcatgaaacctagtaaggcaaccagcacatgcaacagaatgaaccgtttctttccatctgaatgcctaaatgtggactctgatcctttctaccaagtcctaagtttgggaaaagaggacaaggacaggggctctgtcccatatcataatgtgcttgtgaatggctaaaattacaatgctgagataagtgtgtgtaataaaataattgcaccccgaattgaagaatgtttcactgtttattttcatgtttcaatatatgacaccctgtggtggaaagatgtctttatgctggaatatgaactcttttcactgctgaatttattttatttattgtattgtgttttattttattcccatctttattgaag

SEQ ID NO: 468693 - DNA, 767 bp, Homo sapiens
aactgcctcttctggaagactaactgaggagaaggggcatctctggagcataagggaggcttgcagggtccttgctctgtgcaaagcccctcccagccagccagtttccctttagagccctcctgattaatcactcactcatcaatctcctctcgctgaagacaccagccattttggattggggttccatacatctgcaatggccctaggagagtcaagatttcaacctatgggttttggcaggggacacatttcaacctgtaacacaagtgctcagcacgttttcccaggtggcttgtgtcctgcctttccaccccctttcccatctcccacttatttccagcctccagcacctctaccatggatgttctgccttccagttggtctcctggcatgtcctatcagctcctttaatctagtggccgtattgcacctcataggatctttccaaattgcagatctgatcctctcccatctccacctgtcctttggtctccctcagtcttgtaactcctccttggcttcccactgtccttgggataaaaacttcaaatccttagctatgtgtgcttctgcaggctcatctttcactgtgttctaccacctgcctccaatggtcctgccattctccgaaggcctctgtcatttcttttgcacatgctcttctacctggaacactgccctcttcaccagcctctgcctggcatcctccaggcactgactgtttctcctaggggagctgggaacatgtctgctttttatcttcc

SEQ ID NO: 468694 - DNA, 559 bp, Homo sapiens
tcgggatagaatacacccagcaccgatagacgtggcttccagaatgggatctctgtcgaggttccagcttctggggaaggcacagtctgcacacgcctcagacaacagatccgactcatttccactcattgaatccctgcaccgtgcaccaccaccgaggatcccagccaatattatgcatttcacagtgtgtcttgccatgttgccagctggaaatctccacagctggtgtgcctctcccgggctttgcttggctcttgagcttgctactgggctcgctctacccactcggcctggtgggctgtgcttggctcctgttaccagcctcaatttcacacccactgtggctcagtgctcagcccgtggctgggccaggtgtgctgagatctgcttccaccttggtgctggagtctggaggaggggaaagtggtggcaccccaaaactcagagatgccagcaactcgcctggtaagtcccaaagtctgagccccctccaagaactgttacgactctctccccttcccaccacccacagcaacaaactggggggcatgttacc

SEQ ID NO: 468695 - DNA, 1339 bp, Homo sapiens
cggcttaagactggacattgtgaccaaaaacactcctcaaaatgcctacaggagagatgctgcgtctggagtctcctgcttggcattggagcaatgatagggtccctgtggagaagtcgctgcatcctcacaaaggtgctggcaggcatcaggatgtcagcctgcaggtgatgagaccccaacaagcagaagcagaaccaagtaccctggggctgggaggagtggttgtgatggtggtagtgatggtggaggtgatgctgctgctggagatggtggtggtggtgttagcgatagtggaggtgcttgatgacggtggtggtgattatagtaaaggtgctgatgtggatggaggtgatggtgtaggtgatgatgttgctggtggtgctagtggaagtgatgatggtggtggtgtaatgatgttgctggtggtgctagtggaagtgaatgatgttggtggaggtgatggtgatggggttggtagtgatagtgaaagaattgacagtagaggtgatagtggaggtgataatggtggtgtaagtgataatggtggtggtggtgtagtggagatgatgatagtggaagtgatggtggtggagaggatggtggtggtgttcatactggaggtggtgatggagacagtgaaggtaatgatgatggtggtggtgatgattgtggaggtgatggtaatggaggtggtgttgatagtgaaagtggtgataatagttgaggtgacagtgcaggtgatgatggtggtggtggtgatagtggaggtgatgatagttttggagatgatagtggaagtgatggtggtggtggtgatagtggtgatgatggtagtgatactggaggtgatgatggtggtggtggtgatagtggtgatgatgatggtagtggtgataatggaggtgatggtggtgatagtggaggtgatgatgatggtggtggtggtgatagtggtgatgatgatggtagtggtgataatggaggtgatgatggtggtggtggtgatagtggtgatgatggcagtggtgatagtggaggtgatgatggtggtggtggtggtgatactgaaagtgatgatgatgttagaggtgatcatccaggcatccttgttgtaaccatataatcttgtgtgattcgacatgtataggtttatatttgcatgaaaaacatgactcaaatattcagacattttgttcttgagtgacacagttagggcagtttccatgatactctattttgtttacattttctatttttcttgttcctaaaatgattttctaatacgccgtttaaagctgttatggaattgtaccactcagatttcaagaatttttgc

SEQ ID NO: 468696 - DNA, 870 bp, Homo sapiens
cacccacagtgccagcagtcagatcccagatttctttgtacaatgacatggctctctcctaaatcgaatttttctgcaataaacactatggaaagcaggcttgaaaagatacccatgcaaagacacatcctcaaaatagatcccatcactagatctattcatcaagcctgtttcaatggtgtgcatgtttccctgctattggcctcttcaaccccagaaaaggtcatgaactatatccctccagctgcccggcttgttacaacacaattccgaaatcttgagctccacaccccatctgtcccaacggcacctgcagtcctcaagggtatatcacagcccgaagaaaaacccaaacagaataaacatggaaaagctggtcggaaggtagggggtctattgagaagttcaggaagatcttggtcagggaaatcatcttctccaactaacttgccaagcctgattcctgattttacctttcactatataacatacctacccactctttatacccaagtgtcttacccaggggtgaagaactgaaacatcttcctgaaccagcctctgtcaccactgtcctcctggcagcatcctgaattgcgaagagccaccccgccccccagacattcagtgacctagactcagacctctggggaaggacacagtctccaggctcagccagtaggcaggggactgtgacagaaagggacatgtggccaagtccctctggtgagatacaaacctggactttggccaaacctggtgagaaagaggtttaatctcaaaatcaatctcgctcttcctttccacccccagctccctttccccactccctgccttctgctgtggttgttaagctgatagaacgtaaag

SEQ ID NO: 468697 - DNA, 619 bp, Homo sapiens
caaactgggacgatttgcgcaccttaattcgatgagctgatgccgtcatatcaacgcacactttacctagcatgcataagcctagagtcagcagtctctggccgcattacttgcaccacagcactggagaatttgagatgggaagaggtcaaaatcatgaccccagagcagccagtacaaatcagtcccactaatggagtcccactaatgacaccatttatgaggaaagagactccaagtgcagtgctcagcacacagaaagaccgtcctaatctgcactggctgcagctctgttctactctaatgaacacagtcatggaagacgggtgcaaagacaagatctctgctcctgtttcctgtgctccagccaagctggcctctgagctgagcttgggagataccagaagcaagaatttaagcttcagtcactcatattacctggggcaagaaaatgtttggaattttgtattttggcaaatgtttttgtcttgcctgtgttcagacaagattgtgggatgatctcaccgttgtcttaatccatcatggtcacaaagagggcttctgtgatatcaatattctgtgaaaattattcctattttataagaggacagcaaggcct

SEQ ID NO: 468698 - DNA, 558 bp, Homo sapiens
tttcaagttgacaaaccaacacagatgatggttatcacctttgttttggagcggggggataacagctcaagggtcttctcagcttccagagtcccctcctgcccatgcagagaatatgatgtaaacatggctgagattgtaggagcttatctgtttctgtccaatactgtactggagctgacatctgaaatgacacttctcccctttatgggagaaggacttggcggggacaagatggccattacaggtgtttctgccaaggaagacgaagctcaggtcacattcatcatggctgaactccaggtcacctgtggtgcagagaaagtggctggctcagatgtccaggccttactgcagtgctgtgttgagcagacagacatggctgtgagtctctgggcttgtgccctggcccagtcattgcctaggcaactccctccccacgggcacctggcctctctccactttactttctgaacctgtaaaatgggtaggaggatggaggatggtacgtcctacctcatagagctcatgagaggattggtacagatgaaagcactc

SEQ ID NO: 468699 - DNA, 588 bp, Homo sapiens
gtgtgtgtttttccatccaacagaattatggcagcagcaagtaagaaggtaatgatcctgagaatcagcacccaagaccagtggtcagtccagcaggaaagagataaaggtggcatgggacaagcgccaccctcacctctggggaccatcccccagacaccaagcagtggcatgcgtcttgcatggggctgtttaaggggtctgtataatgcacaactccagacgcgtccctcctttgcttttgggaaagctgtcagatttaaaatactcactctgtcaaaccctgacaaaatgaagccagggaaaaccatgagaggagccccttatgcatatttgcctgataatgagaaccatctcaggagaccgccagaaaccacagccctgcaccaaggccactgcaaccttagacacaacgcatgttttgcattgcaaggccctgctattcctgattaaactcaaaatcttcagtgcctctctttgtttgttatttagattgacaccttatagctgtcggtgagacccaaacttagctctccttctgaggcccttcggggactagtactgatcatcttgtgtttttatcacccg

SEQ ID NO: 468700 - DNA, 530 bp, Homo sapiens
tcccgctgctctcctcactttgagtcaggaaagctgctccctgcctcgtccacccgcgttggcatgtgttactacaaagaagatgccctccattccagacctcagtggatgagaatagcaaatgtgtattctcaagctctcaggaatacaacaaataatgcaatcagaagtaagcagggttacaggcccggggctgctacagatgcagtagtgacaggaggcctcttctgcactgggggcaaggataaggaggagctggacagggagaagccagagatgacaggtagagcaggagctccaagacaggcagcaatgtgttataatctctgtgggccctttgcctcatcacgtggggcagctgccctccatcagcaaggacaaacaaccagtgtgacagccctttttggggacccaaatacttgtccagtgcccaagaagaatgaggtcatgcagatgaatcgaaagatggtgaatatggagaattttcttgagtgatacaagtgactctcagtggagaggagagctggaaa

SEQ ID NO: 468701 - DNA, 1061 bp, Homo sapiens
gtacaccccttttttttttttttttttttttttttttttttttttttttttttttttttttttgaggcagagtctcactctatctcatgagacttattcattacccggagaaccgtatgggggaaaccacccccacgattcaattatctcccaccaggtccctcccacaacacgtaggaattatgggagtgacctcaagggggctaagggacttcgagattggcatgtatgccctgctctacgtcttcttcccggccattctggtcttcttgatcaactgcgtggcattttcctggaaatacagacacaaaaggtttgctgtgagtcagcagggcaacgttccccattcccacaactgggtctggcttgggaatgaagtgggacttttggagaaccgtgttgacattacactcccatctgaggagtgcacaaccatgatagacaggggcctgcagttcgaggagaggaacttccttctcaacggcagtttccagaagacttttcatagtcaactatttagacttgttgactatgtctatgagaaagaaattaaaaatgaacctatgaattcttcaggcccaaagaggaagagagtcaagttcacttcctacatcaccatcctcccagaggacggcagcccgtacaccaactccatcctgtttgacagcgataacatcaagtgcgacgtgtactgagattgaaaagcaacaactatgctcaataaagtcatgcaaatgagtggatcaggaaaaatatgaatgagctctcaagctcaagaggcagttgtcaagaacacaggggactggaaaaataactgtcaaaaaaaaaacacagaaattactcaaatcccaaaagtttttaaaatagaaattattgttgaaataatagtattatattgttgatattaagcacatataatattaagcaaatgaagatttttagaataagaaaatgagacagtattttaatttattaagatgggatggctagaagagcagatattgggctagtaaggcctcagtgtgtgttctattgagacattggcatatttaataaataga

SEQ ID NO: 468702 - DNA, 751 bp, Homo sapiens
cagctgcttcctccactttctcctcctccaggaagccttccctgaccacagcagaccatgatggtctttcccttctctcacttccacgctctgaccccacagttgggctaccttgatgctgaacatcccctgaagcaacaggactgcatgagcttgccagccaggcacctgacagtaatcaaaatctgtaaagaacaggatgtggagcctcctctgcttgttcagcacgaacattttgtggtgggtgctgcaaagatgactcagacacagtctccaccccaggtcactcatagtctagtgcagtacaccaaagctgtgaaagctaaagggcagaccattggcccatccagggagagtggtagaagagggagcatttatttgaatagctgtgatgctaccagtctgaaaaaaggggaagaaacaatgatgccttcttggaggagaacactagctggctcagaaaactgtttcattacccacccattgtttacaacattggtgtacccaaagcaaccaatggaacaaagaattggacaaaacgcacaaacaaagcaagaaggaatgaagggttttattgaaaatgaaagtacactccacagtgtgggagtgggcctgagcagaggggctcaaaggccccattgtagaattttggggagtttaaatatccccaagaacctgaacaacctctgccgttaacatattttggtgacccgggaaggaggaagagtctttcaatggctgtctcctagta

SEQ ID NO: 468703 - DNA, 725 bp, Homo sapiens
agaatttaaatctctctctctctctctcgtctctcaagaatggttgaagaggctctgcgtggccgtctgcaagctgagaagccaggaagccagtccaagtcccaaaacctcaaaaactgggaagccgacagtgcagccttcagtctgcggccaaaggcccgagagcccctggcaaaccacgggtccacactggcagctgattggatggtgcccatccagattgagggtgggtccgcctctcccagtccactgactcaaatgtcagcctcttttggtgacaccctcacagacacacccaggaacaatactttgcgtccttcagtccaatcaagttcacactcagtattcaccatcagacactgtggatggggtttacagaagagctgggagtctggagatttgggtccatctagtctgggctccatgatgagaaatcttcatggagtcattcctactgcgcaaaaagagttttaaactcgttggccgctttggtatcatctatctgtgaattagaatcagaagggagagaggaagagttagtttaatgacactctctcaattattgatacaaatagaaaataaacaaaagtataacaaacttgaacaactcaattaaattggactcaaatgatcgttattggaccctccacctaacaagatcagcgcacatattcttctcaagtactcatgaatcatttcccaatatagaacatattctggcccgt

SEQ ID NO: 468704 - DNA, 578 bp, Homo sapiens
ctgccacttgctagtttgtctgtgtgtcatccttcagtcttgcaatttccttaccctcatatccaatgctggaacaagttttattattccagccactaaatgccctcctctctccacctaatttccaccaccctactccttgctcacctattcttatgcttggactattgcaaatccagcatggttcctggaacagggaagctgctgatatcacacgtatttgtggaggcaaatgctggctgcctaaaaacactttatatttactcatggccatgaaactgtctctggccaatgaaataatagaagcccactgtggatctcacggtgccgaaatcaaagagtcgtcagggttgtactctttcttggaggctccagggcggacgcgttttcctttccttcttcagcttccagaggttccagagatgaagatgtggacatctttgaggaggagacgggaccattccacctatgacaagcagccaacactttcgaggtaactctcaacgaagaggaaacgcaattccatggaccaacgtcccagacgtctatccttaaggggagaatgtctgaggagtgct

SEQ ID NO: 468705 - DNA, 566 bp, Homo sapiens
gaatctgcctctcccagaagattgggaaactttgaagccagaagcaatgctgcgttaatggctgtgttgctaggttccaacacaaggactattgcaagggcagtggaggagcaggctgcagccaacacacatggcccctttctgtgcatctgggagacaccttattgtcctaaaggacagcatcaggccaagacacccagctcggactgcacagggcagccaagatgccagacccactgtcccaatccacccacatttgtgcagtgtacagctgctgctagaggcctgcagcttggtgtagagagtggaatattaacagacagtggagcagacacctgcaagtatgattctgaaacatttttcccccagataaaaagaggcaccctaaaagaacattcctccttatcctcctccttcctgttttggacctggttgggtgagaaagcattgcctggagctgcagcagccttcttgagaccatgagaagactaatctaatctttagattagtctaaattagattagtctaatttaatctttagattagactgacagaagcaaagttgg

SEQ ID NO: 468706 - DNA, 692 bp, Homo sapiens
tgctgcctctcataaggggttgaagcaatgggtttgaaagaagctggcagggctagcccagatcagcttgagggcttcacttggcagcaggtatgtgctgggccccagctgagtgagcagtactgcagagtcgacgccccttgggacagccctcggccagtgacaaacaggagcgggaggacgtgtgccctgcttcctcacccctcgggcgacagttcagagttgtgccctgcaccttctcatggaagggctcagcgggattgggtcccagttgctcacagcagtaaatggctcataaatatactttacgtcatcgtgaatttgtgtcccaaatggactctggatgctcaaggtctggcttcagcatctatttccaggggatctcagccgaagatgttactgtctaaacgtttaataaagttcccgaaatcatgaaatacttggggtaaagaagtgtttgtgtatgtgtctgtgtgtctgtgtgtgcatatgtgtgtttgttaatctgtgtgtttgtgtgtgtgcatgtgtgtgtatgtatgtgtgcatatgtgtgtatgtgtttgtgtgtgtgtgtgcatgtgtgtttgtgtgcgtatttgtgtgtgtctgtgtgtatgtattgtgtgtatatgtgtgtctgtgtgtgtttgcatatttgtgtgtatttatgtgtgtctgtgtgtatatgc

SEQ ID NO: 468707 - DNA, 779 bp, Homo sapiens
cagtgggaggcaattgtctcatggcggcaagtctttcctgtgctgttctcctgataggagagggagaatgaccctgcacctgggtactgagaagacattccaaccaaccatcaggtttgatatctcagtctgggatggaatgccatccaattgtttggaaacttccattttgtgtgtgcttcgtggcttcatccctctggacaactgtctaaattacagaatgagaatgaaggcagtagggagcttggtggacacccctctccctcttgccccggtggacactgaggttttgaacactgccattctcactggaaagcctgtttcagttcctgtcaaagtcgtgagggtccaggaggatggttctgtggtctatgtgtctgagtctgtggaatgcaagtctgccaatgaagatgtcattaagtctgtggaattttcactcatgtcagttcaggaaatgccgagcaatccccaaggaggatactccacagatagcaaggatcttatggagcttctgcaagaaaagtgtggactgaggaaattctgtggattgggatatagggaagggagaaagtgtgaatttggaaaaatgaaaactgtggtgatatgaagagaatatcagcatttgtgaactcaaaagtatctgagacagatctcaatcaatttagaaagtttattttgccaaagttagggatgctcccagtgcctaaggttggcgaggtggaaatctacagagaggctgagcactgataaataaattataattaactagtttaaatgtc

SEQ ID NO: 468708 - DNA, 1398 bp, Homo sapiens
atgcaaacagcaggttgcataagagccttgctggctttttttttttttttttttttttttagagatttcgtagtttcctggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggttgtattctaaggtttggggtgaacatagctgttgggaaccagaactcaaccgactatagtgaggaacaatgtggccagcatgatgagcgtggggcctgccatatagtgaggttgtgatcctctttcagacaaaagtaatgaaagacttgagatgaagatcatactatatttaaatgaaaaagtttctaaacagaatatgatatccattttcttttaaaatatgtgtatctgtgt

SEQ ID NO: 468709 - DNA, 1497 bp, Homo sapiens
gcatctgtgtctaggatgagaggacacttcctgcttttctgcttgttagtgccattaccctgacccactgcccagacctcaggctgcctcttccctgcggcagtactccccagacagacccccaccccggcctggctggtccctgagggtctgtgcgtcttctcgggactgctgatttgttcttgcagttgacctggagctaaaattcacaatgcgaacctccacatgctgctctgtctgtccgaaatacgctgccagatttgacctaaccctcttgttagcgtgtacaattacctttgtggtatcagctcagagagttgggagaaaaagttatgcccaagacagcttgaccatccattttgccaaaactagtccatccctgggggatgagcagagaagggagagacagagatggctgtgtgggctccagccccacctgccgtcctgcccacggagcactgggaattggctttgggaaaatggcagaacaagcacctgcagtcttagatcattctttcctggatcacagcctgcctaccaacagccaggctgccctgaggaaccatctgaagatgggaaaactctctcaaacttcacagagcaaatgcaggcaagaaaagagggcccaggcctctctcaactgtcttgtgaactgattacaaaaggcaaacttagaaattgaagtttgtttatggtgcatttaacatgcactggaaagaagtgaaaagggctataatgtgttttaactttgttgtatgttttgcgtatagaacttttacattttaagtcaaattgataatcttttcctttaggttttgttttttgttttatttggagtagaaagttggaaaactagttagctatacatatatatatatatatatatatatatagagagagagagagagagagagagagagagagagagttgaaaagcatgtatcccttacccagcaattctacttctacagatatattctagagaaactcctgtacaagtacacaggcaaacacatacaaaggtgctctttgcagtatttttttaacagtaaagaaattgaaaatgatctaaatgtcactgaatggggaaatgagtaaataaattgaagcatattatagaatgctcttacaatggcagggcaaagactgttaacccatcaccaaacctgtttcctattttgcggtaaatcgtttcacattgattaagtcagttgatgaatttcactcattcagtgaaattcagtgaatggctattaggttttaagtactgtgccatgtaccatggataaggcaagaagctcatagcttagccatctttgtactttactagccaaaatatgatgttgaagcttatttaggcttatcattaattagatcattttagcagttggtttggtcttgaagtcaattattaaattattagtattcaaattgatgttaaattcttttaccaagtatagagtaaattcttgttttctgttcaaccttggcttctcc

SEQ ID NO: 468710 - DNA, 716 bp, Homo sapiens
taaacaaagttggggcagggatatggcttcctgagagctgatctgtagtgactgttatctctcttctggatctagccacccagcaaatctacaaggctccaggctggtactgggggttgtctgcagagagtcctgtgatgtaaaccatctgtggatctctcagccatggatgccagcacctgttctggtggaggtggcaggggaggaaaatgtgctctgttgtcatggaagtggggaaaagctggcagtcacaggcctcactaagctcccacacaacccaaagggctggtttcactcccactgtggcccaccccctacaacagcaccaagtctgttttcaggcagtgggcgaacagggctgagaacttgccccaggctacccacttaccagctgcaaaaccaagtaggacgtttgttcttcccaggcctgtggagtctgcacactgaattcatatctttctccaagtcctggccaggagacttctcaatcagttcaaactgttacaaagttcagctagaggtttcctgctccctgtggcctttttccagtgcctctgactgccccccgccccaaggaccctgtgaggcagggcagaaatggcttgccaggggacccagtgagtccacagggcttttcccgctgcttcctctaccctgtattttgtttggctctctaaattgattcaactccaggtaaggtcagaattttctgccat

SEQ ID NO: 468711 - DNA, 538 bp, Homo sapiens
aaaccacatcaagcaacaactttgcagcagggagactgtaacaattccaggtgtcaacttcagatgcaacacaacaatatccagaagaggatggcattgtctttctttgtgtcacaaaggatggctaaacccgtccccaaagcccccagcaagctttcttctcataagagttatgtcacaaagaggcacctaagccaatctctgaataaggtggtcaggaaagacctcaatgagaaagtggcatttcagcacagagctgaaggaggtgagggagcagaccatgagttatctcaggaaagagccttccaggcagggagaacagcaggtgcaaaggccctgaggctacttcagtgtgcttgtccttggagagagcaagggaagggagagccagggagactgttcaagggagccaccaggctcgagaaagaggaacccctgaagacagtagaaagtgcaggtgccaagaatttgaatatctacatcagagtttctcaatgtgcacacagtgaactaccagtttaggatcatttgatttgct

SEQ ID NO: 468712 - DNA, 1019 bp, Homo sapiens
ataatggtaaaaggatggctactacataccaagcactatcatgggagacatatattgtttcacttagttctcacaacaaccctttggccagcattcatcctttaatgttcgtgcccgtctccttagtgcttgatagaaaggatgcacttcttatgttagcaatgcttgtggagcctttgtggtcattctcagacatgcacagagtggggaaaaacattgagtcacctggaatccacgttcagctgaggttgaaccagcaatcctggaatcagggcactacgggtaaccacattctcactttacaaatgataactcacacaccccatggaagatccgggaagtcttctgatgcccctgctttccaagacaatatgatgcttctctacattccatggactatgacaagtatatcagtcgtcgaagtgggtggtttaatggcatgattagctccattttctcttcctgcagcatagcaaagtgcataaagcttgagctctgtgtccagcagatctttattagaattccagtccccccacagttacatatgctctctccctgacagttttcacagatgaatcatccagactccatttcctattagagctggaccctccacttggacttttgacacttagacccctctagcccacacagggacatcagtgcaataattctcccctttctacagcatcattaaattttgcctctctcctggatcatcccattcacatattcatatgctgttatttctcccatctaaaactgaccaggcactgtggctcatgtctataatcctagcactttgggaggccaaggctggcagatcacttgaggctaggagtttgagaccagcctggccaacatgacaaaaccccatctctactaaaaatacaaaaattagcagggtgtgctgcactccagcttgggcgacagagcaagacactgtctcaaaataaataaataattaattaaaaataaaattactttctcctgatcccatatttcctatgattaaaatg

SEQ ID NO: 468713 - DNA, 967 bp, Homo sapiens
cggagagctgaggtttgcaaggcttctttcctgtgatctttttggagacaggccttctacacacgtcgctgttctatcacaatggttctgtgcctggtgcctgtgggcgccgcaggcagccttttggaaatggaagcactctcccctgcctgccctccactctcttgcacatcttcacctgaacaaggagaaagggaggagagtgatgccttggcacgggaggaaggcatattctgcaatcttctgtgcataccagttgtcgtggaagagctgaagtgctacgtgacaaattccagaggagctgcttcccaccattgcttcaagaatgggaatgaaacgttaaaaaacagtggctgtcacaatggtggaaatcaactttctgattgccgaattcctgcatatttcaccaggaaaagggattcaactatggaatatatgtttaatgctgcagacagcagcaacacatatggtatatgcattgctcttaagtgtgagccaccaagcctggttcctacaattgttaataagagcaataaaggaaaaatacaggaagacgtgaacctgtattatgtgaacatcaaatttcaaaagagatggtcaaagaagcctatctgagacgtgacatttaagttgagttagccaatggacagtactggaatttctagacagaaatatattttttaaagaaatattaaagtaaaactcttctacatcttctattgtttcagtccactttggagctgactttaaattatttgactgtgtatgaagcctagtgattataaactgcctaataaacactagatactcaataaatatttgctgtggaatttcatgagttgtcttactgaaaaaaaggtattaaaatactcattttttaccagaacaatttatggatactttatatctttccacttgctggtgaaaaagctctgcctcttttgctcaggaagtactgttattttac

SEQ ID NO: 468714 - DNA, 695 bp, Homo sapiens
aaggacaaggacaactatcttgatgggcttggacaaactggggcggggcagctcatgtttccggagccaggagaacaaatggtttctgcaagtgatcaaattattctcccttcaaaaagttcattgtaactgggagagtgactacagcaagatggtggaatgggaatttccaatgctcttcctctcacagaaacatcaatctgaacaaccattcacatataaaaataccttcacaagagctaaggaattcaggacagtggttacagcagatgggtggaacacagaaataagaaaagatacattgaagaggtctgccccagagaaccctagtgccaggctgaaacctgtggccccaggctccaggcccaccccaattcccagccagtccccacaactccaggctctagacagcccccacagacccaggttccaggacatctccaacaacccaggtgccaggctggcctctgtggatccaggcaccaggcccacctgcccattgacccatgcaccaagccacagtccaaggattccagcagcatgtgcctatggatgcaaggatagttcaacaagttgaaatcaataaatgtaatgtaccacattgccaggaggaggataaaaaacatgataatcttaacagatgcagaaaaagcatgatttgacaaaactcaacatgttttcatgattaaaaaaaa

SEQ ID NO: 468715 - DNA, 1298 bp, Homo sapiens
ggcccggctccgcgcctgccctgggcccccgccccgccgcccccgcgggctccggccggccggccggccgtcccgcggtcctccgagcccgcgcgtcctggccgtcccgcccgccgtccgccgtccgccgtccgcccggccctcgccccctcccgagctgtccagcgcagccgccctctaccccggatccagaagtcccctccccgctggctcccggactccccgccttaaaggcacaagctccttttgtctgggcatccccctccccctccccagaagtgggggccgagttgcccactccccttcctagcagcggggtaggggcggaggaggccaaataatgggacccctccctccgcgcgccccctcctctcctccggccgcttcctcccccagtcctgggaagacaagcagctactgttctgggatcaagaccccgcggggaggggacctcgcagcccggtccccttcccttcaccccggccgcctcctccggcattcctctcccgccctcaccccgggggtccccgagcgcgcccgcaaacccacccctcacggctacatcccccgccccgcccaccgagggtcgccttccttcctgtcagggtcccaggggttgggccggcgccccgcgcccactcttcatccccaattcctccctgcccctgccccaccccagcccccacctagccattcccgccctgcctgtcacggccctgcgccctcccgcgggaactcagtttaataattaattaagctctcattccacaaggcgccagttatttccagcacggagcagctgcccaagttacctgggagatgggaaaatcgtgtgaaagctggttaaccctttgaggattagagtaatggtggaagcagaaaggagaaggagtttcactccaggatgtacgtaggaccagccctccctgcagtcctgtccttcaagactcaagtcttgtccactccaaatcaccactgggattcctaagtccaggacagagcttcaggcaaggaaaagaagagttgggaaagccagtttccaacatttatcagccacgtgtacctgcaaactatataccttgggtaaatcatcaatctcttgaaatgggaataaaaccatctgccttgtctttcttacagggttttcagaatcagatagagaaatgtttgttataatgtttgaaaatgggaaagtggtactttctcatttctcagttgtgcaggcctggcctgcaatttgatctttggggcctctttgcctgacttctcacttcaaaatttccttaaaaattgttttt

SEQ ID NO: 468716 - DNA, 614 bp, Homo sapiens
ctcggagacagtggggggaagatgagaagcgggggaagtgagagaactgccgcttctactagtggccactgtgccctggggtggtctctactgtggggcaaaatgattgcttgcttttcttttagtgtagcccccttccctctgcacttgctctttggatgcagcattaaaaaaagcagcagcagcgacagcaacagcagcgacagcaacagcagcagaaatgatgaaatccatcagagaaggaggcagctgcaggagcagcaaggcagtgatagtgccaattggggaatgatttctgtaacacggaggaagttgttcagctggaaaatcccgttgtcactactgccatcagcagttttttccattaaaggcctgggtgttcaaattactctcacactgaaccaagcagatccctgtgtcagagagagcaaaaggtacatgcaagagaaaaggtggaaaggtagcggaggagaatccttggaaggcagcacagaaaaaccatccttggaaggtttctctacatgagaaagagtaggtttggcatggagaaaaatgaagaaagatattcaagggaagttgaaatagtttcatttcttgtaaccaataagatggat

SEQ ID NO: 468717 - DNA, 732 bp, Homo sapiens
taggcttttagaagcagccagaccaaatcttgagtggtttgctgcttagaattttcttctgccagataccatagatcatcaatctcagattcaaagtttcacagatccttagagcaggggcaaaatgctgccaggttatttgttaacacataacaaaagtgacctttgctccagttcccaccctccacactcttccaacctctgctcattaaccagttccaaagtcacttccacattttcagagatcaaagcgggaccccagggtcctaacccaggccagggtagaaagactgttgatttagcccttagaggtcacactgtgtccagagttggttccttccagcaggcttttggtcttgctgacttcaagaatgaagccgcagaccttcacaaaaagttctccaagtcccgactcgacccagaaatccagctggcttcacctctcaacactcttgatagctcatcccaatgctgcaagaacaagaggctcttctccaacctgcacaagggaggggcgctctcctcctctagaaaaggcagttgcatccatagcagcacatacggaatagggacaactgtcttctgggtaaagacgtccaggagagaagttgactccaagcccaaagcaggaattttaccaggaaccaaggtcaaattcattggttggcaagggcagtgcttctaactttataatcataagcattggctcagagtgtagacttcagaagtttc

SEQ ID NO: 468718 - DNA, 870 bp, Homo sapiens
ccatcttggaacctctccaacaatgattcttattatcccttttgccattttgcacagtgagagagaagacaaaagcctgactggactgtccaacaaccctcaggttcaggcactgctctttgttctgttcctggtgatttacctcttgactctactggggaacctgctgatggtgctggtgatcagtactgattcccacctctgcacccctatgtacttcttcctgagacaactctccttcctggatgctttctattcctcaattattgtgcctaaactgctagagaaccttctttctaagggggagacaatatccttccttgagtgtttcactcagatctccctggtcatattttctggagctactgaggcttgcctcctctcggtcatggcctatgaccggtttcaggccatgtgtcatccactgttgtatgtggtgattataaacaggagggtgtgtgctggcctggtgggggcatcctgggccataggaatggggactggcctaattaacaccctcctcctggctcagcagcacttctgcggccctaatgtcatccacagttttgcctgcgagcttcctccggtgctcttattgacctgttctgacccctgcgctagcatcgtctccattctcactaccatgtcagtcctgggccttggcacccttgtccttttgctgggttcctacagctgtatcatcatgacagccctgaggatcaactctgctacaggtcggagcaagatcttttccacctgctcttcccatttccttgtggtcaccatcttttatacttcaggagttctcaggtatgtcatactatacccctgaatataaatgcgggatattccttaccctaagtggtctcc

SEQ ID NO: 468719 - DNA, 522 bp, Homo sapiens
tgatcaattaaaaaaaaaaaaaggaagtggaaaagcagcagcagctgttagatcctaaatccacctttttacagcccagctccgggtgcttaggcatgtcgacatccttcttggccaccatgactctccttaaaaaggagttcataaatggcaacccagttcttcttaggtatcaacatctcagcggctataggatccagggccagggctggcagtttcttataaaaccaaatatccacctactgtgttacccagccatgaatggatccagtgactgttggaactgtgggttgtctcccttgggagaaagtgaattagaagccccagaggatccagagaatttggataccttacccacctgtggtctcattgtctcttctatggatgtgctgcaaagaaagaatgatataaacctgatgaggagcacagaatgtgggctaaagccttctcctaactctattctatcactcctagcaggaattcttgaagtttctatactaaaaatccaggaagggtagccac

SEQ ID NO: 468720 - DNA, 1677 bp, Homo sapiens
ccgggatccatgcagccagcaatgatgatgttttccagtaaatactgggcacggagagggttttccctggattcagcagtgcccgaagagcatcagctacttggcagctcaacacttatgaatgacatgtatgggaaaaatctaattacggaggattctggaaccctaactaatattttgttttattatgcttcgacattcctgaagctaaataaacctaactctggcaaaaatgacgacaaaggcaacaagggaagcagcaaacgtgaagctgctaccgaaagtggcaagacagcagttgttttctccttgaagaatgaagttggtggattgatgctcgtgtttccacaggaaaaacgtgtcaacatggttcatattgaatccaggaaatctcggcgaagaagttctgaggttgaaatctttgtggactgtgagtgtgggaaaacagaattcaatgagctcattcagttgctgaaatttcaaaccactattgtgacgctgaatcctccagagaacatttggacagaggaagaaggcaagggtggtcttagcttgtcggagctagaggatgtgccctggttccctcggaagatctctgagttagacaaatgctctcacagagttctcatgtatggttctgagcttgatgctgaccacccaggatttaaggacaatgtctatcgacagagaagaaagtattttgtggatgtggccatgggttataaatataccacccccgctagccccatgtcccagtgtttcctgattaaattgccaagagaggactcggatgggctgagctcacattttcacctcaggccctgatgatggttaaatacagagaaagatggagtatggatattttggggttgtaataggggttagcaggatatagtttgagttgtctaaaggtaaggagaaggcaaagaaatgaaatacagaataatatatattgaaaccacaaccaagaagccctctgggggattcgtgttgaatactatattttctgtgatattcttgaaaggataaatcaggggggaagaataaacacaagcagagaaaaatgaaaaaattccactctatgatgaaaaaacagcaggctcaaagtctgtattaccatgaacccgaaagaggagagggggcgggaaagcgccggcatgctaactgtcgatagatgccactcaggcgagcttctgattgacagtgctgctgagaaacatgattgattacccagaggcccacagcagcctgcagacatgagtgtgggaaggcctaattgcctcaccaataatagcgcaggaaacactcattagtgcaaatatcattcttcatagaagatctgagaatgaacgccctgtatcgagaggacactttctaaaatcatctgtgctttcttgaataagaaggaaaggggataaattacaaatagctctctggaaattatgccaaattcagggtatatttattgaggagtgcaacaaaggcatctgaaaaatcaagaaggaacaagagaccactagccttgatgttcccataatctttcttcaaaggccctgtctaaatctttttttttttaaaggattctgtggttttattgattcaacaccataagttacactttagaaattaaggtatagtttacatacagtaaaattatacatattttattatacttta

SEQ ID NO: 468721 - DNA, 1270 bp, Homo sapiens
aacccataacaaattcaaagaaatacaacacattctgattttcctcatgactatgatttttttctcaaatgtcaaatttcaaagtcctaaaaaaatggtggagtatactgaagaagaaactaaaacttggggtgttgtattccgggagctctccaaactctatcccactcatgcttgccgagagtatttgaaaaacttccctctgctgactaaatactgtggctacagagaggacaatgtgcctcaactcgaagatgtctccatgtttctgaaagaaaggtctggcttcacggtgaggccggtggctggatacctgagcccacgagactttctggcaggactggcctacagagtgttccactgtacccagtacatccggcatggctcagatcccctctacaccccagaaccagacacatgccatgaactcttgggacatgttccactacttgcggatcctaagtttgctcagttttcacaagaaataggtctggcgtctctgggagcatcagatgaagatgttcagaaactagccacgtaccttccgcatgtcaggcaggatgatagagagcaggaattcaacaacaacaacaacaacaacaataacaacaacaacaacaaaagtcagaccctcttcctgattccaggaagctcagggtctggtggagaggacaggcaggaagactggcagtttctgtgtggattcgtatgggctacactggggaagggaggagggccacctaacctgccagatggacacgaatcagacgaaggggctcggcaatgacaagagcattccaagcagagagaacacagtctcaaatgcaggctggaaaggcttctagtaaattggtggctgaagaggaggaatgatgcaaacaggaggagcatcaagagagtttattcaaaggctcaagcaaacacagcttggagctggggatactcttaaaatgtcttatctctatgtccactttctatgcattgtattcacaaacatacacctttcttggtgtacttgtgtttgggaccatattatacatagtgttcctttactagcattttaaaacttagagttatttccatatcaaattgtgtacagattggcaatatggcccgtacaagcactgtttggggtgctgttgttacagaaacacaactgatgtctcctaggggtggtaagacaacaggataagtggtaagttgaaaagtttctctgcttatgtatcattggaatgacccagccctgctctcaactcttcctttatgattc

SEQ ID NO: 468722 - DNA, 1738 bp, Homo sapiens
actagagctgagtgctaagtttacctaaaggaatatgataatagtgacatctgtcacccctttctttgactaggaaagggaattccctgaccccttgcgcttcccggatgaggtgatgcctcgccctgcttcggctcatgctcggtgcactgcacccactgtcctacacccactgtccgacattccccaatttctggtacaagaagttcatgacaacacttggagttgttgcaggatatatcttgaagttttcttctagtagcagaaagaacagatataatttcacagacctccccttatccactcctgctgaaagcaagacctgccaggataagcattctgtacagcgatcataccaccctggtggagaaagaatacccaaggtgtataggaagggcaggccccaaaagaaagagaatcaacaaaagcctggattctatatgtccaaagatgctcttctcagcctcaccagtcagatagatcctgttcagggaaggaagtgtaggaagagggtaaagagaagatacacttccttcccaatactcttgaaacagggaaaatgtccagttttatgggccaaagcaggagtctggggctggcgagaggcttattttctccatattgtcttggaaccagtgttgtaagacaatgttatgggggaataggaattaggagtctgtaaagagaaataatatgggcagaggaggggagatatcaaacagttggcagaaaatgaggaaaaagtagctacctgacatttctatccccatgaggcttgccccttcttcttagtatgggttctgtgagagtcccccaactctttataacaaacttctattacttaacttggatgaaaactctcctctttaaccaagccatccctaagacactaactaacctttactaaaactttattatgtgctcaacactgtgttatgtacccgataatcttgagttaatttggtgaaaggctgatttgttgtaatgaatgtaattaaagatttgatatttaaaaggtttagcattttaatagccccctttgccccaatatagactcccagaaattgcacagaatgtgataaggagcacttagtaaaatcttctctcgaacactagttcatgtgtggagaattattaaacgctttctttagataagatataattccccagaattgctgtgaatacatttgtcatagttctaacgtttatttgacattataaaatggtcaagtacagacaaaaagatcatgatattaggtttagccatatgacattttcatttttttaataggtcaaaatagtcgaatattggtaatttcatatgcatcaacttcattaagcaccataatagtgttaatggctttgtgtatctgagagatgagggcttcttcatgcagagtttggagtctagtctaagttttagtttagagtctagtctagactaaagcatacagaagtggtgcccaaaccccagttaaaactttgcacagtttgtctgtgcaaaatgagagaaataatgacagtataaaggattttttcaacagttaaatgtcttcaattttaaaatcctgatattatgggatttgggctgataaaatatatatttctttgtaaagtgatgttatagtagatggtacttttaaaatctactcactcaaaaataaaaaccagtggaaagtgtatatcagccttcaaatttgttcttgaatttttactaatctgtaaaatacaaatgttt

SEQ ID NO: 468723 - DNA, 653 bp, Homo sapiens
ggacacaatttcactgaagaagcaagctgctcatgagtcactgttggaagtgtctcagcactgtcgctggtgctggtgccgtgctgagcatctcagaccattctgctgccccctccataactgtcccacattttagcgcttgggctttactaggcctgtgccatctgggcgtatatgtgcaggtcacaggggatgcgatggcttggcttgggctcagaggcctgacagtgcaccctatccatgacctacttgccagtgatgggaagcacatggcctttggtttcctaaataactatccatccacatcttggttaaggactgttcctagtgcctttagtaatcaatggatggtagccttactcaacagcttcttaaaaagccaaagatcatttactatatttggaaaaattcaatggatatctgacagcactttagctgtaaaatcagaaaatgagggcagattgtacaatatagtctcctgggatctgaaattggtgatgatatcatggaagcttggcatccagaggacatctggagatttatttttcctggttttacaacccaaggttaacagctctgaactttgtagaaaccctgatactgtgactggtaaagttattcatagttaacttaaaagccaagccaaataaagt

SEQ ID NO: 468724 - DNA, 590 bp, Homo sapiens
accatttcctgctccctggggctgtatggatttcagaattgttacaggccaagtatattgtaaacgtctggaaaagtatcaccgtctagatgccattaagaacattagtgattcatgggaggagctcaaagtatcaacattaacagcagtttggaagaaggtgattccagccctcatggatgactttgaggagttcagagtcttaaatggagaaaggaaaaattgccacagccaccctaaccttcagcaaccaccaccctgctcagtcaacagcccaaccatcaacattaagcacttctctttcctgctgccatgtgaagaaggacgtgtttgcttccccttctgccgtgattgtaagtttcctgaggccttcccagccctgtggaactatgaggtgtacatatttgtggctgatatggtttttctgtgtccctacccaaatcttatcttgaattgtaacgccaacaattcccacatgtcatgggggtaacccaggcaataactcttatatttgcccttttaggctattttctatatcttattgacatgcttgattcttcttattttcttatgtctcctctgactgtata

SEQ ID NO: 468725 - DNA, 742 bp, Homo sapiens
accactagatgatggatctgagtcatggcaccgaagtacattaccagctggacactgctccctgcatctcagctgctccagctccagttgtggctaaacagaccctggatatgtttcaggttgctgctctagaggttgaaaaccataagcatttgtggcctccacatggtgttaagcctgtgggtgtgcagagggcaagaagaaattcttgggaggctccacctagatttcagaggacatatggaagcaccaggatttccaggcagaagcctgctgcaggggcagagccctcatggagaacctctactagggcagtgtggaggggaaatatgaggttagaggtcccacacagagtccccactcggatactgcctagtggagctatgagaatagggctacggttctccaagccccagaatggtagatccaccgacagcttgcacagtgcacctgaaaaagctgcaggcactcattgcaagcccttgagagcagtcatgggaggtgagccctgcagagccacaggggtggagctacctgtcttaggagcccaccctttgcaacagtgtggcctcgataaacatgtaagcaaaggaaaaatatttaagttaaacaagagataaattactcttgtgaaataaaatgaaagtcaatacctaagcattccattccattcaatgaacttcaaaataagaacaagaagtttctgtaaggcattattttctgtcccacactaataacatta

SEQ ID NO: 468726 - DNA, 1866 bp, Homo sapiens
gctgcagcagtcctcctacttggggaggcctttgaaatcaccatggggcagtcaacccagctcctaatgttccaccaagttggccccttactggacaaaaaagggccacagtggctcactgacagcagattgttgaagtaccaggttttgttattaaaaaacctgcaggcctcaaatcttagagctgctagagtctgttcatttgccccagaaggtggcagtagtgcactacaagggacaccagagggccacgatgaaaccgcacaagaaaatagtttggctgaccagaaaactaaagaagcaactgttccaaagtttacatttctgggagccttgctcccttctctccccactgaactacccccactccagtacacccaggaagaaatagatttggaccacccaacagggatatcaaaaagaaaccaatggatggtacagcctgggggcacttttccatctgccaaaggcctcccagtggaaggtcatccagagtctgcatgactcctgctactttggaaaggacagtctagggaaaatttgatactagtgatattggactaagaccttaccctactccagaatgacctcattttaacttaactaatttcatttataacacttttcaaattaggtcaaattctgagagaataggcgttagaatcccaacatataattttggagggatgaaattcaacccatagtaaatatgtgcatttctaaggcaaaattacaaaaaaaaaaaatagcttgaaagaaaatataaaaatacttttagacattatggtacacgaaaattttcttaaaagacccaaaatctaaaataataaactataaacttgcctacactaaagttatatacttctgcataaagcaattattttaccacttgatgacaaaatctgcattctcagaaaagcatatagaatttgcactgctcaataaagtaatagcaatttgattatgtaaaaataattacagcaaaactcccacacgttaacaaaaaggcaaattattttaaaatgtggaaatatgagaactgaattcacagaaggtgctgaaaatcactagaaatctgaatactcaatttgaacaggagctaactaatcattcatttgattgacatgaaaataaaaatacgacactgtcagcatgtaagaatgtgagatacatgattttctcagtaatgctaagaggagaataaattgataaagtcatcttgaaaaacaacttaagtgtatgttataaaaattataatgtaaatgtctcatcctttgattcatttgtaaggttatatttgtatcggttagctagtaccatgacaatgctatataaaaaacaccccaaaactgaatggttcaaagcaaaacttatttattctcatggatctgtgggtcagcttaaccatgcttttaaaagagtgttagcaaagcacagatgaccaagcagtaatcatttgaggccacataaggttatgtgcagaactagcacactgtcacttccatcctcatcattgaccaaagccaacagaagtgcacttaacccttttttttttaatgagaaaaactacaaaattatctatcaaagcacacagacacaaggaggaatagagaatgttcaccaataattcctttgaaagcagtgtattctcctggtcataatcataatatttaaaaacttagtaaaacacagtcatctcaggacacctaatctaatcacatcagcaggcctgaagtttaagatcctacaatctataacaagtttagatgagttcttcatgattcaatgatttatgaatttaagaggaaacattctcccaacatgcaatggtaggaaaggatggaagaatatccaaaagtaaagtta

SEQ ID NO: 468727 - DNA, 1402 bp, Homo sapiens
tttttttttttttttttttttttttttttttttttttaatctgtcttcccagtagattttataaaatcacatctttggctgggcgcaatggctcacacctggattcagaggctctggctgacctatgtggcagtgctttctgggaccagtcagatgcagtgcctcgaatccaagtctgttcaggttgccacaacaaaataccatagattgggtggcttgaatttagaaatttattttatcgcagatctgaggactggaagtccaagattaaggtgccagcaggaccagtatctggcaaaggctttctcctcggattgcagacagccacctacgctgtgtcctcaaatagcggagagagagaatgctgatatctcttcctataaggacaccatccctatcagattagggcccagcccttttgacctcattaacctttatcacctccttacaggctctatttccagaggagaaaataaaaatttcttctggaagagtaagacactggatggtgaaaaacaatattttacagaacagattgaattatatgtcaaaagtactcagcaaacaagttcagttatttcaaatatatcaaatatcaaaacataactttcaaataaaaaatactattaacattaatgtctcaatttttatgtggcttgttactattactttatgtggcttattcttttccctttgtgctttccaaaatctgtaatgttattccattccaatattctttgctatatttatatataaagtataaagtcaatagctttgaatacattaaaatcagattgaaagtgatgtttcatcactgagaaaaatctatatattttttacatataaaatatcaatttgtaggtatgattaggaaaattaggaagaaccctttagttttttatcctacaaaattagtggaaaaaatcataatcccactatggaagtcttgtctgaataccactgcctatggtcagtgtgcttctggtaagttggtgatttccgcaatggttgcttcatgtttgctattcataaagtgcattgggacccgtaagatattggtgctggtgttgataaatgatcttttcctcttagactctgctagatccagttttttattgactgtcattattaggttttagaagcttaaactgatacatagtccttgaaatataaaaatagtctttatgttacaaaattatttgccatagagtttcttttacaacagtaagcttcccctgtggctccacctccagctgggccaagatctggtctgtaattgaaagaattatatttgtggctgttcctttttcaatcaactctccgaaaccattgttgcaaatccgcaccgagaagcccccaacttcctccgaagggccccccaattgacaggccagcttgctcc

SEQ ID NO: 468728 - DNA, 821 bp, Homo sapiens
tttcagacatctctttgctcacacatatgaccatatgctgttagaagcagccaggcgacatcttcaatgctttgctgctcagtgtgtgggggtgaggatgtgaccaaagtgtataataccaagggtcgggttaccatgagtcaggagttgaccaaagagcagaaagttttttataaaatggtgcaacaattacttaaggctatccagtgcactgtagagtccgaagctttgcataagcttatgcttttaatttggcaggaatgcccttggttacatgatcaaggaacattagatttaaagttatgggagcaggtgcgttgctgcctgaaaagaggattggagcagggccattttgctaatgttaccgttttgaccacctggagttggttacactctgcgttatacccttttgatatgccagactgtgatgagtcacatcacccattttcttcacctgaagggaattcagaagatttaaagggaaagggtacacaggaaccagaacaacaaagaggggctcctcgccccacttcactcccttcagtagggcataaagaagacactctggtaaaagttttggtttcagctgccgaatatactgtctcaggctcaggctcaggtggacagcagttgatttcctcaatgctcgcagctagccatacaagtatggaagaggatacccgtgggacaatcccagggttcctttgtgatggttagacaggatgcaacagaaacatacattgaatttatcaaccaattgcaggctgcaatcaaaagacaggtaccccatcctgaagccaccagacttcttaagttgtaat

SEQ ID NO: 468729 - DNA, 670 bp, Homo sapiens
ctccaacagacctgcagctgagggtcctgactgtaagaaggaaaactaacaaacagaaaggacatccactccaaaaccacatctgtacgtcaccatcatcaaagaccaaaggtagataaaaccacaaagatggggaggaaccagagcagaaaagctgaaaattctaaaaatcagagcgcctcttctcctccaaaggaatgcagctccttgccagcaatggaacaaagctggacggagaatgactttgacaagttgagagaagatggcttcagacgtttggtaataacaaacttctctgagctaaaggaggatgttagaacccatcgcaaagaagttaaaaaccttgaacaaagattagacgaatggctaactagaataaccagtgtagagaagaccttaaatgacctgatggagcggaaaaccatggcacgagaactatgtgacccatgcacaagcttcagtagccgatttgatcaagtggaagaaagggtatcagtgattgaagatcaaatgaatgaaatgaagaaatacagagaatgccacaaagatactcctcgagaagagcaactccaagacacataattgtcagattcaccaaagttgaaatgaaggaaaaaatgttaagggcagccagagagaaaggtcgggttacccacaaagggaaacccat

SEQ ID NO: 468730 - DNA, 891 bp, Homo sapiens
ctatacctacagctctgttaccaccacttatgaaaccatttcagaggatatatgaaaacgcctgaatgctcaagcaaaagtctgctgcagggattgggctctcatggagaatatctactagggcagtgtggagggaaaatgtagggttgagccctcacagtgtcctcactgtgacactacctagtggaactgtgacactacctagtggaactgtgagaagagggtcactgtcctgtagaccccagaatggtagatccactgacagcttgcactgtggacttggaaaagtcataggcactcaataccagcctgtgaaagcagcttccactgactcaaatgttaatctcctttggcaacaccctcacagacacacccaggaacaatacttggcattctttaaaccaaccaaattggcactcaatgttaatcatcacaatgtgagacatggaacaaaaggagatgattttggagcttttagaattacagctgccctgctgaatttagacttgcatagggcctacagcccctttgttttagccaatttctcctttttggaatgggagcctttatccaatgcctctactcccattgtatcttggaaagatatatgcaccagaagctatgcgtcaaattagttaactatttggtcaaatatggcttatgtagataaggcctgtattatattttaaatttgttaaaacaatatctttcatttgcaagggacttttgtggttccatgggaagtttaagatcttttttatatttttgtaaaaaatatgtcattgagattttgatgggtacagtattaaatctgtagatcactttattagtctgttttcatactgctgatacagacatacctgatactgggaagaaaaagaaatgatgttt

SEQ ID NO: 468731 - DNA, 511 bp, Homo sapiens
tccccgcaccatgcggtcggagaagaccttcaagcagcgccgcaccttccaacgaagagcagaagatgtccgactcattctagcgcagcatccaaccaaaatcccagggataatagaaggatataagggtgagaagcagcttcctgtcctgaataaaaggttccttgtacctgaccaggtcaacatgagtgagcacatcaagataattacaaagcgcttacatctcaatgctactcaagccttcctcctgttggtgaacggacacagcatggtgagcgtctccacaccaatctcagaggcgtatgagaaaaaccttaaagcctcaacaaacgaactgttagaactaatgaatgaaaattcagtaaactgcagtacaaaatcaacatacaaaaatcggttgtgttttttacactaacaacaaactatttgacaaggacattaataaaacaatcgcattttcaatagcatcaaagagaataaaatacttagggataaatttaatctaagaggt

SEQ ID NO: 468732 - DNA, 681 bp, Homo sapiens
attattgtttgcttggttgtctacccagaccaagaggtattttagtttcctgactcgaggcatgagaggaagatgtgaaggaggctttgggttgggaagaagggtggcaatgatatatggctgtagtcaaggaataatcagggaagcagataatttggttaaaatgtcttggcctaataagggaactgggcagggggcttccgaggcgattgggcagtgtcagtcttcagctgctaagccgaggagatctgggaaggagtcggccaaggaacattgggtttgggctccaggggctttaggagcagcggtgatggtcggggagcagaggctgaagaagagttggagcctgattcagcctggcggggagcgacctgaggaggagcagtctggtgagaaggtcatagaaagatgagaaggtaggtagtactctcccatgaaaaagaagcttcatgagggcagagatttggagcacacctactttgttattcaacatcccaaccctcccaccgcctgctgccccgcaggacagacctctggatgcattcagagacttggtcctgcaagtcaagattgtcaagaagggccagatggtaaaaatgtaagatgacattgtgtgctaggatggccaaagagtggtggaatgaaggagcttgcttggatgatgttgggttcctaggtccc

SEQ ID NO: 468733 - DNA, 854 bp, Homo sapiens
gcagaccaaggcccagagggactaaacaatgtgcctaaccacagctagaagtaaccgtgcaacaaagacaccagggaaaattgataggcacctacttctgactgtctttgaacaggcgcttcaggtcttcaacaggttcacaggtatagcagctggcgggagcctcaggttccaggtccggggcttcaggggtgcaccaggttgccaaaatgaattggacatctccatgataaagcaaaagctagagccaaagactggaacccatcaacaaacttgccagcatccccagtactttcacaacctcttagtgccaggggagctgctgactttgacaaagataaaaggaaacaaccccagacaactgagcttacctcctgctggctcaccaaaacgttactggatggaaagtctttaccgattgtccatgttcttggcacatcaaagcattgaacaaaatgtacaaataaagcaaaagaatggcaaaacagtgcagatctactgaaatgaaagtgtacactcttagagtaggaaagggctctaggaagcagctcaagacacccaatgttattcagggtgtttaagctacaaaccttaacacccctagggtgacctttagaggcctctaacttggttacatgctatgaaggattggcccatggccaatccaaggctgaagtggctatctcaagagtgaggacatggcctgtgtgctgcctaaccttgtctacaactggctgcacctgcctgtctcatgccttaacccttggttaccctaattcccattctcctgcctcaattcactggctctcatcttcactagttggattgactctggggctaaacttacaaggtac

SEQ ID NO: 468734 - DNA, 1340 bp, Homo sapiens
ggtgcccaaccgcagatagccccactctgaggatgacagcagcgaggaggagcactcgcacgacagcatggtccgcgttggaaccaattaccaggccataattccggagtgcaagcctgagagcctcgcacgctacagcaacaagaagctgaagggggtgctggtgtggtcacccaaccactgtgtgtcagatgccaaacttgacaagtatattgtgatggccacggagaagcatggctacaacattgagcagacgctgggcatgctctggaataagcaccatgtggagaagtcgctggctgacctggccaacttcaccccattccctgaggagtggacagtagaggacaaggtgctgttggaacaggcctttggcttccacgacaacctggtgaaatatcactactcttggaagaaaacccacagccgaactagcatgacggacagacaggcccggcggctgaggggctgcaaggacaaagaagacagtgatgagttcgaagagagtcgaggaggcctgagtgaaggagagcccgatgctggacacccgaagagagagaggagcagcttttggctgcctaagccatccggaggtatggcagactttggggctattgcagaggtgattgggaacaagactctgacccaggtgaagaccttctttgtgagctattggcactgcttcaatctggaggaggtgctgcaggaatgggaggctgagcaggatggggcccgtggagccacagtccccgtggaggaggctaggagaggggctcccttgctagccccagcccaagaagaagatcatgaggtccagattacatcgatctccatgtctgtgtcccgatcggtgcccccctgcaccacccccgttccacctcccacctccctgccctaggtgccccctgctgctgaggccacctttgcccacggctcccactctgctctgacagccacccacagtgcagcagggccgcttcctccagccctggttggcccccaaccagcgcccaccacctctcatcctccccgctctggctgcctgtcctggccctccgcccctacccaccctgattggagcccccagtgccctcactctgaatcctgaggtcctccaccaaccacaggctccaggacctctttgctggccatccccaggcatctctggtgtcactgaggacggaaggggctagggctcttgccaggtctttccaagacccagagctgccgacagcccagcctggacctgtgggttctgcatgtgttcctggcagctgggcctgtctcttggggccatggcccgggctcaggggcctttgagctggactgagggcactttc

SEQ ID NO: 468735 - DNA, 591 bp, Homo sapiens
atacattcatgcccaaggttaaggtgggcactgctctcgtggccatgtgtgcaggtcatggttcctgggagcagtgtctccccatcaccaggcagaggctggttccagattcttccctccaggtctacacaacactccagtgcacccagcccaactcacatagggcagtaccaggcaaaggagagcttccttcctcacctttcccctgtctgaggtttatcccaggcactggtgccagtgaatggaaccgaggagtgatagcatcttacctgctgcaatctgaccaagctcagctggaggagcctcgggtcagagcagccgaagccctccagcatgcaggctccttttatccacaacctctccccactggtgaccttgttcgtggtcggtcactcaaactcttcctaaactgccccctgggccattggccactcaccatgagcgttcctgcgtctaatcattgcttccttcctttgatcagaacagctgatggcaaccagtttgaagaccccaacagaggcactgagtcggcagtactatgagaacacagtttcttcctctccctgtcccatgacttcacgctgcactctt

SEQ ID NO: 468736 - DNA, 971 bp, Homo sapiens
ctcagaagagctcaactagaggattggagatgtaaaataaaatggatttacagaaccccagatgggagggccagatgcacctctttgtcccactggcagtgctggatgaagggcaggctctctctctggggctggtggaaggtcccgtgaggtttttggcagctcctaccactcatcctggcaatcagggtctcatagtgctagcaggcctgatggctgccagagttttgattgcaggagtctttgatgtgctggttgtctaccgctcatcaaagccgactctgtacctttttgccgtacagaagctagacaccactcctactggtgccatccccgtaaggcagagtgcaacaccgcagcccgttgataataatgaccaaaagagagcctttgaaagagttaacagtattgtgcaatgtcacacagcattcaggaagcagatggccagcagctccggcttgggtactggtcggcgaagtcagcatgggtgttccagacccaggcacggtcactacctgcttgggcttcagctccatcatccgcatgatgtagtggaagacaaactgagagtcatggttgtactcgtctgtattctcagtggaagtatcatggtcctcacgagtgtccttggcggccgccatgggggcgcagcggtggccgctcacctgggtctgttatcgctggctccgcggcctctcggcggctacgtagctccttcccgcccgctcttccctccgccccgcgacctgaacctcgacccctgaccccagcagcaggaaacgcatggcgattcaaaaccagtacagctttattggctcaggcagcggacactctcattttcaactactcctgactaaaagcgttaatgcacttacctttaatgtaaagagtattttctgaagctcaaattttaactaaacatgaaaagttgttgaattttgtcaaatgctttgaactttttcatgaatact

SEQ ID NO: 468737 - DNA, 1019 bp, Homo sapiens
ggtcctgctctctctgtgatgtcaaaaaatctaggggatcaacagttctttctctcatcctctctcccatgtcaaactgtagcaggtctaagtcattaattatcaagggaaaaactctaaagaagagaagtaaattggtaccagaagagtggggtgttgctgaaaatatacctgaaaatgtggaagcacatttggaactgggtaacaggcagaggttggaacagttggagggctcagaagaagacaggaaaatgtgggaaagtttggaacttcctagagacttgttgaatggctttgaccaaaagcctgatagtgatatggacaataaggtccaggctgaggtggtctcagatggagatgaggaacttgttggaaactggagcaaaggtgactcttggtatctggcagcagaaatttctaagcagcaaagcattcaagaggtgacttgggtgctattaaaggcattcagttttataagggaagtggagcataaaagctcagaaaatttgcagcctgacaatgtgatagaaaagaaaaaccaattttctaaggagaaatccaagtcagctgcagaaatttgcataagtaaacaggagccaaatgttaatccccaagacaatggggaaaatgtctcaagggcatgtcagagaccattgtggcagcccctctcatctcaggccccgaggcctaggagaaaatggtttcgtgggctgggtccagggttcccatgctgtgtgcagcctagagacttggtgccctgtgtcccagccactccagctgtggctgaaaggggccaatgtagagctcaggccatggcttcagagggtgcaaacctcaagctttggcagcttccacacagtgatgagcctgtgagtgcacaaaagtcaagaattggggtttgggaagctccgcttagatttcagaagatgtatggaaatgcctggatgcccaggcagaagtttgctgcaggggcagggtgctcatagagagcctctgctagggcagtgcacagggaaatg

SEQ ID NO: 468738 - DNA, 899 bp, Homo sapiens
aaatggtcaattgttttggacattgtgctttgtttcatgcaggtctaggaggaacatgttcgataagaagctgatcgtcagcattgtaagacacagcttgaaggcagtcagcacatgttgcagcagttacacactggaaatgccattgagatcagccacctgggatccccttggcaagtgtgatatgtgtgacagaggtaagactgtggccacctggttgctggatatctgcacaaccacctggtatctgagcaagtacgtgactccaaaagtcctggtagggggctggagcttcctaagaggagccagatcaggcattcttgtgaaaaaactcttggtctattgcctgcctaggctccccaaggcttatgtggccctgggaaatacaggaaaggttcttgatgaaaacattgagaggaatgttttactgtttccgcttgtgaagaagaaatcccagtcccctctgggaaacattacttcaggcagcaagtcagatacacttatagatgtgtgcacagacgttcacacacacaataaaagagaaagttatctgaagcgaagcaaggtcgttgaacagcactttcaacaattccccagggcacaattcacagttctgttgccctcctcgcaagatgacaaagtaagtaatagccatgaaaaccttaagtgcccatatttgaatctcctgggcactgtgaagagggaagcagacccaagatacattcaaaattcattccataagagctgagcacctacaaagtgggaactggaagcaacctggttgtgtaagtaaggcattcaggttgaaaaccaaatcttcccctgtgtggtcatgaagaaggctcttacgttttctctgatcatgggttctgtcctcatctgtaaaatggggataataa

SEQ ID NO: 468739 - DNA, 1317 bp, Homo sapiens
agcaaggggttccctccacatccatatgatgaccgaattcccagcttaccccacacctatacatgtactgtttgagagaactaagctttctatttccaagcttctattgaataatatagcctctcctcctcaatttctatccaaaatgctgtgctacctagatgcctacctcggcccatgcccagacaccccctcacccatgcactggatttcttctcaccttatttgggctctgacacactactctcagcaacaactaccaccaccccatcccatcctaccccgagcagacttcctctttaccactcttgactccaacactgtgcattgggcctcatggataaacttttcatccttcttgagttcaacatcccacatttatccatttctcctccccctgcccccacaacagatgccctcttctttctccccatttggactttgttactccatgctgggcatctgctgccaccactaccccctaagaaacacatgccttgcttggtcctgactaatggtttctggactaaattatataggaaacaggagagggagggagagaattagggaaggaaggaaggaagggagggatttttatgcttttataaataagggtattggtgttgtcataaatttggaaaagcaagatatttttaactatgagattattaaggatactgtttcttcccacttctgcctcccctctgtcacatgagcccttgtgttgggcggcattggggtgaccataaccattttggcgatgcagacaaaaagttgggttggagttatagtttggatatagtggaatacatttgtatggaatacatatcatattcatatttaactattttgctgaatgaaaagccttcatgtgtgactttaacgacatgaaacaaatctgttcaactgtaatctgcacaatgcaacattttcaatggaaggttgtgacaacacaactcttagaaaagtgaggaccaagatcttggaaatcatcattctcagtaaactatcgcaagaacaaaaaaccaaacaccgcatattctcactcataggcgggaattgaacaatgagatcacatggacacaggaagggaatatcacactctggggactgttgtggggtgggggaagaggggagggatagcatcgggagatataccaaatgctagatgacaagttagtgggtgcagtgcaccagcatggccatgtatacatatgtaactaacctgcacaatgtgcacatgtaccctaaaacttaaagtataataaaaaaagaaaacataaaaaaaaatttaaaaaaaagatcattaataagttc

SEQ ID NO: 468740 - DNA, 1122 bp, Homo sapiens
aaaactgggggtgggtatgggagtccgatgagagaagagcacatcaaacccagggtatctgtgagagggagctggatccatagggcctgctctgcatctgcaattccacatggctgggaggcctctggaaacttacaattgtggcagaatgcaaaggagaagcaaggtacctcttgcatggcagcaggaaaaagagccgcaggggaaactgccgcttgtaaaccatcagatctcgcgagccctccctcactatcacgagaacagcatgggggaaaccgtcctcatgatcctcccaatagcccccaatcacctcccatcaggaccctccctccacacgtggggattacaattcaagatgagattcaggcccccgaatcagcagtttctccctccactcaccggctccaggctggcaaagctgacaccagtgccacagaaaatgcaacccgctgccctctccccaaaatgtggggagagcacggttttgctatgaagatgtcggctttgacctgaggctgacttgagagcccagctgtcatgtctcttccaaataagctgctgaacttggaattatcttggctgaataattaatcaggactaaaaataacctcaaactgcctgggctttgcttaaatcctacacaggcacagcatcaccttacatcgaagacagattcaacgaatctgcctctcatcctaggtggccactaggcaactcctctgggaccatttcttcctgctctatgctcccatgaccttcattcatactccctcttcccctgctggaaacctacttcttttacctcctcaaaggtaaaaggaccagctggtgaacaaaagaatacatttgctctatctaaagagaagcattagagcaagggaggaaaaactgatgcaagacaaatgacttgggctcatcataaaatactgagcagtcagcagaacattaagaagagacttctactccccaccacacacataaccatctgcacacctgaatgccgagactaagcctcaccagacgccagcagcataaatgagaggagtcacttacccctctgaggctcaggcttctcgactggaaaaaaaaaaagataataaaaatatcagttcagttgggcat

SEQ ID NO: 468741 - DNA, 543 bp, Homo sapiens
gcaagtttgtgatcttaaaggactccaagaccttggacttattttaagggagcaggtgccaaactgctaccttgagaaatggatgcatacacagcaagcacaggaatgggcacaggcagaggggcctcatcccagagtcacccctaccccaaaccacgaagagtactgccagactactgcccatgttcccttaaggcccaaggtctcttaaatcagcttgtggtgaatgctgcctggcctgtgactcacccttcagggcagtgggctcccctctggcccagggcaggtccaaaaatgccagcaaagggccaagtcctggaatcagggaccctgagggcctgcttggtgctctacccctctgatgtgtctagaaatgttctccacgagcgagggcctggaacaggggcctcacagctctgtctggtgccctatcctgctgtagctgagctggtatctaagatgcaagacagtctcccctactctttcctctcttctcttcaagcagaggaaggagtctcttttggagccccgaactgagtagta

SEQ ID NO: 468742 - DNA, 549 bp, Homo sapiens
cctgactgttagaaggaaaactaacaaacagaaaggaatagcatcaacatcaacaaaagggacatccactcagaggccctatccgaagatggggagaaaccagcgcaaaaatgctgaaaattccaaaaaccagaatgcctcttctcctccaaagaatcacaactcctcgcgaacaagggaacaaacctggatggagaatgagtttgacgaattgacagaagtaggcttcagaagatgggtaataacaaactcctctgagctaaaggagcatgttataactcaatgcaaggaagccaagaaccttgaagaaaggttagaggaattgctgactagaatgaccagtttagagaagaacataaatgacctgatggagctgaaaaacacagcacaagaactttgtgaagcatccacaagtatcaatagccgaatcgatcaagcagaagaaaggatatcagagattgaagatcaacttaatgaaagaaaaaatatgggactatgtgaaaagaccaaatctatgtttggtctatgattggtggaactgaaagtgac

SEQ ID NO: 468743 - DNA, 828 bp, Homo sapiens
gatgaggggagacagcatttggccgatggggctgagatttacaaacgaggaccacctggcagttcataaacacaagcatgagatgacattgaaatttggcccagcccgaactgactcagtcatcattgcaggtatttgctgccccaaaagccacggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgatttctaaaattatttcagaataaaagaacactgtctaggc

SEQ ID NO: 468744 - DNA, 4247 bp, Homo sapiens
gtgtgtgtttctgtaaggactgggagggctgcctaattgggataatggaggttaatggggcgcctggagggggttgccacgctcctagatcaaaggggccagctcttcccagccaccacagctggaggtcacagctggagggggagggggaggggcttcgggccagccagcagggggtgctccggccctggaaagcccgtcctctgagtctctgattctcttcttcgcttggaacggcttttgcttagagagtgcattggggagcggaggataagagaatgggggagctctgagatccctactcctctctgtgtggggtgatggggaagagaaagggcatgagagactggcaggctgggggccaacgggatgttggcaccgtcgggacctcgggcactgcaagatccggaggaagaagcttggatgcagcctcgagaaagctacggcggaagaggcaggactccggtcctgggttcgggcggctgagaaaggactgggccgggcagcggggggcgctggctgggcggaggcgaaggggcatccggagttcccccgccgccgccccctcccccgggctggcgctccctctcgggctctaatcggcgcggcggccgcagcgggcagagtcagcgccgccagtctccgggacgcgactcccagcaattgtggtcgggaccgcagatatgcagctgcctcctgcccgggcgcctggcccggccggccccgcccgcgccccgccccctgccgcccgcccctcggccgcgccgggacactgaggcacgggatggaggcgagatccccggcggccctgagcctggcctaggccgcaagagacctcccagcagccccggagctcacgacctgtcctgtccttctgagggtgcctatctcccccacagctgtggctgggggctaagaccccccaaatcctgcctcagcttcaaccgtccttcttgcctcacacggctgggctgggtgcatgggcgggtagtggccagaccaggggcccgggacatgagcgcaactttccaagcttctcttccaggcccctgtggttggggagctccacagagggagagatgagtcagcggggccgcagagcagcgggggcctgggtggggtttcctgcctgatctaactgggtcgggcttttctgctggtgatacaggaatttctctaaagcttctctttctcaacttctgagttcggggccccggaaagccatctggcacctcagtctcagactcccccccaacaagggggagaccgcgaggtcacagggacaccccaccacgggcacttcctctcaggcagacgggtggggtggcccgtgtaatcagcggacacaattatgtgctatttatactccttccccgcccccccacctgcctggcaacacaaccctcctcctcctcctcctcctcctcctcctccggacctggctatgcctcaggctattttctctgtccttcccaagccattgtctccccatctttgttcctctgggcctgtttctttatctttttagtttctttcctgctctgttttttgttgttgttgttgttgttgtttaaagccacacatctggtcttctccacctggttcccaaacccttcccctaaaccttgggttcccagagttccttgagggagagctgggagggggagaagtgtgtgttaaggaataacctgtaaaacaaccccagcgggctaagcccccctgtgggagagctgccggtgtcaccacttagctgcccagtcctctctcccataaatacctcagggcccatggcccaggtttcagcagcggcgggcggcagcagcctaggcagcagcagtagcagaagcagcagccgccgagcagcagcaaggactctggagtcagagtaggactgtaggaccggagcctgagtggaacaggagtggagctggcctgggagagagcggatccctcccagcaccctcaggccacccgttgcctgcactctccctgccagacctccagagaggagagactcgggacagccagccccaggttcccccaggtacatgacactggggagctctgggaggggtgcccacagatgcctatgggactgctgccgcgtgtaggacaccggggtccaccatccctttaacctctcccctcagcagccccccgaggaagccctgacaacttgcccatgctgctctcccctcttcctgcttcccaccccttccatgggcgcccctttttctcctctccctccctgatcccttctttggggagctcagcaaatggagcaggaaatttggaccctctgcctccctctctcgccctcctcattggatctggagccttctccgctgggaaagctctctctccatctgcctggctccttgggacccgttccccagcctcaggatggcgtcctccctgcttgaggtaactgtcccctcttccccccaggaaaccagccacaaccttaatggtcctagtccttgcccacccacctcctccaactcacatagatagtagctgtggtgcttgtcaattccaggggtccttctgatgaggagagaggagtggggtccaagaaaggggaagcagagggcaggagaaaagggagggaagaatagggccaggggtcagagggcagtggaaagaggctgggtggggtccctgggcttggctgaggcccctgtggccgcagtgtgagggccgggcgggggacggcgtcggcgtttttaaaaataaaccgaccgcagggaaaccatcggagccgggctgggcagagggagagggggcggtcaggggggagaagaagggaggagtggcctggtctgggggttttctggggcccagcaccatggtggttttctcttagcagtgcgtccctctttccacaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctgagccgggtggaaggtctcccaccccagggctgccctgacagtctctcttggctctctagaccactgcttgccaatcactctcttt

SEQ ID NO: 468745 - DNA, 828 bp, Homo sapiens
atgatgcatgtatgagtatgcacctgtgtatctgcatgtgtgcaggcgaacgtgtgcatatgtgtatgtgtgcatgtggtgtgccttgggggagctggaagactcagctcctggtacttctgctctggttgcctctgggcaagttaacagctctaggctgctgtgctggagcccctggggcgctgggtgtggtgtgggcagcggcaggcagcccctctgtgattctcaacttgggcttctcaccgcacctgactgcctgctcccccacttccagcccatttatccgaagagctggagtccttccagaacgtttctcctttcctgggtccttcggggttggcagcccccaggtggggaagggttcttggagatcttggccaggagcctcggctctgcaggtcccggcgccctccctctgaggtgccattcctcccctgcctcatttgctgccactgaccttactgagttaaattaaaaagcaatgttctgtgtgcggctccagccctgtggagcttgactctgggaagacgaagacaattactggcccctccatctccctctcatctggctgccttataatttttccccccgctgcctggtatgcaacatttatgtttttaataacaccagaatggttttgaccttgggaattcatagcagaatgggcactgcaagaggccccgacgtgattggcgtttgtctcagtcctttgcagggacaagactctggtgcctcctggattctggggaaggtgtgtaggggctgcaccccatgcggtttaagaagaaatctcaaaaaccagagtggacaaggacatgggaagggggg

SEQ ID NO: 468746 - DNA, 510 bp, Homo sapiens
cagacatctcagagagatcaggaagctgcagacggcccactggagagtatgaagactgatgaggagaagcatttgaaatacgttcgtaacctttccctaaaatctggatgcttaggtgtggagatggaaaagaaagttgagatgatcagggctgtaattaatgtggaagcatcaagaaaagttacagaatcacctggaggactttttaaaccaccaattgctggttccactcccaaagtttctgatgcagtagatctgggcctgctgtccagccgtgagtcccaacgcatcccatcatcaaaggtttgtgctcctggccccatagaagttgagagcctctgcagtctcctgcaggcctgccgtgacagtgctggattttgctccaggacttccacttacaatggcatgcagagcaggcttacctcatggcgagatctcagcacaggacccatgggcatggggattgctggggacattggacccctcctggggctgcagcactgacgtcag

SEQ ID NO: 468747 - DNA, 583 bp, Homo sapiens
cggaattagtttagcctgtgtggtctaaccctagccaatgggctgaggtataatgactggagcttcagcagcaattttacaaccaaaaggaaaccttactgggaagtgcctgtggcttcctttgctcagtgtgagccaccacacctggcaagagagtacacatttttatccattcttcctccaagataaggacttactgcccttgcccctgctttgtttttgctcccaacctgggagctggtggcaaagattagggtccttctctaaggcaaaagcatcaaagccaaaccttttcacaatgaggaccaatcctttaggcctccattgcaacagcatcatggttcaggcctctcctctgaatggatgctggtccttcctgattcctccactccttaatagatgttcttgggagttctccttggttaatctcctgcatgcaaatctccatctcagaggctatgtcaaggtaacagcctacaacagtggccttagacagtaacaagcagagtctggagattaaaaataattttaaaaaataatttaaacatataatttccttttttggattaatgctatgaagcta

SEQ ID NO: 468748 - DNA, 595 bp, Homo sapiens
ggaagctgcggtaatgggaactgccctccaccgccgctgatgcgggcagctccacctgccaggcacacgggcagccggtctctgtagtaccgcgtggtactcactgcgtttctggagttacaaatgcacttcaataatgatcaagtcatgctgcaacaggcacagagaacaaagaaacaactgcaacaagaaactgctgaacttgggtctgaaatcccagcattaacaaaaaaggatgctctcctacttatcaagggaatgaagacaagtggacgtgggtcccgctgtgttgcagcacctttgaaaatacttgtgaaatataaatcattgcttccatttctgaagcaattgcaacaactctttagcccagagaatgagagaaagatttgtgatgatttttccagaagatctactttgagaatcactgttgggcccacatatagtagtggcctggttctgagaaaggctatcagttacactcctggtcctggttttgttgtgtgtcctccacagatgatgtcaccttgttactgctactcctctggctatctgaccaatgtctgtcaggtttctagataaagtgtttccacagcct

SEQ ID NO: 468749 - DNA, 576 bp, Homo sapiens
cagaagagatctggatagcgcaccatgcacctgttacgcctgcctgggatgattaaattaagtgtcagagcaggatttaaacccgagcctgacttcaaagccatcttccactgtgctttgctgccttcacctgagatgatgccaaatacctgtgccacatactggcacctgcagtttattaggctgttggcatctagtcaaggatcctcacagggtgttaaagcagcggaagtcatttctcctgttaaaaggagtcgtaataggaagcagaagtcagatggtggagttgatagtgttctgctccctcggggcccattcctcaatgacaggaagggactccagggctgcgaatgcagctcatatattagaggcctgccctggtatccatgggacctattagaagcagatctgtgcatcttgattagaacgagtccctttgaggccattgattcatctgagctggctgtgtttatcatctggggctgctcttttttctcctccgttgtatcactgatgcttgtgtaaccactgttcagttctcttttcctgtatataatttctttggacatttgttat

SEQ ID NO: 468750 - DNA, 1206 bp, Homo sapiens
acagctggttcatctacagtaacaagcaggaaggcacagtaacacaacatgagacccatcaatcagcttttaacagacaattccaggtgtggccttgccattgttccaaatgcatggagcaccctttctgcagaaagcaaagattgccttgctgagaggtcctttgtctccgtgctgacttttcttcgtggcaccgattatctatttctaacagagagtcatgggcatttggacaaagaaaataaaaggattgtgcatttcacatcaaatatatatagcctgcacagctgccttcatgggttagaggtgagtacctgcagcttttccaggtacaaggtgcaggctgctggtggatttaccattctggggcctggaggacatcagccttcttcccacagcttcacaagacagtgccccattggagactctgtgtggggctccaaacccacattttcccgccacatggctgtagtagaggtggagcgggctgtcttagtgcccctgctgcactcagtcctcacctgggagcagccagtgggaaggatggtctcagtgcagacacaggaatggatttcagtgaaaggcagctggggcccttatcaatttcagtgtagtcagagaaaaggcacaagaaactccgcagcccctgaaggagttgaagccggttccagtgtgacatatatcatgaggtttctgcaggacttcgctgtccatttaaatgctaatgtgcaattctggcatatcctcagaatgaaagtgctgaagcaagcagcaacactggaaatttcagaacattgttgaatattcagtatccatgcactaaagagctcaggtagacttttaaatatcagacaacaaaccacagttctcacttcaatatgcttggctaagaattctctggcaatatgctactttttaaagaaaggttcagtgaagttttgcatttccaagtgatttttcttatgaagttaatctgacaagcaaagcaagaggtcgtcggctgcaattcatacataaggtatatattaaaaggcaaattcagaagttcttcctggttgttttctctgaagtctcaattgtcttcacctgtgagaactgaaacttatcaggcattgaagggaaatttcaaggttttgcctcattttcttactctatttatgtagtgcatcaagctatattaatataatatcactgagccagcaataa

SEQ ID NO: 468751 - DNA, 586 bp, Homo sapiens
gggctggtcgggttgaaaacatgaatatcttaaatgttatttttatttatagcagttacaccatcaaaggagaaattggcaaattagaatttaaaccaaataattttgaaattgatgatggtgatgatggtaaagatagtgatggttatgattatgatgatgatggtaatggtgatgatgatggtcatggtgatgaagatggtgatggcgataacgatcgtgatgatggtgatggtagtgatgacgatggtggtgatgatgatggtgatgatggtggtaatggtgacgaagatggtaatggtaatgatgatgatggtgatgatgatgatagtgacgatgttaatgatgatgatggtggtgatgatagtgatgatgctcccaaccttttgctggtggctgcactgaccatcaccgaatgcttcagacacctactcttccgcctccatacacattcttcagatcctcaggacaatgaggataattctgatctgatatatccacccataggtcaaagtttgaatcctgaagccattgagagcacaattcttgttgagtaagcagccccacttggggttagatcagatac

SEQ ID NO: 468752 - DNA, 614 bp, Homo sapiens
tgggatgggagggcccagtttttatgatctccacgccaagactcgcccaaaactcatcggggctaacagatgagccacctgtgaagacaccaaggcaggccgtgggccggtcgcagagtttctgtaaagccttcgccaccgccatcgccatgggggatgatctccactccgtccgccctgtcacagtggtgccagatttcagccgccagcttcggttcttacgagcgggctctgacgggctcatgcttggccacagcagctgggaagggattcggctagctggtggtgtttccaggcaaggagggcggccaatcagaggccccgcggaacggaactccaggggcaagcccaggccatccgagcatgcacctgtcttcgtgtccactttgcttttccagtgggaagtcggcagcaggaatgacccagccatagagccgtatactatgatggagccgtgggtccccaaaaagaaactagggggctgttaccaagaggaaatagatgctgacctgccaagaatgacaagtgtcccctcggccatcctatccacaaggttagacaggttatccatggcctttctggttctgtattaagagccctagctatgtcgggca

SEQ ID NO: 468753 - DNA, 609 bp, Homo sapiens
cgacgggactgggcgccgtggagcagggggtggcactcgtcggggaggctcgggctgcacaggagcccatggagggggtgggaggctcaggcatggcgggctgcaggtcccaagccctgccgcgtgggaaggcagctaaggcccggcgagaaatcgagcgcagcgccgccactggcccgggtgctaagtccctcattgcccggggccagcagggctggctggctgctccgagtgcggggcccaccaagcccacccccacccggaactccagctggcccgcaagcgccacacgcagccccggttcccgctcgtgcttcttcctccacacctccctgcaagctgagggagtgggctccggccttggccagcccagaaaggggctcccacagtgcagtggaggactgaagggctcctcaaatgccaccaaagtgggagcccaggcaggggaggtgccgagagcaagcgagggctctgaggactgccagcacgctgtcacctctcacaagctagggtttcccaacctcagcactatggacatgtaggctggatcattttttggttgtggggctgtcttgtgcattataggacattaacagaatagaatccctg

SEQ ID NO: 468754 - DNA, 696 bp, Homo sapiens
tccatccatgcatccatccatccatccatccatccgtgcatccatccatccatccatccttccatctgtctgtctgcccatccatccattcattcatcattccatccttctatccacccatccttccatctatccatctatcatttcatccatccattcatcattccatccatctgcatattcattcaacaaatgtcaaaggccacatgccttcagtgaacacagagctcagcaggaactatttctaagtgttgtgaggacacaggacagtaactgccttctgagcaccaacaatgcaccccataccgtgctgggcacagggaagaacttgccatttgtaggagagataggggaacatgtgaattacacagaaaaacataaagttagcactgtgggtgtgctctggaggatggggcgagtgtctctggatgcagataatttggcagttgacttagagtaactgggaagactcgccttgtctgaaggatgggctggcgttaccggatggactgggaggatcccaagtgatccacataatctcccatcttgacttagtcacgtcgccttttaacatttccaaataaagtaaccaacattcccatatttcagggatttggatgtgaatatcttttgggggagtgcacttctgcctttcacaaggttgacattctacaactattttctgcctcctctcct

SEQ ID NO: 468755 - DNA, 446 bp, Homo sapiens
aatggatacaatttgggtacatgtgcacaacatgcaggtttgttacatatgtatacatgtgccgtgctggtgtgctgcacccattaactcgtcatttaacattaggtatatctcctaatgctaccctccccactccccccaccccacaacaagccccggtgtgtgatgttccctttcctgtgtccatgtgttctcattgttcagttcccacctatgagtgtgagcttcagcagatgaagttttccgtctgcgtgcggaagagcagcgacctgaaggagatcccctcgaatgactgcagtgcgcagaaacgcttgcagcaggtgttccaggtgataaggaagccactgggtgcagggttctgtgatcactatgatgtaactctagaacattttcgtcattgctgaaaagaaaactcataccctttagcggtcacccccacttttcac

SEQ ID NO: 468756 - DNA, 685 bp, Homo sapiens
acagcaaagggaagccttgtgaccttgtactggtcaataacatacagcaagtttgggccaggaggcatgaaggccagggcacgtgaaagcatgcctgccgccctggacactgttcagcaggtcccagaaggagcctatgtttacagagtaagaggagaggctgaccagcaaacagaagggtctgattcatccccaaatcacgagacgagcaaggacacagatgtcacattccaaagggacgatggaggggagtttagtgaaggcaccattgtcaagggtggaggcaacatgagactagtagcagtaaagcctgatgccaccccaacacctgcagggtcaggggagccttccctgcaggagccgagaggatccacagtgagatgcagccaacccatggaggccctgcaggggagaagccagtggaaggaatataacagcctctctactcctgccctccgtcttctgccagagtgtctcactggttggatcccaaatccaaccaaagacaatgaaacctatgaatgcatttataaaacatcccccaagacatagagcagtgaagagtctaaggggtaaatgggaagtgtctagtgcaacaagcttgtgctctaacccaaactgatgaatgctggggtcttctctgctggagagagcttttgccacatttcatgcaatttatacattt

SEQ ID NO: 468757 - DNA, 575 bp, Homo sapiens
tggttgcaaagaagacaagtaggtagtatggtatcacaaaaaccgacttggactaaggttatggaggattgggctctagaactactttttcccatttactatttctctgaccctaagaatttcaccaatcctccatttcttcttcaccttggaagcagaggatataaaaacttgcagccaccagcaaaaggttgggagctgaggttcatcatcatctccctcaccatcatcactatcatcaccaccatcatcatcattaacatcgtcactatcatcatcatcaccatcatcatcattaccattaccatcttcgtcaccattaccaccatcatcaccatcatcatcaccaccatcgtcatcactaccatcaccatcatcacgatcgttatcgccatcaccatcttcatcaccatgaccatcatcatcaccattaccatcatcatcataatcataaccatcactatctttaccatcatcaccatcatcactgaagcagagaagggggaaaaccttgaagcttaattttccccataaatatcattcccctcataaatatttttaagtccccaccatcc

SEQ ID NO: 468758 - DNA, 480 bp, Homo sapiens
agaggctaagctgctccaggctggactgtagtggtgcaattatggctcactgcagcctcaactttctgggctcaggagacaacagtaagccccaaaatgaagttggagttgtcttttcatcagaggttgaagtcatgatctttggagctgcagatattccgggaggccttttccacgcctgggagagacgagtagagactccgtgcaaccggctgccaatgaggacccagggccgtgccctccaaggggcatcttgcaccctcttccctagctttgaccagcccgatagcggcagcttccgggtgctgcccatgacagcccccacttgccaaaagaggaaaatccaatctgatcagattcagttccagatagaatttggttttcttttctagcatatgggaatgccccccattcacaagtcaacagacacggtatctttttcatcccaaccaagagcaaataattagaaacagtttaaga

SEQ ID NO: 468759 - DNA, 524 bp, Homo sapiens
gcatacaagggaacagagctcagaagttaaaaaggaatgaacgactgcttcactccaaaacacagctctccgaaatgacccctggcatgcaggcattcactcactcactagttcactcagtgcctactgagtgtctaccgtctactgtctactgtgtgtctactgcatgcctactgagtgcctcctgtgtgcctactgtctactacgtgtctagtgagtgtctactgcatgcctactgcgtgcctactgcctactgcatgcctactgggtgtctaccgagcatttactgcgtgcctactgatgcacgggatggctcccaccagagaaccacccagccccaaatgctgacggcatggaggccgagacacggtgagagcgatgcagggaagggggctggcagggagggccagggtagtcacagaggccgctctgaggagctgggctttgagctgagtccaaggcgtggagaggcagcatcctttccctgaggggccagagaaggagcattccaggaggaagggcaa

SEQ ID NO: 468760 - DNA, 714 bp, Homo sapiens
gtgaatggcgaggcccagagagaacagccaagtgggtgtcgctgcaatggaaccagtctgatggggtccaggaggagctgggcagcagaagcctgctccggagagctgcagcctcgatggaggagccacagcccgcagcagctgaagctgcagggaagggacggcccccaccctaggcctggccaggagggacagggcggaacccgtgccctggaagctcactctctccccgtcctccagtctcccttgctgccttctgggggcagagaggaagagaggggattggaagagacaacgggagaaagacctacactgaagcccctctcggacctactcagtgctgaggatgggccgccggtggatgcacgaacctcctcttcctctgtgcttcctccacctccttctacacccacaacaccgaacatggacagaggcatccagaaatatcctctcaagctgaaatccccacgtctctggttttacttctgtatacctcctaagtatcggagcttcaacttctttgtccatctgctgaagcagagaatctgctccatccatgatgaaatgtaaagcctgcagatgcataaatctcttgaaaacaggtgagagaaaggccaggcagccatcctcggatagaccactgaacttaacgagccctgtgcttcctgggcccttaatctaaataagaaacataccgaaagctataaaagctac

SEQ ID NO: 468761 - DNA, 786 bp, Homo sapiens
gaagaagctaggaagcctcctcccgcagcatccgcgcatccagagcctccagagcctgggagctcttgggtgccctggcgtccgctccagtccttgcccactgcccactccaatggatgtggtatttctgaccttccctgattcctgggccatcatcacgcagaaacagctccagctcagcatccctttggcagagccccaggcacactttccgccccaagataaaatcaaacatcaaaggaatgcttacgaggaagaaatcaattccagacagatcaaagccgagtgtggaaacctccccattaccagaagcagccagctcagctcccatgaaatagcgaggaggggagtgcattccttagggcctcttccagtggccatggccattttatcacctaagtttatggagggcgggagggaagtgattcgtttgcatgagcacgcagggcagcatcagagctatcttgggggccagcactctgggaaggctgccgcaatgaggatctccccatttcccagctctgctcccagcgctgatgctctcttgggctccaggaagactcaagttacccaaagctccggccctgacagcctgaagcctcccgcccagcagaaaagacaggaccctttccccagacatcgcagaaaaagcctcatggcagctgactggttctaatctagtcccacaaccatccctagatcaattgctgtgaccaggagaacactcatggagccatgtctagtccaacggccacatcctgagaaggggacaggcccctgacaaca

SEQ ID NO: 468762 - DNA, 537 bp, Homo sapiens
catctgatgataaggaaatgggggtggtgggtcagtatgtatacacatgtgtgcatctgtttgcatatgtatgagtttgtgggtgtgtgcatgagttttgtgtgtgcgtgtgtgtatgagtttgaacgtcagaagtacaatcatcccaactacgagcctattctttgctccttgaaatggattaaattaaaggacgagtctcattttgacaactcacctcaccattgtcaaacaaagtacccgaattttgtttctgaattccacatcacagcgctgtccttggccaagtacaacatgaagatgctacatgttggcccagcaggaaggggcacagaagacaggagctctgagagccggccaaggtccagacgcagagaaagcagatggtgtggaatgagcgggcagattagccagcctgtgggctcgaccccactgccagcattgcttgaagctcaagcacatcatcaaagcatttgggaaaatgtcagtacaataggagagtgacctgagagcacaccttgcaacacaggaccccac

SEQ ID NO: 468763 - DNA, 2447 bp, Homo sapiens
caggttgggtcctggctccatcgtcatccctgggccaccagagtagaggattttcagttgacaatggccttcaaggttcccagtgccctgatctcccactaccttcttgagggcgtctgcttcccttctctccatcacctgctcctccaggccactctgttcctccaccctccaggcaccgccatccagaggctctacaagcagctccctctgcctggcccctgctcctccagctacctgtgtgttctgtccctcactgccttccagtgtggggatgacgatcagaggcgacgtcacaaggcccctgccaggagtaacctgggtgctacatgcaaagcacctgggactcagcactcgccctgtgatttgcgttgcatgattttgcatagcaccgacattctcagattcatggagacaaagtgtcggggagagcctcatttaaattcagacgtggctgattctgaaggctgtgttgagatttttgaaatctgcaataaattgtgatttttgttcttcttcctgctccactcccttttcccctccttcccctcctccttcctctcctcctccccctcttcctcctcctccccttacccctcctcctcttttctcctcctccttcttcttgttcttcgtcttcctctccttctcctcctccttcttcttcgtcttcctctccttctccttcttcttcttccttctcctcctcctccccttctctttctcctcccccttccccttcccattccccttcctcctcctcctcctcctctcctctttcttctttcttttcttcttcctttcttctttcttccttctttcctccttctttcctcctcctcctcctcctccttcttcttctaaattaataggctttattttttagggcagttttgggttcccagcaaaattgagcagaaagtacagatgggtcccatgtaccctctgtatccacagaggcaccatcaacattctacaccagagcggtccatttgttacaatcatttcccctacactgacacatcagtatcacccacagtccatagttcacattagggttcactcttggtgttgcacatcctatgggttttcacaagtgtataatgatgtgtatctgccattctattatcatacagagtactttcactgccctaaaagctttctgtgttccgcccatccatctttccctcccctgcaacctctggcagccactgaatgttttactatctccataattttaccttctccagagtgtcacatagtcggaatcatacagcacgtagccttttcagattgacttcttttacttagtaatatgaatgtaagtttcttccacatattttcataacatgatagctcatttcttcttagcacaaaatcatgttccatcttttcaatgtagcacagtttatccattcacctactgaaggatgtcttggtggctttggctttcgagttttggcagttatgaataaagctgctataaacatctgtgtgcacctaagtctttagtttatttgggtaaataccaaggagcatgacggtcttcccaggtgaaaatacatgcaatgaatgagagctccatatccttgcaagcacgttgcgttgtgaatgttttggatttgcaccattttataataatacatgtgtactatctcgttgttgtagtttgcagttccctaatgacatatgatgtggagcatcttttcaggtgcttatttaccatctgcctatcttctttgttttgcattttatgtttataaatgtctgtgatctgtgttgaattaagggtgtaaggtttgtggctggcttcattttttacagtggatgacccattgtttcagcaccatctgttgaaaagatgatcttgttccattgcactgcttttgctccattgtcaaagatcagtcaactataattacgtgggctgatttctgcactctctattctattccattgatctgtttgtctgttctttcaccaatgctgcacagctttgattactgtagctttgtagtaagtcttcaggttgggtagcgtcagtcctctcactttgtttttctccttcagtattgattgggttgatcgttctgggtctttggcaactccatataaaatttagaatcagtctgttgatagccacaagataacttgctgggattttgactggtattgcattaaatatatagatcaagtctagaataactgacatctttacaacattgagccctcctgtccatgaacatccatttatttatttcttatttgatattttatgatacaatttccaacagtggagacaaatcgttctgtatctctgctacagaatggctgtagggttctgtggttagatgtgtacagtggtgccagaccgctggggtcaagttctccccatccttcttgggcaggttatgcctttctataaaatggggtgataatggtacctt

SEQ ID NO: 468764 - DNA, 1014 bp, Homo sapiens
tttaggtttcaggacctgtttctctgttcaaagagaaaggggcctcggcatctcaagcccccgagctccatgaccatctctcacacactgtcttcacctcctgtgttctcaggcagctccatcgactcagtgaccagctcctccgctgccagggctctgaggtcttggctgctcaccccctgggtttgccccactgtttctgatcggcctcctttgcataaggaccctggaccctttctgcatctccctttgcagatgtcagctgccattctagatggggggggggcggtgcagctgtgacatccccacagcacatacagctgtgaactcccagctcctcactgagcacacacccgcctccaccgtcctccggcaccgcccacgagtcctgcctccctggggtccaggatgtcgggctgtgggagagcctccttggcagctcatgaggaagaactggagaccttggtgccctgcaattcccaggccaaccctgacctgtcattcagccccagcgtctaccagcatgccagcatccaagagtcgcataaccgctgcaagagagggctcatgaaggcaatggacacgggtccaagccacctggattcccgcctggatgaggcagccgcctccccacgggcctccccactacggttcttgtccccacccctgctctccccaacactgcagccttccaaattctctcttccagagtcagagccacgatcgcctccaaggccacaaagcctgccaggtttccgttccccttctgatggctgcaccctctgccctggctccctccgccccagactgaacgcttcctcgcagtttctgaacaggccagatgctccagcctggacatctctaccgctgctgtttcccctgcctggacctcaccctcttccctctgggaaaaatgcggctgccctgagtcccccagcccctgctcagatgttacctcctcagtgaggccctcctcgagggtgccatccgaaatcacagcaccccttccctgga

SEQ ID NO: 468765 - DNA, 868 bp, Homo sapiens
tgacctgactctccagctgcatcttcagccatgcacagacctgttctcctggccccagtcgtacatgcctgtgttctgtttctcgatcatagcaaacttgctccagccttggggcctgtgcactgtgggcccctctgcctgaacaggcttcccttggatcttcacgttagctcattccttgacattcagctctcagcgcaaatgcccccttctcagagacttcccctcgctacccaacgaccgagtccctcaccctgccccgtctccacacttggcttgtgccttccactgcacgctccactatctgaagtcgcaggtgctagttatcatcatcaccatgaccatcaccaccatcacctcatcaccattacatcatcatcatcatcaccttcatcactactattacatcatcactatcatgaccattacatcaccatcaccatcacctcatcaccatcatcaccattaccaccattacatcatcactatcacaaccattacatcatcatcaccacgaccatcaccaccatcacctcatcaccgtttcatcatcatcattaccttcatcactaacattacatcatcactatcacaaccattatcgcatcaccatcaccaacacatcatcactatcacgactattacatcaccatcacctcatcaccaccaccgccatcacctcatcaccacgacccccatcacctcatcaccaccacccccatcacctcatcaccaccaccgccatcacctcatcaccaccaccgccatcacctcatcaccacgacccccatcacttcatcaccattaccaccattacaacatcattaccatgaccatcacacccatcacctcatcaccatgaatcatc

SEQ ID NO: 468766 - DNA, 1718 bp, Homo sapiens
cagtctggacgcgtctaccagccctagttaccaacggggacggaatgaagggacccgacttcctgggcgcccctgccgacatgcagacagataaaggcccaaatcagcgcagtcaagcgcctcagaagagtccaccatggggagagagccgcagtgaccgaagagtcctccctgcagtcctgagcacacttgcaggcgattccccttgtgtggctggccctctgatgattaactcgttctttgctgtggcacctgctgttctcattggctcctccaggacagcaggcaagaagaatccgcagcctgtgatacccacacaggacgcactggaggccccgatctgtgattggcatctgaagtgcggggccgtcttgtgggctgagtccctgacctgtggggtctggaccaattccagcatgtggatgaccacaccctcccttttcgcctgaagcctgcttttcccctttaaacactgaagccctcaaaatcatctttggagaaaggcagaggccacagatgattgcttcttatatacatactatacacaaatatagtatatacatatgataaatagcatgtatatactgtattatagtatatacatacaataaatagcatgtatacactgtattatagtatatacatacgataaatagcatgtatacactgtattatagtatatacatacgataaatagcatgtacatactgtattatagaatatacagtatatagtatatacagtatatatacatatatagtatatactgtatatatacatatacagtacatactgtgtgtatatatatacatatacagtatatactgtgtatatacatataaaatatatgctgtgtatacacatatatgtatatattgtgtatatacatatatgtatatattctgtatatacatatatagtatatattgtatatgtactatatacagtagtatatacacaacatataccatatatacagtagtatatacacaatatatactatatatacgtagcatatataagatatatacgtagcatatatacgatatatactatatatacatagtatatatatgatatatacgatatatactatatatacatagtatatatatgatatatacgacatatactatatatacgtagtatacatacaatatatactatatatacgtagtatacatacaatatatactatatatacgtagtatacatacaatatatactatatatacgtagtatatatacaatatatactatatatacatatatacatacatacatatgtgtatatatactacatgtatatactatatacatatgtgtgtatatactatatactatgtagcatatacatactatatagtatatactatatatgtgtatatgtagcacgtactatatgagtatatatagcatgtatatcctatatgtgtgtgtataccacttgtatgtactatatgggtgtatatagcttatatgtactatatgtgtgtatatagcatgtatatactatatgtgtgcatatagtatgtatatactatatatttacagtggatgtgtgtgtatatatatattatatatattatatatataatgtatatataatatataatatatatatataaattatatatattatatatataatgtatatataatatatataatatatatataaattatatatatatgtaatatatattatatatatattt

SEQ ID NO: 468767 - DNA, 3252 bp, Homo sapiens
cgttgtcaaatccattttgtatgtagagccaactgtcttctcttccggtgagcactccggagcagaaacgttcagggctcccagcaaccgagagagagttctgactcctccataccctcatcgacgtttggggtcctcggtctttatgttagccttgctcagagtgtgtgtgatgtgtccagtggaaaatcattgtgattttgttttcctaatgaccagtgacgttgagcaattgttcctgtgcttattggccatttggaattcttttccgtgaagtgtcattgtcccagaaacgggtcactatcctgagagcccagccctggtgaggcaggccccactccctggaggtctgactccaagcagagccaaccagaagctagagggcaagagttccttgtcgacggcgttgggcgagatcagcctcctggtgcacagagtgcaggggagggcgcggcgtcacgtgtgtgagtctgatcttggcttccatcagctgatgtgagccttcgagtctgggctcggggcaggagtgactcggggtgcgggaggcggggagattctcaccactgaagtggacgtaaacacacgtcagacgcgagcccagacgtgggtgtcaccaacccctttcaatgacaagccccacagtagacgaggacgtttttggttgcgcaagcggcttctgaagtggttcctgtgggcactgcgggaattctccggagcctcacagtccccgatgtgggatagaccagagagctggggaacgggagcccgcctgagatggaggatccaggcccctcggggcgtccccacgtcagatccctggggtcaagcctgtccccaggatgactccccaggttttgacctgatcgctgcacccatgaggctcccggtgttctgccgtctgaggccgcagcctgctcctccccggcctgcttctcatccagggcacgccggctgccccccactagctgcttatcccagagcccgggagtcagtcccactccccagattctgcgcctggtcttgtccactccatcatcgcatcttgtcagctctgtttccaaaaggatgccttgactttacccacatctctctgccccactcccacctccacttccctggtccaagccgccatcactcgtggctggatgtcctcaaaggcgtctcagctcgacttccagggttgctgccctccaccccgggaactgaggatctatagcgcagccacagcaatcttctggcagtgtccattggcgaatgcatccgggcttcccttcctttcctttcctttcctgtcctttccttctctccacctctctctctctttctctccttccttcctttctctctttctttccttccttccttccttcttttgttttgtaggttgattgctttttacaagttttaaaatttaaagggactaaattgataagcagacaggtgatgtgtaactctttgctgatctgttgttacccagtgatagctgaagcttctttagaacacagatgctattaaaacatgctttgtttcagggagggaggtggtgatggtgagaagaaaggctgacactgagaacaatctcatgatatcagatctctaaaattttgtgcaagttcagagaattttctccattggataagggtcagcctcacttgtcctcttaaagcacttaggacaccacctgaaggctttggtggccttccctccctcctccatcccacaaatatgtataaatccttaatttaattcaataaaaagttgatatggtctggtctttgtgctctggagactaagagtctattaagggagttgagataaggacgcaaagactgaaacttcaggcagagcttggtaagtgccatgataggtgtagacgtgatactttggaagttcagagaagggaagcagggccctgaagtgattagggcattaatgcaggaggaggcctgtccgggttcaattttctgtttctctttttactacttgtgtactctttgctaagttatttaatagttctgtgcctcggtttccttactttctaaagatatagaaactatcagtacccacctcttagaattatcagaaatattagataaaatgatgcgcataagatataaataaaacagcatcttactgctaaatattcaatttgtagcactaaggatagaggcattttatcttaaggttgaatagaatttaaatgtaagataaaggtgggcaaggaacttccaaatggaaccatgtaaacaaaagaagcatgaggagcaagaaagcatggttggcagtagctgaaatactcagtttacttgagaaaatgggaaggagaagatgataatattgggaagttatgtgggatcataatggggaagaacattagtaaccattctctttttggtgaatgattatatgttaccgaagatctctaagcaggaaagatgttgagatggcttagtttctctaacaattatcttccccagaaatcatttgcaacatataataatgtaataaaacttattttttcccttctgcttgatttaggtttattatgctctatcttccccagttgcgtaacatggcaacttactagattattgacttgaggctcttttttcttttctaatatattttgctctattttccccagtttcttaatgtggcaagttattagattattgatttgaggctttttttttctaatatatggatttggtgctataaatttccctctaagcactgccttagctataccccacaaattgtgatatgttgtattttcattttcacttagttccaaatagtttctaatttctgctgagagttcatacttgacctatggattagttgggagtatgtttgttaatcaaaaagtgatttgagatttgcctgctattttttctgttactgatttctagctcaatttcattatgtccagagagcatattttgtgtggttttacttcttttaaattgattaaggtctgttttatcttggtgaatgcttctcatgtgcacttgagaagaatgtgtattctgctgttgttgggtggagtgttccataaacgtcaattagatccagatggttgatcatgctgttcatttcttctaagtcctttgctgattttctgcctcatagtttggtctattagtctatagtcacagctctttggagaaacgaaaccaataggatatgtttctatctatctgtctacctatctacctacctctctgtaaataagagagattgatatggaaa

SEQ ID NO: 468768 - DNA, 615 bp, Homo sapiens
ctgaagccacatgagtttgcaacctctgactctcagacagccaataaggatacggagctgccttggcctccacccacctcactgcgcatacgccatccccacccaacaaccccagcccccacacctgggctccgcagagggcagccctgcctggccttttctgggccccaccaccaactcttcccacagacctgccagcctggccacaccctatcacactcagttcagggacctgctgggtggtgtgggccacaatgacacggctaactgctgccactgcagtgtcagacacccggaaacacagagggagcctgctaagtgtctgctgcacattcctgaggatgctgcagggtacccatggctagtcagacgggagggcgcccgtgcccagagtgggtgtttattgagcgccgactgtgtaccacggctagaggggagggtgccagtgccaagtgggcatgaagccccgactgcataccttagctacaggcagggcactagtgcccggagtgaccgctgagtcccgcagctccatgtagttccctttaaagcccctctcagactccatgacctgtcatcactccctcaaccctgagcctcttgaaagcagggagt

SEQ ID NO: 468769 - DNA, 1081 bp, Homo sapiens
agcagcaggcagagatagctctgggtgccggcacctcggaagcagccacccttcatggagaaggggacagagctgctggtgtccccatcccagagtggacctgggggcgatcagcccctcctcgtgaagcacagggaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattggtgagtggcggtgccttcacccttgtcgccgcctttgatctggtttcacactgaggaatgctgggttgtctgtgtgcttgcataaagaatctccaacagccttgtgacttctcacctggaccagcagcctccgcgtgttctgtctgctccattctccccacagtttacagacttattgtcaaacacacagatcaggtggtgctacttacctattcaaagaccttctgggactcaaggttccctgcaggagaatttacactctgggcctgtcggcagatgtctagcaggtctttcccgcccggctttccatgcacctctggctctccttccaagcccagcagacagctgctgtcattgctggtgtcgttccctgtgcctggtgggcctgtctcacccatctgctgtctgagttcacccatctcaggaggagccttctctcctccaagccctctgcggcctgcacagaagggaacctccctccacgcggtctttgcgc

SEQ ID NO: 468770 - DNA, 2016 bp, Homo sapiens
gtgtggctggtccctgcggggccgctctgttaccgatgttcaggcttcgccctcttgttcctcgtgcgtggtgctcgggagcgccttctccgcaggccgtgtccccagggcagcccgcaggacctgtgggtctccaggtcgcggccgtcatgtgggctgagccctccgtccagcactgcttcatgtggacgcctgtcctccctggtgagtgtcctccctggtcagtgtcctccctggtcagcacttctcccaggtcagtgtccttcccggtcagcgtcctccctggtcaatgctccctcccaggtcagtgtcctccctggtcagtgctccctctctgctcggtgtcctccctggtcagtgtccttcctggtcaatgctccctccctggtcagtgctccctccctggtcagtgtcctccctggtcagtgctcctccctggtcagtgtcctcctggtcagtgctccctccctggtcaatgctccctccctggtcagtgctccctccctggtcagtgtcctccctggtcagtgctccctccctggtcagtgtcctccctggtcagtgctcctccctggtcagtgtcctccctggtcagggtcctccctggtcagcgctccctccctggtcagtgtcctctctccctggtcagtgtcctccctggtcagcgctccctccctggtcagtgtcctccctggtcagtgccccctccctggtcaatgctccctccctgatcagtgccccctccctggccagtgtcctccctggtgagtgctccctccctggtcagtgtcctccctggtcagtgccccctccctgggcagtgtcctccctggtcagtgctccctccctggtcagtgtcctccctggtcagtgccccctccctgggcagtgtcctccctggtgagtgctccctccctggtcagtgccccctccctgggcagtgtcctccctggtcagtgctccctccctggtcagtgtcctccctggtcagtgtcctccctgggcagtgtcctccctggtgagtgctccctccctggtcagtgtcctccctggtcagtgtcctccctggtcagtgctccctccctggtcaatgctccctccctggccagtgtcctccctggtgagtgctccctccctggtcagtgtcctccctggtcaatgctccctccctggtcagcgctccctccctggtcagtgtcctccctgccatccagggagccccctgtcgggaggagaggggcagatacagagtcaggtcagcagcctggtgagaggagccatagaggcagtgacataatgtgcaatgtgaggacagttgcaccgccctcatttcttggaagacgtgggtcagtgggaggaggcttggctcagcgtaaagacatcatcaccaacagccacccccaaagaatgacagccctgctgatggcctgcttctccctcaaggagagcagatgcttgtcggtcacagagctctctctggccctgccccagcactggggcttatgcacacagtgtgctgagtggaaggctgagggcgcagggtcagccggggccagcagtgcttctgacactgtgaatccagcagcggacggcacggtgggtgggcagccccgcaccatctttgaaatcaccatcgtcatcgtcatcatcatcatcatcatcaatgagattctcagtcaggacatccgcttctgggaaggcctccgggagctacagtcatggcagaaggtggagggaaccaggcacgtcttacatgggcagatcaagagagatacctcacaagcagagttcacggtcggtttgcattcctatgagaatcaaacgcccggctgatctgataggaggggagctcaggaacgattccttgtttcttttgattgacatcaacaatagccaatggcctgcttcattttccttcttttctgctgtttgatttgaaacagaacttgggtgtttgtattcaaatggtaattttccatcaaaattcctgtttaaacaaattgggaatctcaggaa

SEQ ID NO: 468771 - DNA, 1525 bp, Homo sapiens
ctgtaccaggctgtgagggagaggacagagccagacagaccgaatcctgccctgtgactctcacatcccagtgctggggacctggggaggtgacaagcaggcagacagacaggcagtgacaggtacatgcaagatcagatcccaaggagcagcacgtgggaggcctgctggcaggaggctgccctgaggagtggccacgtggatggggggatcgtggggcatcgggggagaggcatcacacacctggctggcggcgggggcacaccttcaagtctgaggagcggccaggaggccgaggggctggaggaggcaggtcaggggctacgggcagatctttccgggcccgggggcaactttaagggcctcggctttcccctgagtaaggtgggtgcccccggagggtctgagcagagggacgaagcgatggacttgggctttcacaaaccctgtacagggcagggtgagcaggtagacggggctgccgccaggctcaggataggagtggaggatgttagcttcaggtctgctatggggggcttgctgacagggtcaaggatttgggggctcaaaaagttgaaggacagagtggccactaactgacaagggcatgactctgggacagtccagggctgggagtgaggtcaggagggaggtttggacatgctccgtttgggaggcctgtggacgcccaggtggggaagctgcattggtggtggtagagctggagctagaatggaggacggagatgcagattttgcagttgtctagctgggcacgttgccaccccgagcaaaaaactgcttctgttagtgagaaagaactggagaaagaatactggtcaggcgtcatcagggtcagcccaggccctggaggaggtgtgcctggctctgtcaggcctctctgggcctcctccagacctggcttctgagcaggggctgccctctgcctcctatatgtctgatcgctgtgcccctgatccttcttctgagcaggggctgccctctgcctcctatatgtctgatcgctgtgcccctgatccttcttctgcctcctatatgtctgatcgctgtgcccctgatccttcttctgagcaggggctgccctctgcctcctatatgtctgatcgctgtgcccctgatccttcttctgagcaggggctgccctctgcctcctgtatttctgatcgctgtgcccctgatccttcttctgagcaggggctgccctctaccttctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttctggagggagatttcagagaag

SEQ ID NO: 468772 - DNA, 590 bp, Homo sapiens
gttgggggacctgtcacacccgagtggggtgaccacgggctcgcgacctgtatgaggcgagactccagcattctaggggatgaccgcaaaaccaggccctcagcagaggccgcctccttccagagccttctgtggctgggcgggggtctccaggcagctccgcagcccccgcaaataccccctgggagaggcggtctgagacgcgctttagaagttgacctgctgctctgcggggactcggtgcgggagacgagtggaggctgctgcgtcatccagacacgtaagcagcacagtgaggccaccaacagcagcaaccgagtcttcgtgtactgcgccttcctggacttcaggtaccctctgcacaggggagagcagctcgcctccacggctcacctgcccaatgtctgggggatctcccaccatcgctgtgatcacaattctcctctagacgtgagcccaccgtgaatggctcccacagtcacagcggtgttgaaaactcagctccccgcagggccggggagtggagggaggggtggggcctccggatcctcagctgctgctcagctgtggcccctggggcttgttccatg

SEQ ID NO: 468773 - DNA, 2925 bp, Homo sapiens
cggctctgcttccctccgcagttgctggctgtcgttggcgagtggcgccatctgggcctttgtagcccctgccctgtttgtcatcgtgggctcctctgggccagtgactgagggtcttatttcccggaatgctcaggaaggcggtgctttccaggcgggtccactcgaggccccagggctcttccagtcgaggcggcagcaccggtggacaccaggagctgctggtcaacattggcatcctcatcgctgtgaccagagtcatctcacagatcagcgccgacaactacaagatccatggagaccccagtgccttcaagttgacggccaaggcagcggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctccgcccgcacctccaacgcgaagcccttccactcggacctcatgaatgggacccggccaggcatggcctccaccaagctcagccccttgggacaagagcagccactctgcccaccgcgtcgacctgtcagccgtgtgagccgggaggctgccaaccacggcaggctgcgctcagaacacacccccccaaacagaatgaaatgctccacctttgctcatggaccctctccttgctgatgtctggacatgggtgttgtggcccgagacagctgtctcccctgtgactctggctgtcggagcacactgctcagcccagcacgctgatgcccaggccagcgtgggccctcctgccttgcatcccacccgtgggctgagtgacttcctcgggggattccccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgggggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagattcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaagaaagtgtgctccttaaaatctgttgctggtggaatgtgaacaggacc

SEQ ID NO: 468774 - DNA, 1376 bp, Homo sapiens
ttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagcagctgctaccccagttccatctgtagtcctaaccagtccttggacccaagctggtcaggcatgaggaagtctgagaataaacagaatggaatagttgggaaccagaacttgaagaaatcacagcagctggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtgcccctgccatgcttgtgtccctttcagactcacctctggggctgaaacaggaaggcttggctccggccaggtctctccattgcctggagcaggactttaccccaaagagagacaacacagctgatgcagacggtggtaatggtggccagcagccacctacgctcattcctgctaggtaaccaccttggtatggggtgggggaatttatgtctgtatgcacatttgtgtgtacaaacagacacagagaaatcagtcctgtactatgagagggatgactagagttatgggaggctgtagtggggtggagggagtcctttaatctgccttaggatccccacctttcctgttcttccagacacccccaccccc

SEQ ID NO: 468775 - DNA, 524 bp, Homo sapiens
gcttctttgagggtcttggttataaatgagaagaaaaggatacattaagagaagaatgacaaaaatcatttctggtgttcaggagattgatccatggatattggggactgctatctggtttgggagtatggaagaagtcatgcttcatttgccactgagaaagtataaaccattaattagtagttcactattaacctatagaaatattactagtttggaggacctgctcctgctgcactggacggagctgcagcggctgctttgccttccttcgccaccagtcctggccatcgctggggaggtctgcggaccttggctccaggacctgagcggggggccacacgaggcccatggccctgcccctggctccgtcttccttggccatcagggcctcaagcccctctgcggcccccacctcgaacggggtcttctgcaagggactctcccacaccctccttgccttctttgagctggcctggcactcatgaacttccaatacttggtacatgtgcacaacgtgcagg

SEQ ID NO: 468776 - DNA, 596 bp, Homo sapiens
ttgataaggcacagatcctgacgtaacctgtaagacttgtccagtttctggacaggtaaaatgggggaattaaggcttctgaggcaagtgggcagtgtcagtcttcagccactgagccaagaagatctgggaaggagtcagtcagagagccttgggccagagttccaggggctctgggagtggctgccagatttccagcacttgaaacaagatactgggggaggaggtcctgaagaaatgcctgactgctgtggcttaggcgttttgaagttcttgtgtgctggagatgtggctggagtttctctcacagcagcggcaagtaattgcaactcttctgtattattgtacaccttgaagacaaggttaattaagacctgtgtggggtttaagggccaaaatctaatttttggagctttatttaatgttgggaatgaattgcgtaataaaatgcatattgagaataagacagccttctgacctttcagggtctagggctgtgaagcgtctcagagttgctgccaaataagtcatgaactggggtgggtttttacatttgatgaaaaagagcctaaacactaactgatttgggagaggtc

SEQ ID NO: 468777 - DNA, 704 bp, Homo sapiens
cactccccagacctgtccccagtcagctgattccagcgtcttctcccgcttatgagaacctgcggtatttggttttctgttcctgtattaaactggaacaagacaaggatgtccactctcatcactcctattcatcatggtactggaagtgctacccaaagcagtcaggtgaaaaaagaaatgcaaggcatccgaaaagaaatagaagtcaaactatatctcttcatagatgatatgatcctatatctagaaaagcccagagaatctgccaaaagcctcctagaactgataaacaacttcagtaaagtttcagaatatagaatcagtgtacaaaaatcagtagcttttctatacaccaataatattcaagctgagagccaaatccagaatgcaatctcatttttagtagccacacacaaaactaaaatacctaggaatacatctaaccaaggaagtgaaagatctctgcaaagagaactaaaaaatactgcttaaagaaatcatagatgacacacacaaatagaaaaatatttcatgcttatgaacagaaagaatcaatattggtaaaatagccatactgcccaaagaaatctacagattcaacactattcctatcagactactcatctcatttttcacagaactagaaaaaaccattctaaaatttatatggaacaagaaaacagcctggatagccaaagcaa

SEQ ID NO: 468778 - DNA, 1405 bp, Homo sapiens
gcacagtctctggtgggcagtatgttgtgtgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggcaaataaatttgagaaatagagattctgtttaagtaatttggaactgaagtaaaggaaacttctccagttagtttgaggaaggagcacttctgggcaatattctggagtctgtaatactcagtgtttttggtgctgcagaataatggtt

SEQ ID NO: 468779 - DNA, 889 bp, Homo sapiens
taagtgttctagcaagctgaaatggacactaaatcgccttttttgacccagccgtggaaatcacatggcctcgtggaagtcaaatggcatcacaataaccataatccatcagccgcactcttctccttgtttttttccagtctctgctccttctgggactcaaagtgcaagtgcctttgcattatcttacaggggacaagcaaataagaatgaatgctatgttggaggcattagaggagtcccattgtatgagaaactcttactcccccaaacaatattttactgccccttgctgcttcctcattacccacccccaaatattccaggttttctactttggtcttgtaatggcagagacctaagtactatttaccctataggcaataacttaggacatatgtgcctgatcttctcagagtcagggatcttctctgtcttggttacctctgtatcctgggcccaagtgcagggactgctacatatatgctctcaaaaaatacttgtcaagggaataaatcagtcggtgcaggctgaatataaacacctgtttgagaatggttgccatagattcatgatccgcctggaggggcatgaaggaacagccagttttactaagcccaaattcttcttctactactactactgctactactattactactactacctgtgattctgtgattccctacatacaactcacacttctgtgaagatactttctgtaaacaaaccctcctgaaaccatcccgatttgaaaagacatcatgggtggctttggaggatggacacgactggaaaggacacagatgggccctctgtgggcttctataagagcaaagattagcctcctgatattccgtgggaaatgaggagacacactacacagccc

SEQ ID NO: 468780 - DNA, 1045 bp, Homo sapiens
aagatcaggtagtatagcaatagcggatgcccctcccccccgccaaactcctgtgtcccaggtcgatctcagactgctatgctagcagcaaccaaggctctgtggccgtgggacccaccgagccaggcatgggaggggatctcctggtctgctggttgcaaagaccatgggaaaagcacttgggcaggagggtactgctcctctaggtacagtcattcacagcttcccttggctaggaaagggaaatcccccgaccccttgtgcttcccagatggagatgagaaatttattgggaactggagtaaaggtcactcttcctatgctttagcaaaaagactggcagcattttgcctcttccctagagaactgtggaacattgaacttgagaaagatgatttagggtatctggcagaagaaatttctaagcagaaaagcattgaagatgtaacgtggctgtttctaaaagtgtatacttacatgtgtgaagaaagagatggtctgaaattggaatttatatttaaaagggaagcagagtataaaagtttggaaaatttgcagcccaaccatgcagtagaaaagaagaacccactttctggggagaaattcaagctgggtgcagacatttgcataagtagtgaggaactaaatgttaatacccaagacaagggggaaaatatctccagggcatttcagagatcttcatggcagcccctgccatcacaggcccagaggcctaggaggaaaaaatggttttgtgggccaggctcagagccctgctgctctattcaggctcgggacatggcgccctgcatttcagctacttcagctctagccatggctacaaggggccaaggtacagtttgggccattgcttcagagggtgcaagccccaactcttggtggcttccatgtggtgttgggcctgtgggtgcacagaaggcaagagttgaggtttggggacctctgcctagatttcagaggatgtatggaaatgcctggatgtccaggcagacatctactgcaggggtggagccctcatagagaa

SEQ ID NO: 468781 - DNA, 3525 bp, Homo sapiens
accaaatcagactctctgggggtagagcctgagaatctgcactttcaagaagcttccaaagtgatctttgtgataaccaccaagcaagaaataagaagacttaaaaaaagtaccaattgtgggcgctgggggacctaagagactgagaaagagccaccagaatggttgactgggtgttgggtggacagaagtccgagggggtggccgtcagccagccttggagcagttcaaatggaaaaagtctgtgcacatgcctgacacctagtcaccagcagatcaatggtgggctcagcagggctcctttcagcaccaaaagcatagactacaccacaggcaacaaccagggtgtttcttgctctataaatatttgcaaggtgaatgcacagaaacttcttggaacttttgaaggagcatcattaacaccaatatctgatcaatttgttctaagaggctgtttgctaataagcatctttgaaaagataacccacaacaaaaagtcagtgctcctgctcataagatgtgcagaagtaagagcgatccgtggagaattgcctctcaagagcatgtggacatggactaaggaaaagttacaaagactaatggcaagtcaaggaatccgagttaacattcggtgactagactcccaaatgcgtttcacaaatgggtttccagaaaaactgctgtcagcaattgattgtgatatggggcaaatgagtttgcaatttcatgatgaataatctatcactccctatcttagaaactcaggcattccatcttttttgacaggcagcatgtatattctattgccaggaaggaaggcagttgtcaaattcctaatttttctctttgaaaaattaaacatttaactcaaacgtaagatctagaggaacacataagatcttaattacaaagtgcaatccaagatttgcactaattaatatgctgatgaaaaattcattgaaattcagagaagaaccaagagggaaaaaattggccagtgttaacactgagttctataaaatgtgtaagtctatccaaataggcagctgcctttctcggataattatcatttcatcattcatgattattttatttgtaagactttagttgcacatccaaaactatgcagacagaatatttccttaaactttctgatttctaacagttaaattatactagtatatgagggacttttaaagaccagcttagttacctgaaatatgggggttttttgtttttttgtttttgtttttgttttttttttaagtgagagaagccatgtgcttgattcctggttttggcattcactaactgtgacctcccgcaggttgcttaagccctttgagcctgttcctcctatccaaatggggacaataataatgcatgaggttgtggtaaggaatggctattgttgtgaatcagttgcatgccttccttttagtcttcatcacaccagacctggtactagatggggactgaaatatagtaactgatttgttattgatacagctgggttgatgaataagctaatgccagctgtctggattcaaatccagtacctgtgtgaccttaggcaagttacataagttcgctgctcagtttccttattggcaaaatagggatgacaattgtactgcatggtggttataaagattatacaaaaatacaaaaaacacttataaattgtacttggcccatactaagcactttataagcgttggctgttataatcattattactattatttaccaagttggtgatttttctacatcctaataccactaggtctattattatttcctttaaatcaactttatcagtctcctgagcagtgtctgtggaattacaggttggaagggatagttatgtttatataatacaattgaaaataaaatacataatgatttaaataaaacctgatcatctgaactccacgcccgccgttcctcaccattatttcctctccaagtacaccgggaataacactgttttatgatgttactcaatcattcattcatctgtctgcagagattataagttgcatgaaggcaggcaccgaagctggattcatgttttactctgcaaacagtttacaagtgccctagaccaggggtccccaacccccaagccacgaactggtaccagtttgtggcctattaggatctgggccaccagcaggcggtgagtgcaggtgagcaagcattactgcctgagctccgcctcctgtcagctcagctgcagcattagattctcacaaaagcccgaaccctattgtgaactgctgatgcgagggatctaggttatgcgctccttatgagaatctaatccctgatccccaaatcatccctcccgactccctcccatttgtggaaaaactgtcttccacaaaaccagtccctggtgccaaaaaaggttggggactgctgccctagactcgtcacacacgcttgataactgttagtgaaatggatgaatgaatgcagttgactgaaatgcatcaactgatgttcaggaacccagaacattctacatgaaggtcagaaaataataaattaagaatttcacaataaacaaattgtgaaataaaatagcaaattaagaacggacgtgagctgccacctccctcttcccacctgtaccccgggacaatgagaatggcctccactcttaattttcctctcttccctttcaacagactaacctcctggctttttgacagcaagttgaaggggtttttaagatggaatgaatcttgcagttgtaatgaatcagaaattgggggaaaacatcagattttagcagcagcagaattctctcactgtttaaaaagcacttgtcccttaggcttggagagattagaagttaataatttgtattgaaatccagcaaagctcttcacagagtcctattgcttgtccctgtcttttgaatgacaagtaggaaaatagagactgatttgaaaacctagggctatttaactaaagcagcaataattcttccattagaaactaagaaatgagaaggtaggaatggcccagacaccacaacaaaacagatgttgctggtggaaggccacacctttttccaaatgaaactcaccagcccttcaagttgagttagctttctaaccctctggacctcaaagtggcaaaaatatttttacatgctagttaaaatgccctcaagctacagtcattagatttgctggacagtggcatcattctgatgttatcggctctgtcttcccgttttcatgaataatgtataagaagcagctattagaaatggattcttccatggctgacagtatcaccaccagacaagcccctggattctcagtcatttcatctgtagctctaacagatctcccttcttttccctctcactgctttctgcctgcctttcatggatggagactcttccaaagactccttatccctgcttctccctcaatactaggaaactggcagggaggcaaaaggaggagcccattaccttcctgccttttaactgttgctcagtgt

SEQ ID NO: 468782 - DNA, 541 bp, Homo sapiens
acaaccatttttctctcctatgcctccaggcctctgtttgaaggggagaattgactcacacggttaccacatgataggccttttgcaagctacggagcagggaagccagtctgagtcccaaaacctcaaaagaaggaaagctgacattgcatatttcagtctatggctgaaggcccaagagcccttggcaaaacactggtgcccctctactgcatgtttgctagagtttgctggaggtctactccagatcctgtttgcctgggtatcaccagtggaggctgcagaacagccaagattgctgcctattccttccctggaagccttcttatttggggcttcctccaaccaagccatcaactcctccagaatagacagcaccttgggaaacctcctgaaggtggccaccttggtcttttataatagagaccaggaggagacccaagagattaaaaagaaaacacaagagagggacagaggctccagtagctgctttcaagcttgcaaattccagtatctccaggatgcatctgctagttgatac

SEQ ID NO: 468783 - DNA, 674 bp, Homo sapiens
tggagaacctttatgtctagcattgaaatctgcttgggtccccttccacgctgtggatgctttgttgtttcgctctttgcaatgaatcttgctgctgctcactctctgggttggcactgtctttatgagctgtatcactcaccgcaaaggtctgcagcttcactcttgagccaacgggaccacgaacccacggggaggaatgaacacatccaaacatcagaaggaacaaactccagacatgccgcctttaagaacagtaacactcaccgtgaggatcatccagaaggaaccaaccctgctaaaaccttgactttagctcagtacaaaggatttcagacttacagcctccataaggagttatttggctatgagcatgatttatccttcaaaaaaggcaagagtgaccctaaaggcaattcagagatcatcaaggataccactcccaaagcttgcagggctagttcctccttagtttcaaagagtggggttttcaaatctcttcagtttttagagggtcaaaatgcccccatccagtgcctcagggtggagatgtccttccagagagccctaggaaggcggtagatcctgagaatgtgcaaccaaagtggttgggttacagcttggttttacacattttagggagacataagacatcaactataacatgtaagatt

SEQ ID NO: 468784 - DNA, 3388 bp, Homo sapiens
gcggcttcattcttgaagtcaaggagtacccggctgtgaagtgtcagtctgcccctactggggggtgcctcccagttaggctgctcgggggtcaggggtcagggaccctcttgaggaggcagatttcagtaggtaaaggaaaattacagtcaaagggggttggttctctggcgggcaggagtgggggtcacaaggtgctcagtgggggtgtttttgagccaggatgagccacgaaaaggactttcacaagagttacccgaagctcagcatccgtgatggtttaggagcttcccaggtgattgggcagtgtcagtctttagccgctaagccaagaaggagtcagtcagacagccttgggccagaattccaggggctctgggagtggctgccagaggttcggcacagaaataatggattggagcacagagataagaggttggggcacagaaataagggattggagcgcagagataagaggttggggcatggaaataagggattggggtgcagagataagaggttggggcacggaaataagggattggagcacagagataagagattggggcacggaaataagggattggagcgcagagataagaggttggggcacggaaataagggattggagcgcagagataagaggaccaaggcaggcatccctgtgtggtctgacacctttgaaacgtgggtgaataatcagagaggcacccctgcaatgattaaacaccaagggaaggctgacttcccagtccatgaccggcgccagagttttgggtccacggataaaacatgtctcctttgtctctaccagaaaatgaaaggaattgaaattaagagaagggagagattgaagtgtggcaccaagattgaaaggagaaagaggctgagggatagtgtgggaggttggagaagagagtcaaaagaggccgcttactggatttgaaattggtgagatgtttcttgggctgtttcttcaccgacctaatgatccgtaaggagcatgtttcttaatttacttgtgtttgtaccatttctaaacttcctcttgttattaatttacacttttagttcattatgtcctgagaacgtacttgatgagattttgttttttaaaagtgtgttgaaacttgtttgatggcctaacatatagtctatcctggagaatgtttcatatgctaatgagaataatgtgtattcagcagctgttggaaataatgttctttaaatgtctgttaggttcatttgaaactgaaaaaaaatcttgaatgcatccagaagaaataaatatgaatgaacatatttaagaaactttgaatcattcaaaggaggatatgcgctgccagcaattaaaatgtatttttataatatacatatgtaattcttacatggtataataatggtcagaaataggcatattaatgagattcgtaagtctccaaacactcataatatagtagagttcttaaacatataaaacagggatttttcaataatcagaactggaacaagtggccaaccatcatccaaataatgtttccttatttcaaaatagaacgtcgaaataaatccatgtgtattaaacatcttaattttagaaattatatcataaagtgtagataaatgtaggtaattatccatcttaaggtaagaaaacaattttaagcacacatgcaagtataaaatctgttgagaaaggagatataaaattatataaacatttttaaaaactgtgagtcaaaattacataaaataaaattttaaattaagacttcaaattaaaaaacataattagaaaacatgggacctgtcaaaggctaatatcattgattagataaatacccagagaaaaatattttaagagactgtgaacttatttattaaaaaagtggatttgaccagtgcactaataaaagttcaaactcactattcacaaatcgtgtatttgtgaaaatacacaatttcatgtatttttatgcaaatacattaaaagtaaaacattgaaatgctatttttaacttataaatcaataacttggtgaaagtttaggagaagctaatattttaaatgctgtttgtgttacactctattacctttcctttcttgaatgctattggttaatatgtttgaaacattgtctccaggaatccattttaaagaaataaatgaagagaggaaaaaaaggtaaatgcataaaatattctttgtagatttgtttatacagccaatagaaaacatatgaagtagaattaatttattaataattttgttcttaaattcttgattatattagcaaaaaatcttggcatcgtgggtaaaaaaggagacgggaagtaaaaatatttaagacttttaatcttatacaaagggaatcaataaacagtatttattattcaattcttggtatttctaagtagagatggttattgttatgatagatttttataatttgtgggtcattaattacaaaacaattttcagtttgctaaaatacttccatatttctagcagaaatatagaaagtaaaaatatggtacatttagcatatgaaagaataaaagaaaaaccataaggaaacatttaaaaaagtaataaacaatgaaacagaagtaaaggcaaacatctggtatgacaattaaacttatttaataatagacaaaattttagataaagtaaaaataaaatccaatttcttgctgttaaaaaataactaaccataaacaaaacacagaaacatttaaaaagtaaagggaggaccaaagatacatcaatcaataaaatagcagaaatggcaatattaatattaaaatagaatttaaaaaaattaagaatagcagtttttaaaatcaaatctatacataatatgatagttataagacataacattaaattctacaaataaaaataactttttaatggaaacaattcacaaaaacttgattatattggaaaattttagcatattactactctcaagccttgagagagaaaacagaataagtaccaaatatgcaaatagcataattagatttgataaatatatttccattattttcctctatgataagagaatatactttttcttcaaaatccaaaacatttttacaaattgatgattttaaaagacaaatttaaattaaaatatccaaacagaagaaaatttttaaatagtctccttctagagtaaatagaaattttgagtcaaatagaaaatcaagaatgcatttgtaaacaatttgagaaacatcattgatgctacagcatgttcaaccttttgaatcataaagctgtacattgcagcaaataaatgtttgaattattacaccagagaatacagttacaagcctacaaatcaatcatttaggaaaatattttaaaaagtatgtct

SEQ ID NO: 468785 - DNA, 1486 bp, Homo sapiens
tgctgaccttctgctgtgctgccgggttgctaacaggccatgcatgaactggtactggtccacaacctggggcaagatggatggggagctggaagagggggatggaatggaaatgtggtcttcctcaggagttgggctgcccagctgccagactcttctctaaccgcccccggccgaactcctcttggcatccagatgtccctgctcttctttctttctctgccatgtcgttctgccgttgctggtctgccggtctgctggtgtctgctggtgtgttcttctgcttcgctcaaccttcagctgcttgcgtctgtgcctgctaaggccttaggtttatatgggaacaggatggggggcatggtaggccagagcagtcttggaaaatgcaacatttgggcacgaaaacaggagtgcctgttctcacttaggtctgtgggcacaggcctgagggtggagccatctccagggacactgtccttttttacccaatacttccctggcccccatcctgtgtgagtgagattcttggaggtaaaactataaaaagtgtggaggcccacctgactatgatctccaggacttcctgattgtgatccccaggagtttctccctttcactctagtccacacttagcctccagcaattccactatgccaattccaaatgaccactgaagcgttcctaccagtttatggcttcaacatcttctgctccagataaacatacctcaactctggctctggatttgtccatttctccattttggaggagaggggaattgccttgtaactttagttctttattgagcccaagtaaagttgttgattttcagctttcttgctttaaataaatctaatcccaacataatttccaatcttttgcatgcattttcttctttaaacttccattattttctgtttcttattttctaaaatttcagtgttatatacctttggtgtaggtttaaaaaattcattttattgagtccttaatgaactcttaaattttaggattctttttagtatgtctttgaaaatctgctttttgtttcttgttgtttggatatttattttttctttgagcctataatttattatcttgtttaccctcttttatatttttggcctactttctgggatatttctttaactttgtaattcaacttttctatgaattctgttatatattttgttaccatattttaagtttcaaaggactttatttttagtcatctgaacattccttttgttcttgcttcattggattgtgtctcagtccatgtgagaatattaattatggtttttattgaagatttcttatgtttcctgcattatcattttttcctagagttgatttctgtgtgtgatcatttgcttgttttgtctctactttcatgttggagactctcttcaaatgtctagggatccttgactctcccctcatatttaagaaggaggcctgaaaaagaggccacgaaactcggtgt

SEQ ID NO: 468786 - DNA, 777 bp, Homo sapiens
aggaggaaaaaatggttttgtgggccgagctgagggtcttgctgctttgtgcagtctcgggacttgatgccctgcatcccagctgtggctaaaatgggccagtgtacagctcaggccattgcttcagagggtgccaaacccaagccttggcagctcctacatggtgttgagcctgcaggtgcacggaagtcaagaattgaggtttgggaacctccgcctaggtttcagaggatgtatggaaatgcctggatttccaggcaggggtgtgcttcaggggtgatccctttatggagaaactctgctagggcaatgtggaagggaaatgtgggatgggagcctccaaatagagtccctactggggcactgcctagtggagctgtgggaagaggcccaccatcctccagacctcagaattgtagatccactgacagcttgcactgtagaggtagaaaaaccacagatactcaatgcaagcccatgaaagcagccaggaggggagctgtacattacaaagccacaggggcagagctgtccagggctgtgggatcccacctcttgcatcagcatgaccaggatgtgagacatggagtccaaggaaatcattttggaactggaatattctgggcccatgcttggaaagcagtgccaaagtggacggcagcaactgccttaggaaaaagttcccagaaagcaagacaagatgcagagtaggatgaagatgtgatctggcaccaggagcaaggcattggtagaggaagaactagaataattctggaa

SEQ ID NO: 468787 - DNA, 491 bp, Homo sapiens
gcgcacgtaaaattcacttctccttttgagtcacggctatacatggggcagactgatgggttagcaactattgatcactttcctgtccaacgattgatcattttcctgtccctagcatcggctggcctatttccacctatccttatctccatcccttcttctcctcatagaaaaccttccattttgcaactaaaggtgtcctccccatccccattcgttgaggtgaagaacaacaatgctcatacttcacacatattagattttgttagaactctggccacgtgtacacactcacaccagcagcagcagggcagcagggtccacaaccccacatacgtgcaagggtggggcagcagcagcaaggcaagatccatgcatgctggcaaagtggtcaggaaaggtgatgggaaggtgcacatcagtaggaacccatctgtagaagctctctgatgtttatgcagggtctgttggtgaaggagctatggcagtgg

SEQ ID NO: 468788 - DNA, 765 bp, Homo sapiens
cttggttcacagggcagagtaaagtttaaggaattatttgtgcataagaatgactcttaacttgctcggggagtgagactctgccggattcattctggataagatgaagtctagggctttcccaaacttctgtaagaaccacaaccaatccatctgggtttctctgcaagcccagagtccccaggatgaaagctcaggccccagtgacccctttcctcttccctctctgcaagtcttatttctctgtttggataacagccacagatagtaacactaaacatgatgatgatgatgatgatgatgatgatgataatgaggccaatatttatcgaccacacgtgtcaggttctgtgctaagtgcttcacatgtgctaactcatctgctctttgcaacaaccctagaaggcaggcaatacaattgccccattttacaaccaatgactgctgaagtcgtgaagtcagacatctcttacattccaatcagagatagcagatgtcccaggaacaaaacatgctcatccgctcttggcacgggagtgtcactcaacttgcaggagactttcaaagccttaaatgtttaaactatgagctctttccgttagctcagaagttcagttcttacagaaaacagaaaattaagattttggataaaaatccttctaagtgcaagtgaacttggagagttttcccaggtcattaaaaagggaaaatcagcctccctaagaaaacaaattctcctctcactgtaagtgtgggttatcaatc

SEQ ID NO: 468789 - DNA, 803 bp, Homo sapiens
ccagttggatccgtggccactgcccagatccccacaccatgctgtcagagaagaccttcaagcagtgctgcaccttcaaacaaagagtagatggtgagaaggagcttcctgtcctggataaaacaaagttccttgtacctgatcacgtcaacatgagtgaactcaccaagataattaaaaggtgcttacggctcaatgctaatcaagccttcttcctgttggtgaatggacccagcacggtgagtgtttctacaccaacctcagaggtgtatgagggtgagaaggatgaagatggattcctgtacacggtctatgcctcccaggagatatcagacttcagcgtgcagctggaaacttgtctaccagttgcttctatcctcacacttcacaacttcaccgttagagagacagcaagagtcactctctctggttccttgttgaaaaagattctagagcatggttttaataattagccaagcttggttgacgtgcccaattctggagagccaaaaaatgatagtatttttgaggctatgatgaatcaaaccactatgaatatttaagtataaatcttggtgtaaatgtgtttttctttctcttggattaaaacgagagatgggattgttggattgtatagtaagtgtatgcttaacctaataagaaactgcctgtttcctaaagtggacatacaatttgcattgcttccagcaacagatgagagttccagttgctctacatcctcttcattctaatggtgtatgctgtgcgttgtagttttaatttgcattgtcataatgacaatc

SEQ ID NO: 468790 - DNA, 1294 bp, Homo sapiens
gagttccttctggggctgcctcctcttgcatcccacaggcaaggtgccctgttcctcttgcacccactctgatcccactccccatcttctcaccgcctctctgtccaccccaacaacacacctgccccatcccctcgttctgctctttactcatggcctcttaccctcctggaggctcctggcacttaatacccaacctccgtcaggatattacgatgaggacctgccccaccagcgtggaccccgacaccctgtcttgccacagggtatttgtcaaggtcttcgtcttctccgctagaggataccgggcctccagccctcttggtctggcacctctcaatccagaagatgggctccagtctctcaatccagaagatgggctccagtcttttttgcatcgtaccttcggcatctgtaaaagcgacacttcagccatggaggagaggcaccctgtgaagccttctctggttcacaatggccagatgactgtctcctttcagagccagtttgctgtgacattgctttcagtcttcctcgtttcccaggagtctcatgtcttcggtttccacgtgggatttgtgccaactgaccctgccgttaatgaagtttgcttgcaccattgatcagcaacgtcctaagttttggttgttatggattttaaaaaccccatcaatttgtacgaataaaaacaaaacaaaataaaaccgctttcactgatactaatgctttaaaaaaatagtataagagttagaagtggcatctccaagtggaaatttgttcactagtgtccattttgtccccaggggacagttaccaatgcctggagacatttttggttgtctccaaaatgggggagggggaaggggctactgggacctcatggggagaggccagggatgttgctaaacaccctccagttcacaggacagcccctcaacaaaaagtatccggctccaaatgcgcaaaggttgagaaaccctcagctaccctttgcccacgtctcagtagagagtagaacatatttgctccatgaatagacacatgccagtcatttttctttcctttgctgagatcatccggtcacattctttgaccaggggtgtgagatttggtaaatccagctccaggcccagcttggtcattcacttgtttcgtgatccgggctgatgtttcacatcaagtcagtaaagccttttctccttgtcctgtacccacattgagctttagtgaagaccaaatggggtattgggcaggaaacgatttggaaaagtataaggtgccttacaaatcaaat

SEQ ID NO: 468791 - DNA, 3156 bp, Homo sapiens
acatcgtaatgacagatttcacgatctgggcactcgccttgtgccagatgtttttgcattcacgatcttttggatcttccagttaatcctgcagagcaggttcctccctccacatccattttccatataatgaaatggaggtccagagaagacccggaaatggagacgtgcacgcaggtggtttcccggggcgtgctcttacaacaaatgcctgcgaggaattaggacggcaggagggggccaagaaggaagttgggctgggatgcagctgcaatggggagctctggagctggggtgatctttcagagatgccccaaattgaggtgaagggggctgagtcttcacacccctgcatcaactgtacccatgcctatcactggatatgggcgcctctgcccaaggtcatttccaggggccctggtatcacaggagtctgcaaagtggagctggaaaaggccagcatggagctgagcgacctgcaggggctcggccagctggtcagctgccggctggggcttcatgccaggcccaaggatgccccggccagcctgctggtccaccttgtgccctgctgcctcaggcctcgggcaggggaaggaagggtcatcctatggcttgccatcatcttgtccctgttcccttccagcttccgaaagggtgcctgtccccaatttgggctggacagttggcatggatgggggaagcctggaagacggaggtgtgagaacctgggtgtgtgagtccagcctttctccccagagtctctcctctgtatctgccttctctgtgtctctctgcttctcagtctcttcccatcttcctttctcctttctctctgcctctctgttccctccctcccttagtctctttgcccatctctgacttccaggctctctagatctaactccatgtctctctgtctttatgtctttctctctttcccataaaacaaggatgtcacccccgcacaaggatagtgatccttcagcccctcccccccaccaacacactgtccttaaatgcacactaaaaccctaaatgtccatggtgtaccctcagctcatgggtccccactgcagccatctcatctaggaacccaccctgtcttcttgtgggtggaatgaagttcacccttgaccgtcttaaggacactccctctgagcccagggcacagcacacagtaggtctttgggaatggtttgaggagtgaccatgatgggtacagctgttcaggctggtcctgctgctgtgtggttttatctccgagaaactcaccctcccagagtggaaggaagagaagcaaacacacacacccccacccacctggctcccctcacccttccttgacagaggaaagacagttttcttgtctccggctgtcttccttcccatccatcatttcctcttttctgctccctcctccagtcccacacccaatcactcttactgactcctggtgccctcccccaatctccatctccattggccccaacgcaaacagtctctcctccttgcagggatcagaagtgagccagggtgatggggagggaggtgtcttgagaatcaagagtagagatgattccgggatatgcatagagctctgttggttaatagcccggaagcctccctctccccacacctccagtcacatggaaggcggggagcagaatttccatctgagatttctcagggcttcccatcttaagtgagaacccaataccatcctttaacaatgatattcaaagttataccgtgatgctatgttgtaagcatttatccatgcttagatctttaagaagtaatttataaaatttcaatacagaatgatccaaaccccaacaaaacaaagcaaaacacccaggcacagaaaacagcctggaaagaaataagctataatattaatgttggttttctttgagtggtgagatgctaagtaaaacatgtatacttttaaatctttttttctgtattttccaaatatttcttagtgagccttttaagattaattcattgttctcaagtggctatgtttatccatgcagctgtatatgtgcttaacattttgaacacctatttaacagtgctattttgaaagtactttattctcgtgtttacgttttatttatttttggagtaggtaataccttcgtgtggtttataactcaaaagctaccaaaaaagtatgaagtgaaactactacctctctccctccctggccacctggctctccttcctagagggaaacggtagcacctgttccttatatatgcttccagcgacaacatcatgttaggaattcagaaacatacatactcctttaagaatagagattactcaaggattctgtagcaccactgagttttcccttctgcttcaggagacctagtcctgggccaaagtattcctgattacaaaagcaatgcctgaatgaaaacattctggaaacaggcaatatagaaccttcactgtaattgtaccctcagacacaatcaacaggaacatcttttggttaatattttgctgtggtttgaatgtgtctcccaaaattcatgtgttggaaatttaatccctaatgcaacagagttgagagttgggacctttaagagatgattagttcttgagggtgctgtcctaatgaatagattaatgttgttaatgtgagagtgggtttgttatcaaagtgtgctggcccgagaatgaccacctcaggtgagcctcctggatctctggctttgggcattcccagcaggtgggaggcagcttaaggcaggctcttagcaggtgaaaatccagctccagcccccgctgagccccagcgagaaaggaattgcctgcaggctcttccctaatcctccaacggaacctccctcacttacctctctctgtggtaacaaaggatctttctgctctggtggtcacattcctgacagcttagttcagaatgggggaagggacagcaggattttggggggccgttgggcaatttctattggcctgagtttcctcctctgagaaactgacacagagtgggaagaagacaagcagcagaagggtcagtaggcaaaactgtattgctgatgtgttgtgtattaccaacctccacgcttccccatttcagacttagatgtgctcagcaagtgtttactgaaaacccgg

SEQ ID NO: 468792 - DNA, 807 bp, Homo sapiens
gtgagttcaccttgagtgcctactgtggatctagtgctattctaggctttgcagataaagagatgaacaaaacagtgtctgacttcttgaagtgagcaatggctatgatttattattattattttatgatcaaaaggttccagggtttttgagactcttggcggatgctgcagatgggtgcagggagacatgagggtgctgctggggagggcagcggaatggcttcatctgggacctttaatcagatccctgagaaaagtccgtgcaaggagaggatacaggggcctccagtctccgtcaaaatccccgacacctcctgggtgcattccagcgaagcatccccggggtaccagaggcgctgggtccggggccctcgctggggcttttcagcaaccagggaaagcacttcctatctggtggctatcatcatcatcatcatcatcagcagcagcagcagcagcagcagcagcagcatcaacattgttacctgtctcaggacactggccaagaatactttcattgaattgcaaagcatctcaatcaaaaacaaactgccaaatgccaaagctcaaagcttgctaaaggagaacgacaaatttgctgtataccgagagcccacagcaaagcggagcctgcattccagctttggatcctttctgctaccaacgaggttctaatctgggcttcaggggtgctggggtggatatgggaacctcctgaggctgcaaacaaaatgttctgaatgtagacaagtatttttctggggagagggtctggagcttacataaggcttaaagaggaacgtaa

SEQ ID NO: 468793 - DNA, 597 bp, Homo sapiens
ccgcctctggcttctctgttctcttcctgcgatcgtctctctccgataaagaatgctggcctcggtgggcacccacagtccctgcagttggactaccctgctcccagctcccataaatagtttggctgataccttgaggactaaagaagtgcatggtggggcactagtcccagtggggctcctcatctcctgtcatgaccccctcagggactgggactgtggcagaaatcagacccattgtacagatggggaagttgaggttcaaaagatacagccacccacccagggccacactgtgattagaggccctctgactcctgggcctttacacccatctataggaggatggccagacctggttggtgaaattgaagtacccccactcccactcaaggccagtcctctagcgccttatcttcccttgtcttcttgtggaagaagagataaaagtaattcttatggccgcttcaccactggcgacggccagccccgtccccctcctgctgcatttccctggtccggccagataaagggttaggcctaagcacatgtcattttctttgtgtgaaatcaatattcagcaaagtttatctgccc

SEQ ID NO: 468794 - DNA, 1717 bp, Homo sapiens
caaggccacctgagtaacgtgctcagagcggaacctggcaggcatgaggcagccgggctgcagcgggccggcccctctccctggttagggaggcgtggagaagcccctcaccggggcagcctgccctccctccacctgcggcagtggccggctgggcaggggagagcgagaggctctgcggataggacccggggtgggggcctgtcctgaccagcgagtggcagggagcagcatccaagacacttgcccttggaaccgagccgccttgttgtgaggaagcccagtccacgtggaacggcatatgtaggtgtgctggccgacaatccagttgaggtcccaggcagcagccggcattggccaccagacagaagttaattaagtgctctgcctctggagggtgaatcccattatcagctgcacccccccgaccccaacatcagctgtgtgtttacttgtttatggtgcagtgaatcgtgtttgagagatgaagccatgcagggaggcttgctttctggctgagacctttaaagccagcagcctctgagctcatccagggtacgttcttcagcgtttccgatgtccttggctcagtcgggccatcttggtggcagctgcccggagctggaggagaacaggcctcaatgtctcctattattactggaacgtcaagtacccctgaagtggagggcaaggctggccctgtctgccagcgacagggcgcgccccaacaacatctactacgaggatgaaatgagacgattcacagtgctggaaagcacccgaccaccccgagggcagcgccctcatgctaatgtccaggttacctcccggggtcgaggagcagagcagatggccctgtgccttcagagtcacgtgctcatgactggcattccagcccttaggatgatgtggggacaccctacatccctccacccatggccccacgggctgctctgtaatgatccccatgtcttggcatgtgtccttcattacagccccctggatggagcatggctccccacagccatcctggaccctgcagctctgggccaagacaactgtccaagatggggctgcctttattggataattattccagcgggaaatctgtgggaagtttccggtgacctggctgtgagttaggaggttaaggtaaatgtgatcctgtgggaaaataaaatccctggattccctcatctctttttttgggccttcctcaccccctcaggtgggactgcaggctggagggagctgtcctttgattagatctgcattgagggcagggaggctaacactgtcattggatcaacctggggttgaaaagtgcattttcccttcttgtcctcagaacagccctatgaggcagggaaacaggaaaaatgaagaccatctttgaggaataaactgacttgcctaaggtcacatggtcctctgcctgactctggagatgcaatgggaatgaaacaggcgtggaccttggccttgatctcgtgaagcggcagggaagatgggacttaagcaattgtataaataattaactcattgcagttggaggacagcctcaactgaagcaattgtatctatgaaatcagaggttcaaggagctggttatatatttctagcatgcattaaatatgtagctattatgtaaaataaaatgtcaaccaaacacatctccatgtgtgccccattcttaaggtgggctgctgttccaagc

SEQ ID NO: 468795 - DNA, 882 bp, Homo sapiens
ttgcttctggggaggggaccgaggaatgtagtcagaaaatggttcgcgagggcaatgccccttgtatcagcctggctctggcctcaattcaaattgaggaaattgaggagagtttgatgaaggggaaagtttaccaatatgtgtgcagggtgtgggagagcacggtgctcagggctactcacagcaaggagcaggaccccaacatgcttccctccctgcaatctcattttggggatcccctttggccaaaccaaactggaagccagagggcacagtggaacctgcaggatccattccaggccatctcccacagcactgagcagcatggagaaggaggtggtcttgggctgaccacgcagatccctgtttctctcaagttggcccgctctgcacatctccctttgcttacaggttgtgatagttcctccccttggtcccttctggtctaagattggcaataattttcctctgctacccagaatcctgtgtcctccctcctggtccccttccaccctgccatactcctgcaatgagtgctttgtagatcatcctaactgcactgtgtaatcctgttgggaccctaactagtaggttgtaaatggaaaatcagctctatttgctgtcacttgcagggaaccatcatcataaatgtaataaaaatgatgtttatttttgaccaaatgaaataaagtctttgggtgtctatttaaatggacatgttaaaatcataatagcactaagctgagactttcttctccagctcacctcaccccagccccctgcttctactcctggggatcacttccccaaataacctttgtgttgggctctaatttggggaaaacccaaggctaggcagctagtattaatactatgtctcta

SEQ ID NO: 468796 - DNA, 571 bp, Homo sapiens
gccgccacctctgccagaggtcccatcttgtctggccccatggtgtacttggctttcagagaagagatggagatgaagggcccgcgaggatgttcagctggtggtcccaagaagactcagaacaagatggttagaggcatggatccagcagccagaacaccagggctcaatagttctgcccctagttactatgactcatgtgcaagtgaacttactgaatcctcgaatcaactgtttgccttccgctctttggccctcaaaggtcctggctgggctgtgctgagaaggaaactgaagagcagttctctggaggagctgcttttagacagtgcagatgaagacccgagacccctgacacaagctcacaggcagagggggaaggctcttgctggcgaggtgctcattggggtcataccagacaccagacagaagcgcagtgggaacggtggtggctgcttctgagcagctgcccagatgcctccactttgaagttctcaaacatgctgagcccagagccagaaagcactgaagttggtgttcttgtctttaatcagaagtgtttcaagtgtcc

SEQ ID NO: 468797 - DNA, 1091 bp, Homo sapiens
gctgactttctagacagggaaaagccagtaagcgaacacatggcacatgtatgtgacataagagcaggctgtgatcagtgccacaaagacacagaaagagggggtggtgtctgggcggagacacaaataaagattccatctctgggtaaagtgggtcccagcacggaagccctgggtcttggcagtgtgcgggggcttggtggagatgaggccacgtggggcagagtcccagggagaggctcatccacagaagtattggtgagatattttgaagactctctcaatttcggtttttctggtgttttgctcactattagaatgggtctatgggtttttgggaggaatacaacagaggcgaagggcccttctcatcacaccttattggagggtatgatattaacatcacttatcactgatgaagttaacccgaactcactggtttaggcagcgtttgtcaagtgtctccaccataaagttactgtttttttcctttcattactatattcttggcatgtgagtaagtccagcccacactcaagggtggggggcaagaattaacctccacttcctaagatgaatttatctacttatattatttggaattcttccataaggatgatctgtttcttgtgcccatctatgcattgaatcattaatttacacctgtatggacttatgtatattccatactttgtgttgtaatccagtactacactacttattttgttcctcaacattatcccagcggtgaccactgggagctctttcaagttgcttcctgtgtctctggagatcctttcattttctgagcacttccttgctctccgacactacaagtcgctatatatttattatatatatttattatattttaatatatataatataataaatatttaaatatatatatattaaatatatatatttaaaatatataaatatttatataatataatatatatttaaatatataatatatttaaatatatattatattatataaatatttaaaatatatttaataaaatataataatttaatataatttattataaaatattttaattaaataatatatattttaatataac

SEQ ID NO: 468798 - DNA, 563 bp, Homo sapiens
aggccagagcagtgagagagttcagggagcagctgctgacatggaggctctggaagatgcccagtggatgggcatttgggtaatcccaacatcacagactcccaaggttaccacagaaggagatggcatcattgagtctcagggttgggaggaatctcagaggccctaccagatgcagaataacttctccattctagaaaagtggtcaatgtctgcttgtcactgcacacccaagtggaagaacccctgtgtccagagcaatagcagaggtgagaaaataaaacagtcgtttccatgttatcacagcgcaggtgctcacctctcaccacacaagatgctgaaactgttcaaagtagctgggggagcccaagcgccttctggggtgactccaggaactggacagtcaggcattcttggagccatctggctttcgcaccctttgatgaatccacaccaatctcctctccactgacagcccctcctctggctccttatttctgctcctgtaaaactttgacttgcagggctttgttttgccatggtgctttattttctgaattttt

SEQ ID NO: 468799 - DNA, 919 bp, Homo sapiens
gcgctcccagccgcagacacgggcgcctctgcactctcaacccctcacccacgcagaccctggcccgccggtgacctcccctgcggctcctccttctgccccggcccagcccctcccctgctgctcctcctcctgccccggcccagcccgtccaccgtcctctcatccccatggcctcgaaccccagcctgccgagccgctcctcacagggtgctgtggctccccgctgcaaaggggcgggtcctggtagggggcgtggcctggccgacttgcggggcggcggcgccctctgccggcagactcgggaacggccacactcgtcacctcgcccccggcccggctcctggacccccctggacctctctgccagctctcctctctcctggaaatgcgcctgcaggactcggaacgtgcagagccccacagtggaaggaaaacataagtcacctccagagattatcacatgcagtggattgctttcagccttttttctgaatataaaatatacatatacgtattttaatacaattgtggcccttctctacgtgctgttctgtgctgcctttttttctctctctccaagtgcttaacttatgttcttgctctgtgactttatatttccacccttgagcaaaccacacaacctctaccttcctcagcctcagtttcctcctttgcaaaatggtggtaatgccaggaatacccacttcacaggcagcggtgaggccccgcacacagcccagtgcatgctgactttccccatctcagcgccttcccaccggtcctgtgtttccatggcctttccccgggtaggggcctttcttttcctagcttcgctcagttccctgctacattgtcgcctcctcgcagaagccgtctctggccgttcccatatggtgatcatatgttaagaattatt

SEQ ID NO: 468800 - DNA, 2366 bp, Homo sapiens
ggcaggagcagtaacaggcctcccatgtgagaccgtgtcatccttcaatcctcagtccaggggactgtcccgcagaacagaggcatggcgagccaatcctgccacatcagctctggctgcggggtcaagaacttcagctcccgctctgccactgtgcccaagcctgggtatcacagctgtgtcagtgccatggcccatcatggggtcagccctggggggctaggctccaggcgcctcggaggctttggcagtcagagcctgtgtacggtggggtctccccggatcgcggtgagttgtagatggcccctacacagcaggggcaggtttggctactgggcagggggcctttgcaggcccagcccaccccgcatcacatctgttaccatcaacgagagcctcctcatgcccctcaacctagagatcgaccccaatgcccagtgtgtgaagcatgaggagaaggagcacatcaggtgtctcaacaagtttgctgccttcattgacaaggtgcgcttcctggagcagcagaacaaactgctggagaccaagctgcagttctaccagaaccgcgagtgctgcgagagcaacctggagcccctgttgcagggctacatggcgactctgcggcgggaggctgagtgcgtggaggccgacagtggcaggctggccttagagctcaactgcacgcaggaggcgctggagggctacaagaagaagtatgaagaagagctggccctcagggccacagctgagaatgagttcatgatgctgaagaaggatgtaggctacacctatctgcacgagacggacctggaggccaactgcgaggaggtgaaggccacagtgacccaacagggtgagaacctccgcagaaccaaggatgagctcaacgagctgaactgcatgatccagaggctgacggcagaggtggagaacgacaagcagcagcgctgcaagctggaggctgcggtggcccagtctgagcagcagggtgaggcagccctcagcaatgcccactgcaagctggctgagctggaggacgccctgcagaaggccaagcaggacatggcctgcatgctcaagcagtaccaggaggtgatgaactccaagctgggcttggacgtggagatcgccacttatcgcaaactgctggagggtgaggagatccggctgtgtgaaggcgtgggctcagtcaatatcttcctgactgtgtgccagatcctcttggaacggagccagctagagggtgtggagtatgtgggaacatctctgcgctttgccctcggatgacaggggctccagatgctgcctcagcatggaagggtggtgtgggtgtggagctgggctcctcacttgctctgagagattgtatattcccagagtcccccaactattcatatgtccagattgaaagactgacggaggctaatcagctgggtttatactgtttgttgcctggaagttcattgtatttgcatgattcctgtatggttccttctttcttttggtgtgcttgattaaatatcaatggcgaaaggctttttcttagtaaccaagttaatgcctgcctccttcattgtcttcccaacccacccaaagccctgactgtcttggtgcatctcacaatgtggtccaccgaccaccacctgcatcagaatccctgtggggtcacttgacttcttcagaattttttctttctaataaaatgttaatccttagttacccttggactgtaccctttgcattccgaggggaatagttctttgatcaggagagagctgcaggagccccagcatcctttgagccagaagagcttgctgtggtgggtttttgctgttggctgcaaggagggctggggcagaggcttacctccccataagcaaaaggcacctctggccagctgaatctgttgaatggtatttgcacacaaagcacggaaatgtattaaaaaattcattcctatctcccaggttctggctgtttgacttttcaatccatggtgccgttattttttgggtatcagatttggcatttttgttttgctcagcccagatccatggtaacatgaagctgttttccccaagcatagactctctgtagcatctcagaaccataggaggcagcagacctggtaaggactctacccactcatctcatagaccccagactgacatgcaaagcatgaaagccacttcctgcccaaggactcaccgagacctggcagtcttggcagaattggggctcaaatttccatttcctgatgtttcagcccctgggatttaacgtttcctgtgggtgaatgatgtcccctaaattgaaagttggcctattgtgattgtcaccatgccctcagggcccaaacagctggg

SEQ ID NO: 468801 - DNA, 2016 bp, Homo sapiens
cctgggtgaaactcagatttgtcaccgactagcaggcagggggccggggcctgttcctactgtattccagcacccattgcagggctgaccccagaagacactcaggaggtgtttgctgtgttgaatggaatgcagacatcccagccaccaccaggaggcacatctgtcccgcctgttttgaatgtctcctctcctggggaggaagggggaatggggacacagctgcacgatgctggggagtccctggtgggtgtcctggagggggtgccctggtctctgtgctcacatccagggctgagcctcagtcccaacaccaaggtgggccgtttcctgggcctcgagcagccatctgtgagatggggtggccagtctccttggaatctgtttgctgactacagggcggagggtcactctggctctaggcatgtggatgtgcatccccggaatcacactcacaggccccagccatgtgctgcgtgcccagctggcagctgtgatgccccagcctggagcctgctgctggcatcctgcccagacagtcccgtgggcctccaggactcaggcttgcctgcccctcctcctgggagcttccagagcctcaggactaagccctaagcagccacagctctgctttctctgtggattcccatattctggacattcatacaaatggaattgtaaaataggtggcctttcgtgactggcttctttcactttgcataatgtttccaaggttcatccatgctgtagcatgtatcagcacaggactcctttatatggcagagaatattccattgtgtaggtgtgccatattttggatagacactgtgacatgtctacacagtgttgtttccacattttagttattaggagtaatgtgataaactttcacgggcatgtttctgcatggacataggtttctatctctcttggatgtatgcctaagagtgatagtgctgactcaccttgtacctctgtggggaccacgctcaggaactgccaggctgtcttccacagtggctgccccatcttacattctctaccatcggccccacatacagtgtctactgcgctttatggggtaaactggccgtgaccagggctgtctcattccgcactgagtctccaggccctgggtagccagccccatagcaggtgcttgagagatgcagaatgagccaatgagaatgtgaaggaatgggttctgctgactatgcttgctctcagatctgactctagacttcccttcagcccctgtccatacagtcttccctgtgatcctgtctctgaccctcgccaggcagtcgtgagctgcttcttggggctcccatgctgtttggccctcattatttatgaatcttctctccgggaggctgagcgtccttccaaggttaagagggagtcttagtcaattctgcagcaccagcctctaatgcagggcttggcgcagcatgggtgctctttggggagagtggggagtcatcccaactctcaggagaggggagccataagggggaaagcaccccccaggaggggctgtttcagggggtcggtgaggcagaggaaaggggactgaggcctcacagagggtggaagcaccgccgccaaatctccaggtcttgggctctctaaatggggagaggagactggagtgtcctggtcctcctcactccatgggctgccaccatcttcactgctttcctggagctgggggtatccaggcactgagaatggttcgggatagggacagagcctagggcttgggggctgctaagtctagacacaatagaggaccccaaggattttctctaggatgtgtataggacaccatgtagtgaggaggcctgtgtgcaatgggcttgtggcttttaacatggcaagtgacttgcaaaccattggggtgtgacgtgcaggttttaagtgtgatttgtatagagccctatttcttccacaggcaatttgcaaattatttacatgtagtgtttctgtttgtataatagtcttcatttctgttcc

SEQ ID NO: 468802 - DNA, 3254 bp, Homo sapiens
ccatgccgtggtgatagatgcagagcaactgccttaagagatggcaggtgacttcttgagagtgcggagcacctggctcctctggggtgggcacaccctcagccttggcagctgcaaaaatgctgaccagctgtcctgccccccaatgaatggcaagccaaacccacgaattaagctcttgactgcccatccacaagccccagtgccaagcacatataaaggcacctgccagtcctcactacaaccagcagaaccttttgggattttgccttcctccctcctgcatctgagctttgtctccaccagcaacatgagccgccaattcacctgcaagtcgggagctgccgccaaggggggcttcagtggctgctcagctgtgctctcagggggcagctcatcctccttccgggcagggagcaaagggctcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagaatgaaatctcggagctcactcggctcatccagagaatccgctcagagatcgagaacgtgaagaagcaggcttccaacctggagacagccatcgctgatgctgagcagcggggagacaacgccctgaaggatgcccgggccaagctggacgagctggagggcgccctgcaccaggccaaggaggagctggcgcggatgctgcgcgagtaccaggagctcatgagcctgaagctggccctggacatggagatcgccacctatcgcaagctactggagagcgaggagtgcaggatgtcaggagaatttccctcccctgtcagcatctccatcatcagcagcaccagtggcggcagtgtctatggcttccggcccagcatggtcagcggtggctatgtggccaacagcagcaactgcatctctggagtgtgcagcgtgagaggcggggagggcaggagccggggcagtgccaacgattacaaagacaccctagggaagggttccagcctgagtgcaccctccaagaaaaccagtcggtagagaagactgccccgggccccgcctcattccatgacccggctctggatcccacactgtacttcccacagcccactctcagctccatctccaccctgctggtcctgctcccatacacctggcactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactgggacctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctcatggcttggtctctgagtattcaaagtatgcacatgcacctcaattcactcacatgagcgcgcaccatgtacattcatgaatgcatgaagcacaaacacacacacacaagtacatcactgtgtattgcccatgcagcctatatgtctgtgttaattttcaggaggcaaatggggtgtggagcagggtctgggaggaggggcagggagggaggaaaggagaagcccagaaagcgtgtgcatgtactggctggaggcttcagcagatggacatgcacaaactgtgtccagtgacagagaaatggtcgtgttcctgacctgaccttgcctctttctgagactgcacctttcctcgttggaaggtgggcttagtgcacaggtatttgcatttgtccagcccttttctcaccgctcagaggcctggcctcctgcgggggtcagcaggtgggagtcccacactcttggcttctcagatggaaagataagtaacaagtcttggaagttggggctggtgtagggaggagtgagctggggtcccaccatggggtgggggtgggctatgaatttcagtgactggggggttggcactgccccagacatactcctatcccaccttccagaaccactatggtgatggccagtcctgccttgttaagatgaacgtgaaatgatgaagatgaatgttggaacttacttgctcctcaatgatgtgagtgactttttggctgaatcagataatgggttttaaatacc

SEQ ID NO: 468803 - DNA, 1654 bp, Homo sapiens
cctttttctcatgattggcataaaggcaccatatggccctgcaaccacttggttaaactgctctgatgtttctctctccagctctgtcaactcaacctttcccaccatgagtcggcaactgaacatcaagtccagtggtgacaagggcaacttcagtgtgcattcggcagtggtgccaaggaaggctgtgggtagcctggcttcttactgtgcagctggcagaggggctggcgctggctttggcagtcggagcctctatagccttggagggaatcggcgtatttctttcaatgtggctggtggcggcgttcgggctggaggttacggcttcaggcctggctctgggtatggagggggccgggccagtggctttgctggcagtatgtttggcagtgtggccctggggcctgcatgtttgtctgtgtgcccacctgggggcatccaccaggtcactgtcaacaagagcctcttggcccccctcaacgtggagctggaccctgagatccagaaggtgcgcgcccaggagcgggaacagatcaaggtgctgaacgacaagttcgcctccttcattgacaaggtacgcttcctagagcagcagaaccaggttctagaaaccaagtgggagctgctgcagcagctggacctgaacaactgcaagaagaacctggagcccatccttgagggctacatcagcaacctgcggaagcagctggagacactgtctggggacagggtgaggctggactcggagctgagaagcatgagggatctggtggaggactataagaagagatatgaagtggagattaaccggcgcacgacagcagagaatgagtttgtggtgcttaagaaggatgcagatgcagcctacgcagtcaaggtggagcttcaggccaaagtggactcactggacaaagaaatcaagttcctcaagtgtctgtatgatgcagagatcgctcagatccagactcacgccagtgagacctctgtcatcctgtccatggacaacaaccgggacctggaccttgacagcatcatcgctgaggtccgcatgcattatgaggagatcgccctgaagagcaaggccgaggccgaggccctgtaccagaccaaggtgtgcccttgtctcatcaccaacttcctatctctgggaaaccagatccaggagctgcagctggcagccagtcggcatggtgacgacctgaaacacaccaggagcgagatggtggagctgaaccggctcatccagaggatccggtgtgagatcgggaatgtgaagaagcagcgtgccagcctggagacggccatcgctgacgctgagcagcggggagacaatgccctgaaggatgcccaggccaagctggatgagctggagggcgccctgcaccaggccaaggaggagctggcgcggatgctgcgcgagtaccaggagctcatgagcctgaaactggccctggacatggagattgccacctaccgcaagctgctggagggcgaggagtgcaggccctgagttttaaaactgtctgtagtacactcaactgtctgcatcgtggtttagcttttactttcaagctctgattgacacagtcaccttccctgtttccttaggtcccatgtggactaacgacttctcattttcctcgctgccttt

SEQ ID NO: 468804 - DNA, 762 bp, Homo sapiens
tacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagagtgcttactgtttctaacatgctgcatgattgacacaacttatttgttgtgtttgttatttgtctctctctgcttcttaagggcagggatatttgttttgttttgtgcct

SEQ ID NO: 468805 - DNA, 1850 bp, Homo sapiens
ctgggcccactccgacccctccctcaccttctgagcccacccttcctttggaagaccttgctgtctgccatgagtcgccagataagctacagccagcagccctgcaggtcttctggtggggcctactgccagaccttcagcagccacttagcagtggtgtcaggccacagctggatcagctccatcatgtcctcctttgcctccagctcaggaagggctggtggtggccagagtctccatggccttggggggaagaagacgatccctatcagtgtggctggaggtggcacctgggctagtgggttcagcggggctggtgggttcggggggcctggtgggggatgttttggaggcagtggttttggaggtggtggaagagggatgggtggaagctttggtggaagagctgggggctttggcggaggaattggaggcttcagaggaggagccaggggtttctgcagaggagctggtggctttggtggttctggaagctttggtggtcctggtggctttggtggcctccgtgacctcagtgatctgggtggcttcctgggtggaatccaggaagtgactgtcaaccagagccttcttcagcccctccaggagactgaccttaagtttgggcaagtaaaggcccagaagcgggagcagatcaagaccctcaacaacgtttgcctccttcatcgacagtctgaggaaggagttgtgggttcacccaatatgtcaagccctctgtggtatctcagcagtagtgggcctgcttacagcagcaacaggtatgaagatgaggtcagcaagtgcacagctgcagagaatgactttgtggtcctgaagaaggatgtcgatgctgcccacatgaccaaagtggagctggaggccaacgtggagaggatgataggcgagatgaacttcctgaaagccctctacgatgctggaagtctctcctcattgccattcctcgggactcacctgccctgcctcctagaggagagggcatttagaagtccagcaggactgagggggcatgtttgcttggccctgtgggagctgtcccagatgcagtcagacaccagcgacacgtctgtggttctttccatggacaaaaaccgctgcctggacctggacagtatcttgggggagcagcagaccacggccagcaggcatggggatgacctgaggaacaccaagaatgagatcatggagctcaacaggatgacccagaggctgtgggtggagatcgagagcatcaagaagcaggaggtggccctcaaggacaccaatgccaagcttcaggacatcaagtctggactgcggcaggccaaagaggacctggccctgctgctttgtgcgtaccaggcgctgatgaatgccaagctggccctggacgtggagatcgccacctaccggaccctcctggagggcgaggaatgcagggtgtctgggaggtgccagagttccgtgatcctagagactggccacagcagcactggcggcggctgcgccctgggaggaggagtcggagcccgggcccgcggcggtagccggggccgcagcggctggggcttgggcgggagctccgcggtgctcggggggcttctctggctccgggactcctgcgccgtcagccggggtggcggcggcggcggcagcagcgccgccagagagaacaaagctcctcctagagctggcgtccccttcgccctccggcacgccccgctctgagctcccccgcacccccgcggggccccttccctccgctgcttctgacctgtgccccggagccccaccttcccagactgctggcatcgcagcagcccgaaagttgccgcgaaggatgagtaggcggt

SEQ ID NO: 468806 - DNA, 2685 bp, Homo sapiens
ggcgtctgtcttctaatcctactgcaggatgcatgcatctctttgtccaggaagcagcattattcaaggaacagacatcgaggaggcagccattcttgctttcgttctcgttccaaatctgcagaaaaagaacaacggcacgaagaacaagaatgagataaggagagggattggaataagaaggaccaatatcaagacaatgatgggcacagatgggacaaggaccagaaacgatccagtttctcctggccgaggaaaagactttaaatctcggaaggatggagactctaagaaggatgaagaggatgaacatggtgataagaagcctaaggcccagctgttatccctggaggaacttctggccaagaaaaaggctaaggaagaagctgaggttaagcccaagttcctctccaaagcagaacaagaggctgaagctctaaagcaacggcagcaggaggtggaagagcagcagaggatgcttgtagaggagaggaagaaaaggaaacagttccaagacttgggcaggaagattggaaatgaggatgagaaagggcagcagaagatacgggaagagaaggataagagcaaagaactgcatgccattaaggagcattacctgggtggcatcaaaaagcggcaccaaacaagacatctcaatgaccgaaagtttgtttttgagggggatgcatctgaggatacatccattgactacaaccccctgtacaaagaacggcaccagaaaaagttagatgagatgacggacagggactggtggctcttccgtgagggctacagcatcaccaccaaaggtggcaagatccccaatcccatccgatcctggaaagagtcttctctgctgccacacatcttggaggtcattgataaatatccaactgtggctgtcattggtggcatctccagagaagactggggcttcaggctgctcatgggttgtgagattgtgatcgccacccctgggcatttgattgatgtgctggagaatcgctacctggtgctgagctgctgtacctacgtggttctggatgaggcagataggatgattgacgtgggcttcgagccagatgtccagaagatcctggagcacatgcctgtcagcaatcagaagccagacacgatgatcatgttcatggccaccaagcccccagcagtggagtgtctggccaggagctatcttcggcgacctgctgtggtgtaccttgaccccgcaggcaagccccatgagcgtgtggaacaggtcttcctcatgtcagagtcagaaaagaggaaaaagctgctggaaatcttgaagcaaggctttgacccagccatcactatttttgtcaaccagaagaagggctgcgacgtgttggccaaatccctggagaagatggggtacaatgcctgtacactgcacggtggaaaaggccaggagcagcgagagtttgcattgtccaacctcaagcctggggccaaggatgtcttggtgactacagatgtggctggtcatggtattgacatccaagatgtgtctatggttgtcaactatgatatggccaaaaatattgacgattacatccaccgcattggccgcatgggacaagcaggcaagagtggggtggccatcaccttcctcacaaaagaggactctgcagttttctacgagctgaagcaagccatcctggaaagcccagtgtcttcctgtccccccaaactagccaatcacccagatgcccagcataagccaggcaccatcctcaccaagaagcgccggggagagaccatctttgcctgacacagcattcttcctgttcactgagggcatttccaaagctgcctcatgcctgttcttcagaaccctcacatccctttttccaggtcctcactcttgggttatggaggcttaggaaaacaatccgactccctagcccagaccctcaggtcgggaagcctgcatgtggggctgcaaaaggagaagacgatgctgtaggaggcagggagagcaaattaccacagctttttggcccagctctgcccttctttgctttgggattgcactgggccataagctcatgccaggctatgggggcagccagttggcattgctccccagactgaacagaaacctggctgtctgatgggacctcctttggcacagacttgactgtgtaagtgtataaactgcagcagcatcgttgccctagatgccccaggagacctggcaccatgaggattatggacagtggaatcttactgtcatctggacagccgttttcctgtttggatggtaaaggaagttgagaacctttagacctgtgcacagccctgcaccaaggagtgctgtgtgctctaggcatcccttccccaggggattttctaagtagatggggggacagggtgaactgactgtgtcctttgtcactgaatgaaatctctgttttctattctctgagaagatgtttgtatgttctgagaataaatatatgaatatttttaaaaagtgacttgaaaatgagatgcaggaattaaagagagttcttacgtatgacactaatgcctcatcgcagcaggaaagtggcattatattccaaagagctcaaagcaatttggcaactgatgagcccttataagctctggaagccctcagacacaggagccaataaaaaagatggcagaatttctgccttt

SEQ ID NO: 468807 - DNA, 1541 bp, Homo sapiens
tgtggtatccatgatgtcagggttgtgtacagagctagatttcatgggtttaggagctaatcagagacagacggccaaggctagtgccaatgacctgcagcccttcttggagtcctacattggctgcctccaagcctacctggacaagctactgatggaacagagcctgctggatggggagctgggcaccatgcaggcactcgtggaggagtacaagaggaggtatgaggatgaatttaacaagtactcagaggctgataatgacttcatggttctgaagaaggatcggatcaaggccaccgttgccagaaggcagatggatagggagaatatccagctcatccacttgtggagttgggtgcatgactaccagctggtcctggggaatgtctgccacagctgctgcaagaccacagccagaagacatgatgatgacttgaggagcaccaaaaatgagattgcggagctcagcaggatgatccacaggctgcaggcagagattgagaacatcaacaagcagggggcgatgctgaccctcaaggatgcccaggccaagttggcagagctcagagatgccctgcagcaggccagggaggaccaggctcatcttccgtgtgactaccaagagctgctgaacatcaagctgggctggatgtggagaccgccacctaccagaagatgttggagggcgaggaagaggaggccctggaaagggtggctcctttctgtcgggacgtcatctccacaagtctctgaagctctcagcagagagcgctgctcctctctgcagctcgtcgtcctggcatttctagctatcagcagagagggtagctcctctctgcagctggtcctccctcatctctccatcctctgtgtcctttcccctgctctggctgttccctgggcttttatggacctcagaggggaggaagtgtgtgctgattggtccatgggctgccccaaggagaacaggaggactgggtctgcagctgcaatttggatggctgcagcatcacctggggaggtcccgccccaactcagaagaggtggggctcccactggctccatggagtgtgcagccctagctgtgcctccctgctgcagccgctgccatcactatgaggtggacgccgtccaggaagcggtgctctgtccttggtgctgaaatctggcccagctctgacgatttgcatttgggcatacaaattttctgtctaagatcaggtaaatatttggtccagagcccgactttaaaatagtctcagactttgtctattttgttatattccccataaaaccaagaccaaaataatttgcctctaagtctttatgaataataaaacgtatgaatattggcatgttttcctttctgcctcctgctgctggaaagtatttgtcattggtgattagagtattatattttcttcctattttaacatggattgttattttaagttaactccctcattattgtgatgacagggatataaaaataaaaaagtctaagaagctagtcttctcttgattgaggctaggttcat

SEQ ID NO: 468808 - DNA, 786 bp, Homo sapiens
atctgagaggagttttcttgagtttggagaagtgctggattcaggggccatggtttgtgctctgctgacactcccaggggccgagtgtggagaaggtaattctgttgtggacactccaggggccgagtgtggagaaggtaattctgttgtggacactccaggggccgagtgtggagaaggtaattctgttgtggacactccaggggccgagtgtggagaagataattctgttgtggacactccagggaccgagtgtggagaaggtaattctgttgtggacactccagggaccgagtgtggagaaggtaattctgttgtggacactccaggggccgagtgtggagaaggtaattctgttgtggacactccaggggccgagtgtggagaaggtaattctgttgtggacactccagggaccgagtgtggagaaggtaattctgttgtggacactccaggggccgagtgtggagaaggtaattctgttgtggacactccaggggccgagtgtggagaaggtaattctgttgtggacactccaggggccgagtgtggagaaggtgcaggactttggacatctgcttgcaaatggccacactcacctgatccgctcctgtccactgccaactcaacagccacttcacatgggcccaaatttgatgggcagacgtagagcctgtgcagttacatgtgagagacatagctgacctgagccttcaaacaagctgcctttgctcagcatttattctttcaagaagtattggctggggacctatggcacgtgaagca

SEQ ID NO: 468809 - DNA, 628 bp, Homo sapiens
ctcttttccttctagatagcaatgtggctccaactactggctgatgtgagacggtaccggcagttcctggctgtgtattcttgccaacatttagagaagccaccagcagaggtccaccctaagcacgtaaaaacagcaagtcagcaccttgccttgtggctacagaaaccgaaagcatctaacctcatgttacagtctcataagggaactgcattcttggtccaatcaaagggtccacatgccccaacagcagttaggatgctggtagaccactgcgaacacaagttccactcccccagagatggattcactcaccaaggcatgatcagaagtggccttcctccccagcagcatttacaagctggagtacagtgcttggagggtgccctgggggccacgacggctgtctcctccctacaccatggtgaagacattcagaccaaacagaatataggagtttatcaccagcagacagaaggaacttctagaaaacaacttcagaaacaatgagaagatttgctatcagtattttattaatatcataaaatatgttaagagcgcttaccatctttttctctgatctggagtagtttaaatagcatttgaatgatctattatctaaaggtaa

SEQ ID NO: 468810 - DNA, 735 bp, Homo sapiens
ggtgttagtgtgacctcagatagatcagctacactagatagccatgagacagcagtgccttcagggttcgtggcccaccgctccttcgcagtccctgccgccaccgtccacgctctgcgttgtagagaagacagtgggtcggaagagcgccatcgccgccagtgtatgtggggccctttttatcaggtactgcatctacttttaccacaaaagacgaagtgaccccaatttcaagaacaggcttcgagaacgaagaaagaaacagaagcttcccaaggagagagctgggttttccaagttacctgaccttaaagatgctgacgctgttcagaaattcttccttgaagaaacacagcttggtgaagagttactagctcaaggtaaatatgagaagggtgtagaccatctgacaaatgcaattgctgtgtgtggacagccacagcagttactgcaggtcttacagcaaactcttccaccaccagtgttccagatgcctctgactaagctcccaacaattagagaattgaaagagcaacaccttagtaacactgacatctcaagctgctcctcactcacagccaagggaggaacatcagggaagggtcccatttgattggctctgctcaggtcattagtaaccacagaattctgtccctgaagagatcatcacttaagttctacctcaagtctctggttcacagtgaatctaagattctcaggaacttaatcagagct

SEQ ID NO: 468811 - DNA, 763 bp, Homo sapiens
gaaatgcaggggccggaaaagaatatgtctagaagaatccttaatattccagaacgtattattctaatccactccgaatgtctcattctgcctgtttttctcttgccctttcaagcccttacagtctgtttcttgcccagaaatgctttctctgccttctgctctgaccaaccacccacaacaatctactacagccagattaattttctggttttcctagcagctaggaatggctggaaacctaccactttcttctccttcaacccttccccacagaaaataagtcttatgagagaatcaggccttatgagaaaatcaggccctagcactaacactgcctggagagtggggcttggggtccagctgctggggtctaatgccttcctgagatcatcaggatggcatcagagtagagcctcaaagtctggaattgggagtgatggatcttgctcttgctctgttgcccaggctggagtgcaggttattgggagttacttgtcttctaattattgaattacaagttctttatatattctggacacaagtctcatataagatatatgatttgcaaataatttctttcattctgtgggttgtcttttcactttcttgatggtatcattttcagcaaaggagtttttaattttgatgaagtccaatttatctatttttccctttgtcgcttgtgtttttggtgttttatataagaaaccattgcctacccaaggttacaaatatttatttttatgtaaacttctaagaa

SEQ ID NO: 468812 - DNA, 1692 bp, Homo sapiens
cccagccttctttcagctcctcaaactcctgcttcagagcctttgcctgtgcctggaagaatatgtccttttgcccctccgtccgctcctcacggcggccaccgctggccagtgtcttccctcccatcagctctcagcccccccgaatcagagctgtcctcatgattcggcccctggtagcatccctggcccccgtgcccttcagaggcacagcctgggtactggccaagagccggcaggtgatcagaggccagtgtggatactggcttctgagggccatgaaggtgaggaagacagaggagggtgtcaggggtggtcccaggctgagcacggcagcggggctgggccccaacctgcaaccatccatcaatctgactgtgctgcccacttccgctgctgcccagacactccactttgggatcctggctgccatctgtaggattggcagcttctgccaggctcacatggctctgggcccagagaggccccccaggggttggaggaatctagtcagtgtggagcagattgagaaaatcacctccctggatttggagtttggcaggcaaaagccaagtttcctgtcggtcaaagtagacactctggaatggagtggggctcaaaccatgcagcaaggaccagtccgaggagtctgctgcttgccaggatcagggaatcccaacagaaagcctctgtgtggggctgaagggaagactgaagacatcaggacacaggacaccccaaagagagaaggctggcgtttgcacattgccaccctgagaggactcccctatcctggattcagcagttctggacacgaaccaagactcagagaggtgaagagactggaagaacaaggtagccctggggacgagaaagaggaggagaaagaaatgacccaggacaggctgttctggggaccacccccatcccgactacagggggaggcttttgtacccaagaaattgtatcccaaggactcgcaggaggccgtgggcagagagcagggcctgaatgcccggctgggtgtgagggcctgggttacaggcccagctgccctgggccggggctggggaccccgagatgagtcagacctggccttcgtccaggatgaagtcacagtctggtggggagacaggggagcaggcagggaagtgacccttcggggcactgtgggtggaaccctgctgggttctcaggccccagggaactctaagaaggccagggcccctgcccctccctgggctctgggcttccagtctcacccgttccaagccatccttgccagcagccaggagagccctgctgcaatgccaactaattgcatgtctctagcagcacccctgtgcctaagcctggctctatctggcctcttctacaatccagtgctcttctccagcccttctaccctgtgctgcctcctagtgaagggttagatgtgtcattctgcagcccttctggtggcttcattcagcctttggggcttcgtgtatgttttcctactgtgaggcaggaacccccactcccttgtccatctgatgaatcctactcatctttcaagattcagctcagtgccacctcctctgagaagccttccttggttagcccatttccccacagagttaggtccccttccctggataccccagcctcctatatgctcagatcactgtgtttcagagggtgtcaccttcc

SEQ ID NO: 468813 - DNA, 651 bp, Homo sapiens
gccgccctccactggctattctagccaccatccatcagcagagataagaggaccactgggcgaggaagttatatgaggaccccagcccggctccaagtcagacaggcgagggtttgcctgttggctccctcttccactaactggttgcctttagcagttgtctgttacctgagcctctgttttctcatccgtaacctaaggatgattacaccttctcccaagattgttagggggaccaaaagtggcagtgtctgttccattcccagccggaggcataacagtgggaacaaaaggagtatcgtggtagtgggatttgctgtgtcgctgtctcactatggtcactgtaacaaattcccacaaactcaaggacttaacacaaatgtattaccctacaattccataggacagaagtccaaaatgtactttattgggctagcatcagagtgtcagaactgcgctcctttacagaggctctggggagatcctgttctcttgcctttcccagcttctagaggctgcccgcactccttggctagtggcccccttccctcctcaaagtcagcgatggctgattgagtctttcctgcctcccatcactcagacacagactcttctgctgcctcctctttcactttcaaggacgctgtgctt

SEQ ID NO: 468814 - DNA, 952 bp, Homo sapiens
cagccagacagcagggctggggccagatcccaggcccctgtctcccagcccagggctctagatgaaggggcctgacttgccctctcaacctatcttaatagtggcaccaacatccaccaagttgcctaggccacaaacgggtctcactgcactcctccctcccagcaccctcctcctggcagcagcactcatagctgtctcctgcagtccatcacaggccactccctggctcaggccaccttgtcttctccaggaccccagtccaggaaatacctggccactgctcaggcctccctacctacatccaggcttctccctccagtccatcttctgttcagctgcctgggtgacttggctaaaacacagagcccacagtgtcagtccccagggcaacccttccagggctccttggctgggcatcccagactctccgtggtgcttgcgcctccttccagcagctgcccctgacacgcccctttgctccctcggtgcagaagctgcctgccctcttcagagtgtgcatcctctctgcatttgctgttcctgcgccgtttcctctttgggaactcctccctctgcaggcacgttcctgtttttgctcactcctgaggaaagctcacacggcccgatctcccttcccccaccccagccttggagggaacgtctaggtcttcctccccacctccttgacagcagcaaagacattttattgtggaaaatttcaaacacacaacaaaaatagtacaaaaactactgtgtattcctcacccagcttcgaccctccccgactcagggccactcttgtttcatttctatcccccaactcctccccactggattactcagagcaaatttaaacatcagataattttatccacaaatactacaaggagttgggcgcagtggctcatgcttataaatcccagcaacttggaaggctgagacaatgtac

SEQ ID NO: 468815 - DNA, 1164 bp, Homo sapiens
cgcgcccgcgttccaaacatcacatcatcatcatcgtcatcatgactgcgcagcctgggtcttggggttcctggatgtctagctttgtgggaggctaccgaatcctgggcggaacccaccgactctggttcaccgaatgggcctcccagcacgtggggcgcctggcacggtttcccgtgcttcgcctctgcgtccacggcctggagatcagaggaagatcagaaagtgacaccacagctcagaacaggaagctaggtgctccctcagtgcccatgagtgacagagatggtggtgtgggtccgagggcaccgcactactctgaccctctgctccccacggaaagacacagacctgtgtctactcgccctgtggtcttcctcagaccctgcgagtggtggacgtcgaagacctttggacaacagagcaaggccccagagtatgctgagggtgccagagagaactcagacctgtggcctgactgtagcaggaaggcctggtcatcgctgcctgcgtcctggcctctggacttgcctctctgcacggccagcagcgagggcctgccagcccggcggccgcagcagttacttgagccagatgatgggcctgcttggcagttcctggccatccgaccccgcggtcctgttcccaggcagaccctgctccccccatgccagtttcccccaccagtatcttgagctgctccctgaggacctgctccaggcctcagccgggccagggcctcacgctctttcaactcttgtttttcatttctgcctctcttgattgtcctctgtgtgactgtccctctgctgggcctccctgtatctcaccccactcctctttctcgctcttctctaggaaaacatagatgtaaatccttgtgaccttgaagtagacaatagttttttctatatggtgccaaaagcacaagcaaccaaatgaaaaaatagagaaaccgaacttcatcaaaattaaaaacgttgtgtttcaaaggatattatcaagaaagtgaaagaacaacccacagaatgggaggaaatacttgcacatgaagtgtctggtatgggtctagtattctagtaaccggaatacataaagaactctttgcaactcagcaagaaaaggacaaataatttaattttttaagtgggcaaaatatttgaa

SEQ ID NO: 468816 - DNA, 2011 bp, Homo sapiens
gcagtcagcctggagaccttcttcctccctgtgttttttattttcctcctcttctaccttctcatcctgatgggtaatgccctgatcctggtggccgtggtggcagagcccagcctccacaagcccatgtacttctttctgatcaatctctccaccttggacatccttttcaccacaaccactgtccccaagatgctgtccttattcttgcttggggaccgcttcctcagcttttcttcctgcttactgcagatgtacctcttccaaagttttacatgttcagaagccttcatcctggtggtcatggcctatgaccgctatgtggctatctgccacccactgcactaccctgtcctcatgaacccacagaccaatgctaccttggcagccagtgcctggctaactgccctcctcctgcccatcccagcagtagtaaggacctcccagatggcatataacagcattgcctacatctaccactgcttctgtgatcatctggctgtggtccaggcctcctgctctgacaccaccccccagaccctcatgggcttctgcatcgccatggtggtgtccttcctcccccttctcctggtgcttctctcctatgtccacatcctggcctcagtgcttcgcatcagttccctagaaggacgggcaaaagccttctccacctgcagctcccaccttctggtcgtgggcacctactactcatctattgccatagcctacgtggcctacagggctgacctgccccttgacttccatatcatgggcaatgtggtatatgccattctcacaccaattctcaaccccctcatttacacgctgagaaacagggatgtaaaggcagccatcaccaaaatcatgtctcaagacccaggctgtgacaggagcatttgacctttaaatgcagctaactctgcttccaggacaccaaataacagtgcttagcacagagaaaggactcaatacatgataatgaaataatgttaatttttattggaatcttaagttgttgtataaaattttactacttagtaattcaagaaacctttactaaaataaaaaaaaaatcttcatggcaaaaaattcttaaaagcaaagtcaaaaaacaaataaaaaacgtatcacagggaaaggcaaatattcatattatacaaagaatgtagaagattgaaataaacatttcaataaaaacatgggcaaaatatatgtgtagacaaataaaaaaaaatgcagtggcctttaaataatgagtatttactatataaaaagaatacgaatttaaattgtgctgaaatgttatttttcacttaatcagattagcagattagcaaaaatccaatattttgacaatatgcatgtagaaaaacagaacttttataacttgcttgtgaggatgcaaactggtataacactaccgcaatacctaccaaaattacatatgcatttaccctttgactcagcagtatcacttctagggatctatcccgaggagtcaccatcaatcattcattaggttacgtattcatcactatacagggaactgattgaataaaccataaaaatgcatgatgcagtaataaaaaggaaataaggaagctctctactgatatgatatcatctctaggatatgtgttaagtgaaaaaaagcaagctgcagaaaagtgtttttgtaagaaaggagatagtttgcttaaaatttcaggaaaaaactagagggaaaatgtgaactcataaagatggttatctataaggagaggcaaggaacaggaaggagaggaccagaatggaagcaagtctagacatatgtaattatttttacatagttcaaagaaatcagaaagaaaaaccccacaattccctcaatttaaaataaacagaagcacttgaccctggctgtctctcaagttagtggcatgaccacaaagaaaattactctagagtagttttaaaaacatgaatattatagttttacttctttaatatatattagataaattatatgttc

SEQ ID NO: 468817 - DNA, 1545 bp, Homo sapiens
gaacggaccgaccgggactgccagccgctccgggcgctcccaactcactggtgagcgcggcggcccgggcgctggatgcgggggcggccgcgatggccccgcgcgcgggacagccggggctccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgccctgggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccccgacgagctgcgcgcgctggagcgcgatggcggcctccccgggccgcgcctgctgctcgccgacaaccccctgcgctgcggctgtgccgcacgccccctgctggcctggctgcgcaacgccacggagcgcgtgcccgactcgcggcgcctgcgctgcgccgccccgcgggcgctgctagaccggccgctactggacctggacggggcgcggcttcgctgcgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccgcgcccgccgcgcccgcgggctcccgcgccacctccccgggctcggggctctgagcggcgcccccgggctcggggcttcccttgcctggcccgaagccgtggagatgagacacccgcgagccccgagctctgagaccttcccctgactcggaggcgctaagccgtaccctctcgttcccgcctccgagagctcccaccgtcaaagacccagagatagccggtccgaatccagaaaccccgcctgcccaccctagtttccgaaacctccctcctgaaccactgaaagacgtctagtataatgtcaaataggagtggtgagagtagtcatccttgccttgttcccaattttagaggaaac

SEQ ID NO: 468818 - DNA, 790 bp, Homo sapiens
tgttctgcttctcagagatggcgccacggttcgcttggcctgtggaaacgtgtgtgtcatgggacctgcttcttgggggctctgggctttgaaagggaggctgtaatatggccttgcggcccctgccagtggcatcccggccggacccatctttgactgaggctgagccccaggcccgctggcagctcccagccgtcctccccacagcctggctgtggctgttcctcggcctgccagccccacaatcacagcccacaggacgcacccccactccctccctgatttcctggaattcagaaaatggatcacccctgcctcgtcctagttttccaccccagagacctgccatacccttggtcaagtcctcatgcaaaccagattcctttcattcaaggactttcagagggagcgttacccggtcctcagccacacccatgccgccctgtctgccctgtctggactgcctagactccatcagaactccacagccactttctctggaaagccttcctggctgctcttgccaggtgttctctcttcactggcctctcaaagccaggtcttgacttgtcctagggcctcatcccataccatgttttattgtcataatattctttcccatagtgaccccagtgctcagcactgagcctggcacaaagtgcatgctaaggacaagcttgctgcacggagaaatgaatggggacttcagatatacatacacacacacacatatatatatatacacgtatatatatatatatatatatatatacgtgtatatatatatata

SEQ ID NO: 468819 - DNA, 3890 bp, Homo sapiens
gtggaggttgggagtaggtaggacctgtgccctaggaaacggcagtgcctggcctgcaggggccttctggcacgttctcactcctcgccgttgctcttcttctatcttcaaagcagaagagattttgaactttataatatgccttgaagtcaaataccatcagtcctcttgtcatgggatcctttgggagtgcttcgccagctggaaacctctgcggccggaggcgccttctgcctaagtattacttgcgccgctggactcattccgcccacttggccgtctcagctcgagctaccgcctggatcccacacctgccaagggcgagccaggcgtggaacagcaaggggagtgtgggcaagtgagtgtggggtctggtcactgtgcacatctgactgtggctggaccagatgtatggcatgcagcttctacagtgggcagctgcatctggacagggggagcatggtggcacctggaagcttggaactgcagagccccaaagagggtgtcacagccctggcttgggaagcccctatgtctgggttccctgaaggctgcagctcttctctccttcttgtcacccgcaacgtgtcccgccatctggtgggtcccaagttcttgtcctgcgtccggaagaatgaggcatgtggacaactggagggcagatcttcccgacaagtgtccagctctcagcagagaagagaccaacagtgggtagctcgtttccacaggcaggtcatcctgacgaatggaggagacctgaagtgggtctgcagcagtttgctgggggtccactccggaccctgtttgcattggtatccccagtggaggctgcagaacagcaaagattgctgcctgctccctcctccagaagcttcatgcaagagagtcccactgagaacatccgtgtccctcagttgacagaaatcactcgccttttgcgtttgtcttggtgggagaaacagaccagagctgtttctacttgaccatcttggcccctcccccccattttaaattttgatgcccaaattgttccagattttccagtgagagacccttggtgacagctccgtagctcacttaaataaaatgacacagatacattttaggttccatactgagcatactccgtcttccttccttccttaccaccatatggaagatgacatggatgcatgtttttgtttttgtttttttacacatatgtgtacctataataaatctgtattctttgtgtatttaacattatttttttcccgaatggttatcatgctttgtgaaactcttacaatgtgcctctttcacttatcaataggaatgtgagatttatccatgctgatacatctaaatctggttaggccattttaactgctctccagtagtctgttgtatgataaaccacttaaatacacccccccaacacacacacacccacatacacacatatacatctgctgaggaacagttaggttgttcctactttttagctattacaaataatgcagcgcgtttttccttatatatgtctccattgcctatgtgaaaacaattctctagggttgataatccagaagtagagtttctgagtcatagggtatatgctgctttgaatatacgaggaacaaattctctccaaaatggttgtaccagtttatactcccacctgcagtatgtgggagtttctgtttctcaatctcctcaccaatatctgttataaccagactttaaaacttttgccgttcggaagggtgtgaaatgttgtatcatggtgtttaaatttgaatactagtaaggctgaacatctttttatgtgcttattgcctattggagtttctgttttgctgctcatgttttgttctgttttgccttgacccacttttctatcaggttgtttgactttgaaaaattattttataaaagtttctaatacagcctgcatattaatcacccatggtttatgtgcattgcaaatatcatctcccaggctgtggcttatctttcaatcatgtttatagtatcttttgacatacagagccttcaaattttaatgtagtcaaacttatcaatctattgctttgtgagctgcactttctgcatgtttaagaaaacttccctgctctgatgtcatgaagatattaccttacattatattttttaagttttttgtctttatatttttagtctatcttttgtgtgtaatgtgaagtagtatagcagactatccttcttccttacttagagcaccccaggttattcctgttcaggtcagcagtgtacttctctttctggacttccttgtagccagaaaaggtcatgtgacatggttctgcccattgaggcatgagagaaggggatttctgtgaaatgttatgatttctttctttcttgatatgagtgtatttccatctaccttccttcttccttcttccttctacttcttcttttctgaaaaaatggacataggctagagatgaatcacccttttgtcaccatgaggtcacaagctttgacacaggaataatacagggtggtcacaggagaatagaaaattccaggcagcagttttacatgactagcaaaagaaaacttgaaatagctacagaagctagggattgacaagactctgaaaaccaaagttttggaccaagctggctaagaccaaccggacacaacatggtgctggatttgacctaggtttcacttaggacctcattatgcattcattaacatacacatcacactcgcaccagccccatgacagtttcaggaacacccatatttggtgtaaaaatgggtggcactacaattctgagaaatcttcacctttttccaggaattttcatgaatattccaccccctggttaaagaaacccataaaggtggaaaccccaaactccactgtgtgactcgcttgagtacacccacactcccctttcttgagtatgtactatttgctttgcaataaatctctgtactttcactattttcttgcttgtccttgaattcattctctcgacggtgtcaagaacattttataacctaggaatttaattcattcattcttaatctttcatttttatttatatatgcatttcctcaaaatgagttccattcagcgaattccaatattccaagaaaaatgtttttgaaatttaagatgactatataatgtatatataatgtaataatgtaatgtgtgtataatgtatatagaatttatatgtattcatggaacatatatgtattatatgtatatatatatatataatgtatatgtaatgtatatcaatgtagcctggacacttacactaaacctccactccagtaacacccatagattgcctctcctaagacacatgtgacacctaaaacataaggacactttatgttggatgactacagtcttaacaccctggtcccatccgtcacggcctccttaatattatgtaagttgctgattctattcaaccaacaagtggtaaatactttgctcttatatatttggctaaccttgtctgtttagtgcctattccaacagcctctcagcttctgtttgcctccactgctgaggggacacaatacacctttccagggtacccatgggggaccttcacagctttgtcaccacacacaatctttgcagacaagatcttaatgacaactgccttccccaggggcacagatatgacattgcattgaggacgtcctactccaaagaaatgcatttgatacacacattgaagacatttaaccccaatatttcttaatacttttgggctctggtggcaacatatttctcattgacaaattttattgctaaattaaaatcaacaggcactcctgtgtgtgatctcaaaaggctccttcactgtaaacctttggcaagctcccgt

SEQ ID NO: 468820 - DNA, 689 bp, Homo sapiens
cttgggcaaaagatatatccaaaatgcgaaagagtctaatagggctcctcctcaggcccctgcccctgcccatcccctccctgttggttttcatccgtgctgaatcaggcagcctcctctgttcagaaagcacttggtacacatttccatgcagacagctctgggactgggggctcctcgatgatgagggcaggttctcatctgattgtcccatccctggatacccaatgtttgcccagatccaaaggcatcagaagaggcaaagggccttcggtgccacaggctccaaaggaagaggctgtgcttgtcactgggagaagtgggcagggttctcagaggcatcagcttacagggagctgcaggagggcagagcgtccctgccaacgcctcacacaggacctgcatatatggacgcagtggaaggatttgttggaagtagatctccaggggtgtggagcctcatacaattcagtggccctgtttaagaaaaactgcaaaatactaatataaatgtagacgtgaaagtgaatgtctatctgccataagaatgggaggagctgcgtttaacagccctggggcccgaagctgaagctgctgcctccggctccagagaccagtcccaacttcctgggcccaacttgcctactcccaacccctgggcctgaagaagacagggcaccctcaagtcc

SEQ ID NO: 468821 - DNA, 1906 bp, Homo sapiens
cactttgggttggtggcagtagaacagcaggctgggagtcagcacaccccaagtgaggtcctggcctctacacagccatgctccgctactgccagagtgcccgcgcctaccatctggctgaggcctgcatggctgggagcagcttggaggggagagggcgtgagcagcagtgtgattctggcgggacagcttggcctctggcagccctgccttctggaagtggcagacagtggagtgggggctgtgccggccagcggagaagctccaaggaaggcaggaagggaagtgagattgcccagggccagcagcagcagtgtggtgctggggctgctggcgccactcccctctggcccctcacccacggcagattctctaggaggaagtggggagagattggggagcaggaagctgggggcggttgtggagggaagtcccttggcatcctggccccaggctcctctttcttaaccctcacccctgtgcagagccccgagcctggctttctgccaagggagccagcaggccactgtttcacacactcagaaaacaacagctttcctggttcccaaccccaagtaggaggtgcctgcttggagctcaggcacttggaaagcagcgcctgctacagggtctgccaggtctggaggaggcagcaaaagagaagaaagacccccagcccccacagcctctcctcaggggccttggaggaggtgctgcattgctcagaattcctgcacccagaaggtcgtggggagcatccccctgccttggatagtggctccaaccacaagactcgttcgtagttctctgaatgcatgccaacccacctcacccaccaagccattgtacatgcttttccctccacccaaagccctctctcaaccagggcagcctgatgaactcccacaaatccatccttcctttaaggctcagggagtgcaagcactgcctcctctgggaagcctgttgaaactggccttgggaggcctccctcccttgtgctgtctccatgcctgcccatgcagaactctgtttgtcacttggcacggagtgtttcccagagtccctctctaaaggcctggggtctggaatccacccccactactcaaggaccaagtccaaacctcaatccccagttattttctaacacatgaactttgggggacaccatagcaatgcacaagctatggatggcatcatctcttcagaggtacagagtggagcacagaccccagggaagtgtgaacagctcagggcaggatagaatcatcactctttttggtcttgttattagatttccattgatacagcctgaaatcacctgagatctttgggggtgttaacacactttgactcagcttaagcacagagtcaactaaaccccatagtaatttttctggcaccagcaatggaaagtttctatgaaaaagatattaggaacatctccatgtccccccactaaataattcttctctccacctactctgacatttatctttccatacaatgatgcaattattcatctacttgtttgcccacccatatgcaactacccaaccatatataatgcagatttgttacacagacaaatatgtgccatggtggtttgttgcaacctatcaacccatcacctaggtattatacaccatatgcattagctatttatcttgatgttctctgttcccccaccccctgacaggtcccagtgtgtgttgctcccctccctgtgtccctgtgttctcattgtgcagctcccacttataagtgagaacatgcattaaccactatatattaacccatacattttacagcccagctaaccacccacattccttttcattcatctgtccatagagcactcattcacctgtgcaactacctactggtgacaaacccacttacattt

SEQ ID NO: 468822 - DNA, 811 bp, Homo sapiens
gtgctgtggtgactttaatgaatactaaaggacatcattggctaacgaatgccagactcaccaagtaccagactttgctctgtgaaaatcccccctgattgtgtagaagtgttggactcaattcactctagcagacctgacctccgggaccagccttggccatcaggagactgggaactatatgtggatgggagcagcttcttcaacccccaaggagagagaggtgcagggtatgcagtgataaccctggacactgttgttgaagccacatcgttgccccaggccacttcaggccagaaagctgaactcattgctttcattggggccttagaactcagtgagggtgagactgtcaacatttacactgattctcggtggcagttatgcattgcaggggacaccagcgagcttccatcttgctgggtttggggaattcccgcgctgactcagaggctccaaaagcagcatctgcccccttctgggcatcagtgctccctcaagcacctgatcttggacctacttcttctaaagaagaaaaggactttctgcaggtagagggaaggacaattgatggaggaaggatggattcggttagcagatgggagagtaactgtgccacagctgctaggaactgcagttgtactggctgtgcaagaaaccacccatcgaggtcaggagtcactggaaaagttgttaggctggtatttctacatctcacctttgtcagcccttgccaaaacggtgaggcagcggtgtgttacctgccgccagcatgatgcgaggcaaggtccagccgttccgcccggcatac

SEQ ID NO: 468823 - DNA, 877 bp, Homo sapiens
agcagcagaatctttaaataaaaagaaagaattcgactgaagggcatacagcggaaaaagagactgagcagtaagtttcagagcaggagtggaagtttatttaaaaaggctttagaacaggaaggagaggaaaattctcttggaagagacccgagcagatgcctgaaggtccaagaaagaaaagagaagagcctttaaccttgatcctgcgacggaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcaggaaggaagagaatttcttcaagaccagaatccagaagacatgagaaaactcacacaggagagagaccatataagtgtcatcaatgtgggaaagcctttattcaatcctttaaccttcgaagacatgagagaactcaccttggagaaaagtggtatgaatgtgataacagtgggaaagcctttagtcaaagctctggctttagaggaaacaaaataattcacactggagagaaaccacatgcttgtcttctatgtgggaaggccttcagtctgtcttccgaccttagatgacatgagagaacacacactggagaaaagccatatgaatgccatttatgtgggaaagccttcagtcaatgtactaatcttaaataacatcagaaaattcacgctggagagaaaattataaacatcttcagaacatattctgactttagatgacacggtgttaggaatgacgaaggtaaggaatgt

SEQ ID NO: 468824 - DNA, 565 bp, Homo sapiens
gagagtgagctccagggctgccagaacgctgtcacctctcaatagcacatgagggttcttgcctttgcccaggaaagaattcaagggcaagctggaggtatagaagaagacagctttattgaagaggcagcgttacagccctgtgacttctcctacgtggaggtgagggtgcgcattcttcagtgcctggtaaagggcttccgcttgccccaatttggtggctcccaccagatacccgatggtcctgtcgagttgctgaatcatcaacttcctgttctctgcctctggcctgaatcgatgtctcacgttatctggctctctgtagcacagagtcacaatgtcaaagtcttccttggtgaaccagttcatgacggtatcgatgttctccctccgctctgtctcgttgctgtttggcttcagtccatgcctggttcaagatgtattggctcaactcgaggatccagaggtgggatgtggctctggcctggccagaggactgaggatgctgcatgccatggctacagcaaccggttcagctttgggctcatgtcctagtcagagccaa

SEQ ID NO: 468825 - DNA, 1207 bp, Homo sapiens
cacccccagtgatattgcgaataatgtcatcctcttcttccctggatattaggaacaatatcacaaggggtgatatctccctaggatattacaaatactatcacaggttgtacacccactgtgataacacagtgatacatcccaaggatactaccaagaatatcacagggctgtacaaccactatgacatcaggaaggatccagaactgcagcccgtcctcactttgctgtccctgtccttgtccatgtatctggtcacggtgctgaggaacctgctcagcatcctggctgtcagatctgactccccccaccacacccccatgtacttcttcctctccaacctgtgctgggctgacatgggtttcacctcagccacggttcccaagatgattgtggacatgcagtcgcatagcagagtcatctctcacgcaggctgcctgacacagatgtatttcttggtcctttttgcatgtatagaaggcatgctcctgactgtgatggcctatgacggctttgtagccatctgtcgccctctgcactacccagtcatcgtgaatcctcacctctgtgtcttcttcgttttggtgtcctttttccttagcctgttggattcccagctgcacagttggattgtgttacaattcaccatcatcaagaatgtggaattctctcattttgtctgtgacccctctcaacttctcaaacttgcctgttctgacagcgtcatcaatagcatattcatatatttcgatagtacatttggttttcttcccatttcagggatcttgttgtcttactataaagtcgtcccctccattctaaggatgtcatcgtcagatgggaagtataaagctttctccacctgtggctctcacctagcagttgtttgctgatttgatggaacaggcattggcatgtacctggcttcagctgtgtcaccaccccccaggaatggtgtggtggcgtcagtgatgtacgctgtgatcacccccatgctgaaccttttcatctgcagcctgagaaacagggacatacaacgtgccctgcggaggctgcgcagcagaacagtggaatctcatgatctgttccatcctttttcttgtgtggaaataacttcccacctatatgttcaaatgatttttcacatgagtgctaagaaagctcattggtggaaaagcagccttttcaagaaatggtgttggagaaa

SEQ ID NO: 468826 - DNA, 671 bp, Homo sapiens
gccatcaactgggaatagtctttgatcctatgctaattattagagaagcccaaaaattatcttgggaaaaaaggtaccacccctttacaaattggagggcttagatctatggttaggacaataccagttctttccttcttcagacttggtggggaaagtgacagtgctgataaacactttatgttccattcactgaatgtagaggacatcttttcactaatcccacctatcttttcaatttttccaggaagattccagaaagccagtgtacacgcagacttcggaggcagtaaacaggaaaccatcgatcccgtgcaggaaatgaccttgtttgaaggcaacgaaggtgtccccaggaatctggaagagtggagatgcggtcttggctgtggttcagttgtctcatttgtaaatgggaataacatttccccacctcgtaggtttagtgtcaatcctaaaagacctagtgtaaatgaaaacattgtaatctgaaaggtgtaaacagacattaggcatttcatgtctaaatactttagtattcataaatattcataaaatggtaattccattagcacctaaagtatacaataattgtttgatatcgccctcagtattggaattttaccagttgtctcataatattttttccagttgctttgttttaatcagga

SEQ ID NO: 468827 - DNA, 703 bp, Homo sapiens
aacatttaaagtgaacatttaagagatgttaattgctgctactgacgattcttccacttttctcctgtgggcatttattgctgtaaatttccccttaaacactgctttagctgtgtcccagagattctgttttccttctaacagtcaggcccctctgctgcaggtctgctggagtttactagaggtctactccaaaccctgtttgcctggttatcaccagtggaggctgcagaacagcaaagatttctgtctgtttctttgtctggaagctgctgcctctctttcagagatgccctgcccagagaggaggaatctagagaggcaatctggctacagaagctttgctgagctatggtgggctccacccagttcaaactccctggcagctttgtttacactgactgagaatcacctgacatacagcaaccaggtgtaccctaccttaacctttgctgttctggacagaaaggaacactagatattccaaactggcttcaactttgcagatttgaaagtgtgggagaaatcagataaggcaagacacacagaactattgattttattggattaactcagtcttttggggaaatagtctgataattcaaaattcaaatttcctatcaaggatgcttctatcctttcaaagagtcacactccccctcctccttcccatcatgaggcctagttcaaagggatgcctctg

SEQ ID NO: 468828 - DNA, 1788 bp, Homo sapiens
gagttaataggtgcagcacaccaacatggcacatgtatacatatccaaagagttcaaagtggttctagaaactttggtggtggtcatggaggtggttttggtgggaatgacaactttggtcatggaggaaacttcagtagtcatggtgggtttggtggcagctgtggtggttgtggtggatatggtggcagtggagatggctataatggatttggtaatgatggaaacaattttggaggtggtggaagctacagtgattttggcagaaacttcagaagcagaagttctggtccctatggtgatggaggccaatactttgccaaaccatgaaaccaagatggttattgtggttctagtagcagcggtagctatggcagtggcagaaaattttaattactgccaggaaacaaagcttagcagtagagtagagccagagacatgacaaggaaattacagattacaacagcaatgtgctaatcttcttggcctcatgctaatattagccaagttataattcaataaatggagagaagataaatttgagaggtcaactatcctatttgtcaagacaaatttgatttgcttaagatcagaagaaaggcaaattaaaggaataaaactattaatattttaataaaagcacattaattgtatcaattactttaggaagaattgaaatctttacaattttgaatatttctatccaagaagttaatgtcctaaaaatcttgtgtttttgtgcatgtgtatgtgtgttcttcaggaatgttttaatgtacttctcataaaattgtattcatttattgttaaatgtgttcctaagtgttttatcatcttgttgccattgtaggtggtatattctttttttggatttttcagttatttatcgcttgggtttctgaaggacattactttatgcatattaattttacaccacaatttgttattgaagactcatcacttgtagtacttttttgttgaatctcaagattgtcagttttgtaatccaaatatctagaaatagtaataactttatcatttcaaatttcgtgactaattaattctattgtctaaatagcattgaataatactccctgtataaaatattaatatgttaagaaattgtccgttttattaagtgttctcatcaagaatgaatattggactttgtttaaaggcattttttaatctataaaaagaatgcatattttttcttcttgtatatcatatttctgcttgtgataaatatatttcttaatattgaactacatttatatatttctgaaataagtcacattaaaaaaatgatgtactatcattttttaaaaggtaatgttgaattctatttggtaatattttatttaagattttgtcttacatttataaataaattgcaatttaatgttttaaagtccagccaagttttagagtaatttgacccagaccacacttggtttcctgccccttctgctgagtcttatatcttggtttaccaatcactgaacctagctcttcttttttttttggtcaaaacatgaacttgaataaagtaactgcaagaaagtagagagtcagaaaaacatgattcttaaaaaatgacaaagataaaatcttccattgagacttatcaacattttcactctgtagaggtattatactttgtagcatttaaaatatttgtaacatttccaagttttcaattaaaaaataaggtaggaaaaaaatgagaaaattaaaaataaataaataaaattaattcactgtttaattgaaaaaaaaatcatgaac

SEQ ID NO: 468829 - DNA, 899 bp, Homo sapiens
ttgctctcccctgaagtcaagttgtctctctctgaggtacagccagcatctctgaagtcaagttgcttctcctctctactggctaagtctggggtctttataggcacatgatgaggggcagggcaggccataggctgtcagggagtggcagtattatccttggtgccctgagtctgaatgctgctcctgtgctctcagtatctgcaggagccaatttgaaggctcctgttgtgcctgctagtgacagcagtcaagggagtcaaccaagaagtccagctggacagtttctactccactatcctggctgttccagagaagtgaagaaagaggagagaagtctgggtcctggagacctcaggaacctggatatcatcctgaacacacaagaaataagttatggcagcaagatgaattctgaaccccactatgtaacagattggattctgttattaagacattgttatggtaaaccagaactccagctcaagactgcacttacagagaggaacttcagtgatgggcctggggagtcagggagctaacaataatatcaagtcagaatgtatttttttttttaattttctaagccatttctgtgtctggaagttaggcgtctattatattttactttcagtcaacggaggtaacctgcctagcagcctttgaggcagtccttattttgtgaatttttcattgtacttcacaagaataagaagggggaaaccagataataccagtatccaaaaaggtacttttagcaaccaaacttcacataccttttcctctttctttctcttcttcctggaaggcaaaagaagaaatctttttgccttccaggaagaagttctagttaaaaagccatctaaaagcaaccttaagttattattttttaactgcca

SEQ ID NO: 468830 - DNA, 596 bp, Homo sapiens
agacatcacagtgccaagctgtgtaaaatatccacccctagaatgtattcagaaccataaggcagggatgtttaagtctgctataagctccctggcttcagcacccctttccaggggagtgaaaggttctgtctcactggcattccaggtgctactggggtatgggaaaaaaaaaaaagagctcctgcagctggtttggtatctgcccaattggctgcccagttctgtgcttgaaacccagggtcctggtggggtagacaccagaaggaatctcctggtttgtgggttgcaaagaccgcaggacaagtgcaatatctgtgccagagctcctcaggctcagaccctcacagcttcccttggtattccatttacaaggctagcggtgttcatttttaccttaacaaagtctattcagagtcaatattttaccacttcacatttcatacctgatctacttcctacttactcttaatcatctgaatcttctcagttcctatttcatacttctcacatttccacttctcacttcacaaatttgataacttacaatagtataattgcattaccctccctatcattcattgtgatagcattgc

SEQ ID NO: 468831 - DNA, 620 bp, Homo sapiens
tagtcctgcctcccatccgccgtgatgatccgtaatgagttatcttctagatgtttaaagagcttaaacacacaagctctccgcagaagtgacttcctcattagtcattcagatccccaggcttttggggtctgctgcccctctagtacatgggaaaaaatgaagtggagcattgaagaccagcaattaaatacttccacagagaatgacatatgtcactttgttcaagttcattggccaaacaagttagccatggtggcaggaagggacacggatgaaggtggaaaccatcatcctcaacaaactaacacaggaacagaaaaccaaacaccacatgttctcactcataagtgggagttgaacactgagaacacatggacccagggaggggaacatcacacaccagggcctgttggggggtcgggggtgagggtaggaaacttagagcacaggtcagtaggtgcagcaaaccaccatggaacaggcatacctatgtaacaaacctgtacgttctgcacatgtatcccagaacttagagtaaaattttaaaaaatgcaaagttactggcttcttcatggagacaactgtttttgtggtttgctgttttgttagagtttttt

SEQ ID NO: 468832 - DNA, 698 bp, Homo sapiens
cgggcacaaaatcttccatctcagtcatttcagagcctctttaaattcatattggatgcaggtcttcgtcaaggagaaagtggaaagacaccaacttgccgtgaagcatacagcaagtttagatgtaaatgcatctcggcagcaaccacaaggcagatttactgaaaatgagaatttgtccagatgcattttaacatccacaaggtcttccaaaactgaagtgaaaatgaagggatctctggcaccaacagcagagaaatccttctggaatagaacaaccatccttctgttgcagctaagagtcatacaaatggcatcatcacagcagaggaatggcgtagtccttgaatggcagcatagggcccctgctgaaaatagtgatggtatcgcggcatgtggaatgaagggaatgtggggccactcccttgcatggagctggcaatggccgatggggtcaaaggcattcccagtcggctatatggcggcagagaaccctggatggggtgaggaatgggtgttgctatggatgctgtgctggtgccaagagcagtcagggactgtgggtgctgaaacccaggaaaactggaagaagatgatacccaggagctgagagacaaattatcagatgttgtaaaggctgaccctgtaaggaaaaacactcattagactggaaacactgtgtcaatgtacagatcaag

SEQ ID NO: 468833 - DNA, 624 bp, Homo sapiens
accggtaccgcaattgatcaaaccgacaggaaaggacaatactgatttaattacgcgggcagcagttacccttcagtacgtggctcaaggggcaccaaagccagattatgttgtacgaagatgtgcaaagctgttgaatggtgttgacactgaacgtgaacatggagctctacaaagcgccactcagcaggttcaaacagttcacagaaagagggtctccaattgagagttcagctgactatgggagttacatagagcccacatacaaaaccaaaaccaaaaaggggaaaagggacaaagaaaaagaagttgtggttgtcacaacctttctgactcagctgggctacattaaacctgaagctctgtacaatgtggagagcggtgttgccttcattacaagtggtgcagcattggattttcaaggtatccagcaccacatcaggggcatgctttgctgtgctctgtctctccagttctcggagttcattcaaagctgtgttcatcgtttcttcaatatcctattgaagaataatcggaaagagagaaagcacagactgataatgaatactaatgtatagaaacccagacacttaatttcaaaggtacatgtgcacattgtgcagg

SEQ ID NO: 468834 - DNA, 712 bp, Homo sapiens
ctaataggaagagagttaatctctggcctgccgcacttagaatgaggtggtattgcattgtggttttgatttgcatttccctgatgattagtgatgttgagcatgtttccatatgctttggaagctacaaactagtcttgcttcctatctgccattttcactcaatcacgccaagatgtctttataacataaagatgcaaggagaaacagcaagtgctaatgaagaagctgcagcaggttatccagaagatttaattaagatcattgatgaaggtggctacactaaacaagattttcaatgggttaatgctgctggtgacttaatgttgaagccagcgctcacttaccattctgaaaattctagggcccttaagtatttgggtaaatcgactctgcctgtgctctataaatggaacagcaaagcctggatgacagcacatctgattgtagcacgatttattaaatatttgaaacccactgttgagacctactgctcagaaaaaaagattcctttaaaatgttactgctcgttgacaattcatctggtcacccaagagctctgatggtgatataaaagctgatgaatgctgttttcatgcctgtttatgcctgctaacataacattcattccacagtcatggatcaaagactaatttcaactttcaaggtcttattacttaaggaatacatttcgtaaggctactgctgtcat

SEQ ID NO: 468835 - DNA, 4311 bp, Homo sapiens
tcaatcttttttttttttttttttttttttttttgagacggagcccggatgcccaggaggaaaaagtggtttcatggactgggcccagggtccccctgctgtgtgcagcctagagacttggtgcctgtgtcccagctgctccacccgtggctgaaaggggccaaggtacagctcaggccgtggctttagatggtgcaagctccaagccttggcagctttccacatgctgttgagtctgtgggtgtacagaagtcaagaataaaggtttgggaatctccacctggatttcagaggctctatggagacacctggatgtccaagcagaagtttgctgcaggggagggaccttcctggagaacctctgctagggcagtgtggaagggaaatgtgggattgaagcccccacacagagtctccactggggcactacctagtggagctgtgagaaaagggccaccgtcctccaaacctcagaatggtagatccaccaatggcttgcatggtgtgcctggaaaagctgcagacactcagtgccagcctgtgaaagcaggagggaggctataccctgcaaagccacaggggtggagctacccaagaccatggaaacccacctcttgcatcagtgtgacctggatggataactttaggtttctaaaaaacttgcagagatagtgtagaaggttcccatagatccttgagtgagtttcactttcccctaatgttattgtcttacattaccataagatgatacatcttacatttgtcaaaactaggcatcctatactggtatgttactgttaactgtgctgaaaacgtcattcagctttcacccatttttcccatgaatgtctgtcttctgttctagaatcatatccaggcctccacattgtatttggtcattacatctccttcatctccaaattatgaccatcttattttttattaaacacctcaagtaatgatagactcagtatctatacttctggaaaaccaaaaattttttaaagttttttttgcattattgcttccatcaaaatgacattaaaaattggtcactagaaaacataagagagtcattttggtattttctgtataaaacataactcaaccattatttcatatattcaaactcatccattatttcatataaaccataactgaccattatttcataactgtcagtttaaaacaggaaatacaattaaagatatgtaaaaatgcaaaatatgagaaaaacaatccctatttttattatataatgttttgtttttggtgacaggtttactgaactaaagattctccctttgccttagaagctaagctacagtcacctaacttttaccaatttaaaaattttaaagataggtgaaaataacagtatataggaaatacacaatattaaaaataaaaaataaaaacctattacctcttggatttttgtttttgtttttgaaaaatcatttcaaaattttatgcatgctgcctgctatattataaagttcacattaattcagctatatcctgatatcattctgctgtgttctattcatgttatcatgagcctctatctctctctcttattttatgtgcttattcacttatttcatcttggggttgtatcttgatttctattaactttattcttttattaaatgtcatttcagtttttaaaaaatttaatactggctagacttggtgaacataaatataatttcagtggacattaaaagataaacacaagttgaggtagaaaagaagtataggaaacaattgaagaaacattaaaaatacattgatatttttgggtacaaaagtgtgtgggtgttttaaggagagaggaaagctttgggaaaatggtctttataatcaaccaattaataataacctcatcctttattcaaaatagttacaaagttaaaatccttaaaagaaaatagatatgatatacctatactctgacaataatattttatagatattgttgataaaatatctaagcctatatagtttgctagattttcaagaacctcttatatttattttatttaataaaccttgaagtttagtattaaaatgccaaaaactaaaattgttaataattacctgtctttggtggtttgccccatacttttagggacaggtgtatatcagttgctctattaatattaaatgatgataaatgtaagcctatacaactcttaaaaagagtggaagcaacacattcctataaatatgttatggactaatttttagaatccatttgacacttgttatggttcataacatatacaaatgctattaaatgcattctggttaaatgatacatttggaactggggaatttgaggtaaaaacatacatagagatgtacagcagccaagcagagtaactaatggctgcgaacctggaatatcatagttcatgggcgtgcttaaaaactgtttacctttaaaagaaagttcaattgtctggagaatttccaggatgcattgtctgtcataactttatttagttagaaacctactccctgaaagcaatcagttgattcctagtagagaaacagaataagccgaaggcaaacctacaagagaagcaactagagaatctagttttgttaccactatttagaaggggataagatagttttgctttagggtaatgagagatgcattctcaaaccatgaagaagtgcctttgtaaagaattcaaatggtgtagctgaaatagagatgaatttcagttgttattactgcacatttctaagaaggatttttaagcactagagcattgggtgtgcagattaatgtggttgaccctttaggtgtgcacattaatgaggttgatatgaaaaaaaaaacaacaccaaagcctgcttttgttactactacctacttctagagttaaataggacatagggctgctcattgaattaaataatttttaaaaatgctttgacagctgtggctacaactactggaagagattattttgactttgatgctttaaaagggcttcattcaaatctattcaacagtttaaggctttctatttctgcttctgtcttaatttttattatttagagaaacagtctctttcttcagataatttaaggagaagacaagaagtggaaaaacactatttcagatcagtcaacccatactgtatatagttacatttattataattcatcaagacatcgcaatatatttaggatgttcattaaaaatacagaccaaaatttatgcacattttaacagctatctatttttattatatgtataacaattgtggattttcctccattttataaaaagtgtataaatcacacaaggcagaatatggatatttatttttctatttttatagatttaaaatctttttgttaaccattttctagtctcatgagttgctgagatggccatatagatataaaacaggaaagcatatttgtaaatatatatatatggattagaaaatggttaaccagttgccataaagtttatggcagttgctgtaaccagtttagcagttgccataaattttatgaacatttaatgaatcgagagagagagagagagagagagaagaagctttatggcaactgctgaagctcagaatcattggtacaaattacactaccaccaatgttgtaaaattaaagtgaaatatgtacataatgtcaattattactgttattaattattataaaatttgtgaaatgtgataattaggaaatattttgtaatttgaataatttatggttctttctattagtgagaaggtacaattttgtgcgtgattgtaatttgtcttctttatttcttcttctgtaagttttctgttcattcatttcacctaattttctcctgtgatatatttcctttttcatttttattttcaaagaacatcaaacagtttgagtacatatttataacactaattaaaatgcgatataatgcatgtgtgtaaaacaagatacccactaagtagtataataataaacataggaagaaatgttttgaaatattaaaagtcattattcttgtgttatagaattacgagggatctacaatatttttttaaaatttcagatatgcatatcataattgtaaaattggaaaaattcaatggtattctataaataattgctgattgtttttgttaaatatctttttttggttgccgtttaacatgatactatccattactgactttaaaatttccttctattggaaaggtttgatatctttgtatcttctgtaatgtttgctatccattaacattttattttatttttttattttaacagtat

SEQ ID NO: 468836 - DNA, 2732 bp, Homo sapiens
agctgagctcccacttataagtgtaagcataagtcaggaagtatggggatcagggactcacttgaggaggcagtctgttgcttaacagatcttcagctttgtgctgggagatctactgctctctttagagccgacaggcaggaacatctgctgaagctgcacctacagccgcctcttcccccaggtgctgtatcccagggaggtgagagttttatctatatgcccctgactggggctgctgcctttctttcagagatgccctgcccagagaggaggaatctaaagaagcagtgtggctacagtggctttgctgcatgctgggacatccatctcctcagacatcagagctgcagactatcaggctttcggagtctgggacttaaacttcccctctcacagttctcagacctttggccttggactgagagttacacaattggcttccctgcttctcaggcctttggactcagactgaattacaacactagttcctagttcttcagctttcagatgacatattatattgtttatgttgtgtgtctttttttttgttatagaagtaccatatatttgtttcatcagagttggaaagtaacaatataatttatagaatgtttttcaactacaaagttgaagaataggattaaaattattgttaaaaagtgaaattggtcgggggaggggggagggatagcattgggagatatacctaatgctagatgacacattagtgggtgcagcgcaccagcatggcacatgtatacatatgtaactaacctgcacaatatgcacatgtaccctaaaacttagagtataataaaaaaaaaaaaaaaaaaaaaaaaaaaaaagtgaaattgaagagttaaaacttggaaagcaaattaagtttgacattagaataattattcttagaaaatatacaaaacactattgggaaaagattattagtcaagtgaacatatgtacaaatacatttcctaaagattgttataaagacatatatttggtaaagttcatggaaaagtgtctagcttcttaaaagagattccaacatacctgtaataaagtagaccaaaacagggaattctgtttaccacactatcactcttttgttaacaagaacattaagtataatgggataattgtgttcatgtatgaatatcaccaggacttcaggttaagtgacagatgactgcatgacactgagagaaatgttttaaagatactatatctatttttaaacaattgtctttactgtttgtctttgtgctccccaaatgtagcactgtctctttgctgctaatctgcatttataactgtattagtgaatacctgatttatattttggagtagatccaatgcaaatatccacattaatgcaacacatgcaaaggtcaagaggtccaaaggttggttcccacagcaactgacctttgtttctctggagtttggcagtattaactttcactttgtattagcaaaacttttatatttaatgatgtgggaattgaacaatgagatcacatggacacaggaaggggaacatcacactctggggactgttgtggggtggggggaggggggagggatagcaatgggagatatacctaatgctagatgacgagttagtgggtgcagcacaccagcatggcacatgtatacgtatgtaactaacctgcacaatgtgcacatgtaccctaaaacttaaagtataataaaaaaaaaaagcaattagctcacacttgtgttttctctatattgccagtgtttaaagtaacagtagatgtttaataacgtttgttaaatgatcagttaggttgtagtttccttggaggatgaacctttggctttgtagataatatatttttaagattaaaacttgagagacacttttttaatccttgcaacaaccttgtgaggtagttaaggcaagtcatattacctttattgtacaaaatgatcaactgaggctcagaggaattaaaggattccagaaatcatctacctaaacaggtgaccaagtcttgaatccaagtattcttactccaaatcctgcattctttctgtgttatgtagtaggtagaatatataaatatagcatagagtattcacaaggaaataaagtgaggcggttttttaaggtgctttctggaaagttatatgtaataaattggagtgaatttgacatttgaaagacgataccaagaaagaagcaatggtactgatcttggtgaaagagtctgaatttgagccagttctgaattgtcttttaagccttacagtaacagaaaaactaagcacagccattttattctccttttacctccatttctcagcttatgtgaaccataagctatttaagtcttcagaattttaccaaagtattctaaatatccttttgtactctattttccccccaatcaactgagaaaaccagctgacttctttggtatttttataccttgtgctttattgttttcctccagtgtttttctcccgacgccaaagtgcagatgctgtgattgctacttctagctcaagacatctgtttttcagtaggtccttttctttctttcattcccaattataatctttatgtgccactgctaaagtgtagagtagaaacatcagatcctgtcctttcaagaataaatactctgtttttagcctgtgttttagcctctggattctcccatggaaggcagtttttaagttggattagtacattaaac

SEQ ID NO: 468837 - DNA, 742 bp, Homo sapiens
agcaccaatcagcaccctgtcaaaacagaccactcggctctctgtaaaatggaccaatcagcaggatgtgggtggggccagataagagaataaaagcaggctgccggagccagcagtggcaactcgctgtaacactcattgcgaaggtctgcaggttcactcctgaagccagcgagaccacgaacccaccaggaggaacaaacaactccagaccagccgccttaagagctgtaacactcactgtgaaggtctgtagcttcactcttaagccagcgagaccacgaacccaccagaaggaaaaaactttaaacacttccgaatatcagaaggaacaaactccggacacgccacctttaagaactgtaacactcaccgcgagggtccgcggcttcatccttgaagtcaccgtggatagcacagtgggcagccctggaaacaaaatcccctttgacatccaaaatgaagcttgcctagagcagtgtccggtccatggaaatacaagtaatattgttggaaggcagcaggcaccagacatccatttgtgtgggggaaaatgtatcacaaaagcgtttcctggtccagaaagtaaaccattgaacttgatccgactggtaacagacaagagagaatgagagccccaagggaaaagggaaaccccttatacaataatcagatctcatgagacttattcactaccatgagaacagaatgggggaaaccacccccatgattcaattatctc

SEQ ID NO: 468838 - DNA, 626 bp, Homo sapiens
ctagcaagaagccagtctggctgaagcagagtgagcaagatgggagtagtaggagatgagagtggagaggaactgtcagcgcagcagacatcacctggcatcacaggatctcagctgctcccccagcaacgagggccagtccttctccctgaaacagagtatcattggcaagtagcttctggagtgtttacagtcatcctcatcaatttctggaagcatggggtagaaactgattctgaaggcaaagtctccaagaatagcaacacccttcttcagcatttgttcctgaaaatcctttaccaatgtgtgctctttgggagacagtttaaggtcacggagagcaggacagacattctaggtgctggaaagtccaagatccagacaccgtcagatcccatgaatgggcacactcatctgacaaatacaagattccaggctggaacctgacgggtttttggcatcaacatcccttgctgtgaatttgttgttttgctgtttgaactgtgtgacataaatgtctgttgtttataaggcgctattttgttgtagcagcccaaagagacaagcagccatggacaagatgaaaaataatttgtatggctatatatcaataaaagtttatttat

SEQ ID NO: 468839 - DNA, 1164 bp, Homo sapiens
acagctcctcgggggtgtgcatggagcagcatatccttcttctcacagcttcagcttcctgcaaggctgcggagtcacctctgttggcttggacctctctgacctcagatgacatgggaaacggaggccagaagttggcacaagatacaggtcacaaagaccctgctgataaaacaggatgcagtaaagaagtcgaccaaaacccaccaaaaccaacatggcgaaaaacgttacctatgatcatcttcactgctcattacacgctaactgtaatggattcacatactaaaagacactccgaccagcaccatgacggtttacaaatgccgtggcaacatctggaagttaccttatacagtctaaaaaggggaggaaccctcagttctgggaaatcaatgcccctttcccagaaaactcatgaataactcatcccttgtttagcatataatcaagaaataactataaatgtactcagttgagcaggccatgccgctgctctgtctatggagcagccatcgttttatttctttactttcttaataaacttgctttgctttactttatggacttgccccaaattctttcttgtgtgaggtctaagaaccctctcttggggtctggatcgggcctactttctggtaacaaggtgacttttgaaccagtgtatggtggcaccttatctgtcacccttagtacaagcagattcagtcaaatgggaagggtggaaaccaaatggtaacaacctgagaaagtatttatttcctgaggcctccccagccaagtggaactgtgagtcaattaaacctcctttctttataaattacccaatctcaggcagtatctttatagcagtgtgagaacagactaatacagacttggcccaaatcttatattgaattgtaatctccaatgttggagatggggcctggtggaaggtgattggatcatgggggcagatttccccttttggtgctgttcccgtgacagagttctcttgagatttggttgtttaaatgtatgtggtacctctcccattctctcttcctcctgctctggccatgtaaagtgccagctttcccttcatcttctgccatgattgtaagtttcctgaggcctccccaaccatgtttcctgtacaacctgtggaaacactagccaattaaa

SEQ ID NO: 468840 - DNA, 2047 bp, Homo sapiens
acgtcccttcctagtttacagaagagaaaatgagagttatttggctaagtgaattgtccaaggtctcacaagtattgggaaagctcggccttgaacggaagaagagcccagacctaggggagtatgatccacttacccaggctgacagtgatgagagcgaagacgatctggtgcttaacctgcagaagaatggaggggtcaaaaatgggaagagtcctttgggagaagcgccagaacccgactcagatgctgaggttgcagaggctgcaaagccacatctttcagaagtcaccacggagggctacccctcagaaccccttgggggcctggaacagaaggcggcctcctccctggtgtcatatgtgcgcacgtctgtcttcctgctgactttggggatctcgatgatcctggtgctcctgtgtgctttcctgatcccctgtcctcccagagatctgcacagcacctggagccgccacttgggctcccagggaggtgtctcaagaccagctgctaatcttgtatgcctttcggggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcaggtatgatctctattaaatgttttttgtttcttatagggactgcttctattttagttgtctcagctcctagtgttacattataaatgctgcttgaaatgttctttttacaagggtttaggtttaagtaaattctctttgtgaggttaagtgaatacttgaccattatgaacccattttctctggcagcctcatggctccatggactggggtgtagtggagctttagagttagttaggtctgtatgcgaattccacctctaccactttatatctttgaggccttgggcaagccgtggagcctgtccaagctctggtttcttcatatgtaaaaaaggcatgttatatctacttacatcattgttatgaaaattacagctaacatatttaaagtgcctagagtagtgcctaatttttgctgtgtatatgtatttttagttttactgtattatatatatgtacattttatgtcaattataaaacaacagaacaggctgatacaaagttcataaaagatacataggaaaaaatctaagtcaagcaataataacaacaatgaccaaagaaaggagtgtcataatctaggctgtgacaaggcagactttgattcaggacagtggcccttgaattatggtcctaaattatgatttgcaggaacttcagtgtactggttactctgcacacagataaaataagagtagtctttcccccaaatcacaggaaggaataaattaatgaacagaataatctcaattttaagtttttattctggaagcgtttttcagagcttttgtcaaagtttctctaagactttttctcagacttcctagtgtgtctgccaaggaaatgcttgtgcacaaaagagtcaaacaatcggcaaagaatgtttgtggaaaaatgtggatatggctaattttgtctcatttgataacctattttaattttaatagaccttgtgtttgctgttgtgatctttgtattgcatatatggagtagagttgtaaattctggaggtgaaattatgtagaatggaatgaaatctgttaagattttgtggctttctgccaagagtcccccaaacttaagagtgccccatcagtcatgagttttgaggagcactgctctagcacactaaactctccctcacatttgcaagataaaggcaagatccagaatgagctaaatttctgaagcctacttagttttaagggttttaagctttaagggtactttatgttc

SEQ ID NO: 468841 - DNA, 481 bp, Homo sapiens
ttcctgctgcattggacaaggtcctttcgcctctgggccatgttgtcagcgaagtacttaagcacaggggctccgaagaagaagaccactcagcacagtgccggagaccctgccctgattcccctttctcctcccaaccacaaaggccatgcagcaaatccagaagctgatcaaacatgggctgatcatccgcaagcctgtgcctgtccattcccaggctccttgatgccagaaaaccttggaccatcggaagggcaggcacctgggcatagggattgtgttcaaaaacaagcgtattctcatggaattgtccgcaagctgaaggtagacaagtcccgcaagaagctcctggtggaccaggctgaggcccactggcctaagactaaggaagtgtgcaaacttcatgacgagtgcctccaggccaagaaggaggagatcatcaagatgttgtccaaggaggaagagaccgagagataaagct

SEQ ID NO: 468842 - DNA, 673 bp, Homo sapiens
cggtcttgtggagaagggagggggatgaaaggagtgagtaaatacggcaccttcaaccaaaacatccagagagaggggaaggctgccacctttggtgttttgcagctttcgctggtgatacttcgagttactggaaaattcaaggtgactagggactggagtggacccccagcataccacagcagccctatggcaaagtggccagactgttacgtgggtgcttgttctcacatctcctctccaggcaggtcttccaggtttaggcctttagccagcccccaccagagttatgaagccagtagcaacttgccaccccctggacagagcctgcaggggcaactgaaagcttttctgccactgcctctgcagtggaactgtccttgctacccttggactaacaaaggaacaaagaccttaagtgtcttatccatatcttcaacaagctgcagtcgacccaaggagaggaggccagtttatctcctatgggtcccacacactgtccactgcttgtcaccagaaaggaaactcctggctttggcccacagcacagacacttcgtcctgggctaattgcactgagcaattgttaacccacatctctctggggagaagaccccaggagacaagcaaagtggtggagcagtaagccagctgatgtggagcccagaaagttc

SEQ ID NO: 468843 - DNA, 637 bp, Homo sapiens
ctcgctataccgccgcttatgggcctagacatgagtcaacgagtaaaaaaagttgcacaacatggctgaacataatttgggatggacaaaggaatacagagcaaaatttttgctgttggtacagaggctacagatcaaattgacactacctgctggggtcccaggaggatactcaaaatggagagacttgacatggtccccaactgtgaaatgccctgtccagagaggaagaatccagagaggcagtctggctacagcggctttgccaagctgtagcaggctctgcccagttcaaacttcccaggagctttgtttacactatgcctacatttggcattcagtttacctagggaactacggcagcaatatgcacaagggtagaaggcagctatcatggtgtggattggatgtaaaccatctcagcctggtttccaacccttgttggagaggttacgcggtcatttggaggaaagaagatattctggctttttgagtttttagcattcttgcactgattctttttctcatctttctgggcttatctaccttcattctttgaggttgttgacttttaagtagggattttttttttaatcctttgtgatgaccttgaggatttgattatggtataacgtgg

SEQ ID NO: 468844 - DNA, 728 bp, Homo sapiens
gtgggtgtataatcagagaggcgtccctgcaatgattaaacaccaagggaagcctgccttcccagtccatgaccggcgccggagttttggcgaagaacacgagtacaggggattgatctcccaagggaggtcccctgatcagagtcacggcaccaaatttcatgtgcgtccgtgtgaagagaccaccaaacaggctttgtgtgagcaacatggctgtttatttcacctgggtgcaggcgggctgagtccaaaagagagtcagcaaagggagataagggtggggccattttataggatttgggtagttacttcaggccatctgggcatatacgtgcaagtcacaggggatgtgatggcttggcttgggctcagaggcctgacaatgttcatggcatgtgcagataggagtggacaatctcatcagggccttgcagttgcccttgcctcttcatcaaagatcgattgactatatttatgtggctctatttttggtctctctattctatttcattgttatatttgtctgttcttttgccaataccacactgtcttgatttgtagatttgtaagttgtgctaaaacaacttgaatcaatttggcagctcagtttacacccatgggaggctttgtgacaagtaaaattacatttcctttttagctagatttgtccctattttctgttaacttgaactggctaaagaaaccaggagagattcaatatgagggtc

SEQ ID NO: 468845 - DNA, 1518 bp, Homo sapiens
aggttactaggtgtttgcattgttgaaactatgcaaatgatgttaacaaaaagcaaacgagtgattttcttattcaacttcaaaatgggtcataaagcagtgaagacaactcacaacatcaacgcatttggcccaggaactactaataaacatacagtgcagtggtggttcaagaagttttgcaaaggagatgagaggcttgaagatgagaagcatagtggctggccatcagaagttgacaacggccaattgagagcaattatcgaagctgatcctcttacaactacgatatccgacaatgcccagctcagcggttggatggagaagaagctccaaagcaagcacttcacaaagccaaacttgcaccaaaaaatggtcatggtcactgtttggtggtctgctgccactctgatccactacggctttctgaatcccagcaaaaccgttacatctgaaaagtatgctcagcaaatcaatgagatgcaccaaaaacttcaatactggcagccagcattgaaacaaagccggttgactgaacccaactcatacaaaaaccaaaccctcacagccatcaaagagtataaaagcaaaaagccctatccaaaggaagcaacttcaaagattgaaggaacatcagccagacagatgagaaacaaccagtgcaataactctgtcaattcaaaaaaccagagggtcttcttgcctccaaatccccaccaagggaaccctatcaggctaacatcagaacttttagcagaaactgtacaagccagaacagattagaggcctacattcagcatccttaatgaaaataaattccaaccaaaaattttatatccagccaaaccgagctccataaacaaaagtgaaataaaatctttttcagacaagcaaatgctaagggaaattgttaccaccagaccttccttagaaaagaaaacagttttcttggtatagttttctttgttggcaggttcctctccctccaacagaactgtgaatatacgcaaactactcttttctgtcctgcaagttttctactgagaaatctactgatagtcttatgaagactccagtatatgtaaaaattcacttttctcctgttgattttaaaattacctttgtctttgacatttgaaaacttataatgttttctcagtgtagatctctttaggtttaatctattcaaggtcctttgtgtttcatgaatttggatgtttattttcttcctcatatttgggaagtttatggccattatttctttgaataaactttctgccattttcttttctcttctctttctgagaattccataatatgtacattggtttactcgatggtgtcacataactcccacaggctttcttcattcattttcattcatttttctctttttgttcctctgactgaataatttcaaatgaactgtctttgagctcttttattctttcttctctttgactgaatctgctattgaagccctatatggcatttttcagtttagttattgcattcttt

SEQ ID NO: 468846 - DNA, 525 bp, Homo sapiens
cagacttctgagttgagggataggagagtttccagaaagcatctcgtaaatgttttccccactcagtatgatactagctgtgggtggtggcaagcttcccagtctccagacaggtccagaggtgctgtccagaagcaagggactacggtcaaaaaccttagaagtctacctggtgttctattgtactgcagctgagctgacactcaaaccacaagatgcagtccttcccactctcccctacactttccaaaggcagagaagcctcccccgtggccactgccaccacaagcccacaggcagtgagctcccctctggcccaaagcaggttcagaaataccatccaagagccaaatgctgggattggggaccccaaaagcccacttggtgctccaccccactgtggccagagctggtacctaaggtgcaagacaaagtcacctgtacatttctctccacttttctcaagcagaaagatccttgccccacagccaccacagctgagaatgtgctgagtctcacctgaag

SEQ ID NO: 468847 - DNA, 584 bp, Homo sapiens
agacaccacatatgaaggaactagttgtggagccaacttatctaatttttcatttcttgctcatgcttttggtgtcatatccatttcaaaatccaaggcatgaagatatttcctttatattttcttctgagagttttatagttttagctgttacgtgtatattcttaatccatcttggattaattattacctatggtgtgagtactatgtgcaataggaatgctgagattggatatgcttgtcttgttccagttcttaaaggagtgctgagtaaacacgcaaggtacctgcaggacccacttgtgtccattgatctctcagagcagctgggcatcgtggtttctttgggcaaatttctgatccaaactgggtttggagttgtgacagaaactggactgggtccaggaacagatttgatccgggaattaactggcttggatccagttagaggcctcttacatctgactgggtcagaaaggaactggtagtaagcagtaatatttcaggggttatagagtttggcttttgaaaattcacaaggatttttgtgctctacccttttgttcatttttcttgcctgcatc

SEQ ID NO: 468848 - DNA, 2241 bp, Homo sapiens
catagacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacggtaataaatttattcggggtccagcagactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctcctatatgttttaaaagaattacagactactcttgtccgtggataccaggtccatgtgctgactttcaccgttcacatgctgctgcaaggcctcaccaataagctgcagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaagccaaggtctttccgactcccaagctcgctcttctgtgtcttaatccagcccactgaagagttctcagcagccagagcagcacgggtgttattagatggagctgaactagctgatcccggtgctttcaaagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatggcccaggactggctctgcctgttatagcttagcatgtcacacagcctttctggaacacttgtttcttcatctgtaagatggaaattataattccaacgtcacagaattgttatgaggtctaaatgagataatacatgtaacacaattagccctgtccctggcatatagaaaa

SEQ ID NO: 468849 - DNA, 558 bp, Homo sapiens
caccattttgttctgtactaagaaaaagtcttctgccttgggatgctgttaatctataaccttacccccaaacccctgctctctgaaacacgtgctgtgtcaactcagggatttccttggcatctccatttgttagtctttgcagttcactgctctcttctttccagctgggatgaaaacactttattcttccggtatccaaaacttgggggcgggggatgttggagaggatcccacagcaaagggctatgtcacatagtggaacagttttgtgacttaaccatagtcctctcttttccggataatatgtatgctggcattgggaaggacttcagactgcttctgcccatactgccagaatcattctttcccaacatttattttatctcagggtctcagctgcctctgtctgcaatctggttttcacatacatctcacatcccactagatatagtgtatacatttgaactccaggtttagacagggattagttttcttcccataggttttataggtgctcaacaaaccagagagtattaccaagtgcccacttagtgc

SEQ ID NO: 468850 - DNA, 723 bp, Homo sapiens
aggcctgtggatgttgaggtctgtcttttgtgctgactagaggatgcccccggagaacctggaccatgaacacagttgcaaggtttttctgttctaaaagagccaccttgcctgacaagtcatatggcagaacaacagtggaggaggaggacgataggactgttctccaagaatctggacatgagggaaatggagtgaccttcagaaagtacaccatttcccacagaccctctctggaaaaagcacagatcacagatttttcctgtgggttactgacttcctacccacatctgaaggcagggtgttgctccgagttgtttggctgtagtgcggccgcgagctgctgcgctcctggaagctggcctgtcgccccagctgactgcgaggtgttggagcctcatgattcaaactcatctaaaggaaagagatgcgtggacaagttaagcaacttgcccaagagcctgggcatggagctctagtactctgactccagaactctttttcttgactgcttggtgcttctcagtcaaatgttaggttgaatcatataaaacttcctttttaaagaaatatctgataagagaggttaaaaacttgtccaaagactcattcaaatttctctcctttgttaaaactatacatttttcggtgctaaagttgaacctaaattattgctagcaataggggaaatgattagtaaattaattttcatttccatttcaa

SEQ ID NO: 468851 - DNA, 581 bp, Homo sapiens
ttgtcagtggctctttcagtgatatgaagttaaaaccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagaaaaatcttctcttctttaaataaacgcaacattgaatgataataaaactggaaaccatatgtagctctatttttggttcattaatacagagcaaaaagccaatgtttataaaccttgtcaattcagtcatcctatacttttcaacatgtcttttgtctttccttttatatttttc

SEQ ID NO: 468852 - DNA, 558 bp, Homo sapiens
aactttcttgaccctatactctccttcttcttgcggtggcatgtactttccctcccaccacagctgatatcacgatggccctcatggtggatggtaaggcccgcatagagcaaaaaggcagaaaaagagcaacttctcactctgctggagctgggatatccgtcttctcctgcccttggacagcagtgttctgggttcttgagcctttggactcagatcagaacttgcacatcgttccccctgattctcagcctgcagacatgggaccaaattacaccactggcttcatggttcttcagtttgcacgtggcatatcttgggacctcttgtcctccatcatcatgggtgccctgggaatggcattttacttaggaaatttcaatctgaagtccctgttgtgtactggaaagagcgtctctaaggaaagaagtgaccttgggcaagtcgtcaatgctccttggatcccaccttcctcatctgtaaaatgaaagaactggatgagatgatttcaaaggactcttttagctttaacaggtttcagtatataaaagccaaaat

SEQ ID NO: 468853 - DNA, 1938 bp, Homo sapiens
tgggaagaatttagagacaagggaaaagcccagaaatcaaatgatggagaagtggtacagagaggagtataatttactttatggcaagtggaagggtcagacaagccttcagaggtgtgggattcaagtacactatcagttttatacaaggaaagctgacttagagaatggtggcctggcctcttatatcccagctgaaacttgcctgtactgggatacagaggctccatctttcttggtgatttcatttcagaaggatggctcccaggtctttgagaaagatgttccattcctgggttacagaatgcttatatctcaaggaaaattgattttctgtccaaaacacctaaatataaaaccccatctttctgctatgccatggtactgcaccatcatgagagaacgagaaaggagtgaggacaatactatgaccataggcagagaaaaaagccattctcagggaaataaagaaaggacatagttgccattttcaatattaatagaataatctctttttacaagtgccatcgacaaagactgcatttatcgtacacattgagcaagtgtgtaaggaggaactgacatttttctgttattggtaacgtaggctctgaaatactatttaataagaagcaagtatttctgaccagaacaatgtgggacatattgaaaagcgtcagcagaaactgaggagagagaataactaaaaggaaaactgtatttgcagcgtctttgttagaagacgctacatatataatataaaaacttatattttccaccatttccattgtagggtgctagaaattaatttaacactacagtaaactatccattgtgttcggttataattgtttaactggaaggtaaactgtttctaaagttttcattgcgtgttaataagtcattcccttattcacttatttcttatttttattgctcattccttcacttgttcatccatccattcattcatttaataggtaaaaattatagtgtgcatctagtcattatttattatttcactgttttcatagaaacacaagtatttttctttttcttatttatccatacttggcagacctttcctgattgttctagcaaagactctgattgtcaaaagttagaaaacatggaaggcaacaccccttacagaattctgggttaacaaatgggtactacaggggacactggcaaggctgcaagtaaacgaacacttcaagtacttttatttattcatttccaatgatcatatctactgctaatcagaaacatgacaataatggctggatctgaaaaggagtaaacagacactataatttttaaaactatcagccaccataaacataaggcaaagaaagcttgtgttgtaaggaattaaattcaatgtgctattatttcttcaattcaaacaagataacgagaaatttacaacaggcataggcctgaaaagtgtttgcctgaatgtaataacagtgtcactcttatctatggagagaggatgctctcattcactcagacagatgtgaacacactagtcaacttggtaattgtttcagtcactctatttaaacaattttaacacaaagttccttagtgaaccttattaggcagaactctaataaattaagttttcttgatataatatggtatattagatgcagatttttattttacacttttattttgacatcatggctctttcatttaaagaaatatttttgaaaaatgtattacattttatgatactgttatctattgttatttagctttctagtttatatttcagctttctagtttatatttatattatatttatatttatattagtgctgatcaattgtttataactgcataggatcacgaaatgaccagagatcagttattcctgctcccttatttttagataataaaggactgacatactctcagatctattta

SEQ ID NO: 468854 - DNA, 494 bp, Homo sapiens
ttcaggaggggaggccagagagcacagctcacttctctgaatagagatgacacctgtggctctgatcccaggggatactacattaattgagctgatctatttagcatgggcacaacagctgaatcaaagggaaagtgttattaaattcaccaaacatttactaagcacggactgctctatgttcctagcttttgactcagccagtagagaggagaagcggctggacgttgggaagaggcaacttgacttcaggggaaagcgaactgcccttcctgtccccttccagctcccctctctgctgagaaatgcatttaccacccttcagttcatccacacgacctcattctcgttgagctccaggcaagaattcgggatctaccaagtgcaggtacccaaaaaggctgtcacactggccctttgccctcactggcagagggcagccgccccatgtgacaatggaaagggcccactgagctgataacacactgctgtcc

SEQ ID NO: 468855 - DNA, 648 bp, Homo sapiens
agcagtcttagtatctgaagcagttaaaatgatacagggaagagatcttactgtgtggacgtctcatgatgtgaacagcatactcactgctaaaggagacttgtggctgtcagataaccatttacttaaatatcaggttctattacttgaagggccagtgctgcaactgcgcacttgtgcaactcttaacccagccacatttcttccagacaatgaagaaaagatagaacataactgtcaacaagtaattgctcaaacctacgccactcgaggggaccttttagaggttcccttgactgatcccgacctcaacttgtatactgatggaagttcctttgtacaaaaaggacttcaaaaagcgggatatgcagtgaataatcctcctctaaataccatatggctcaccctcttcactccaatgatttaacagtgttcaagatcacttatgaaatcatccatcccctttccactggtatgaaatgcctcttttatcatatactaaatttttatgtctactcggattcatttctagatttttaaccttccataattgtgacaatgcaaattttgaagtgccattttatgaggtttttagtgttgtattttggaaagaacatgggttttggacttactagatatgtcattctc

SEQ ID NO: 468856 - DNA, 1226 bp, Homo sapiens
atggtttaaaaaggggagaaaacctaacaaaagcgaatagagaaactggcaaaaggcatgaataaacatttcacagaagaggaaatcggaaaagtccataagcatatgaaaagatgataaacatcattagctatttactatctcccaatgataaaggatgcagtaatacccaagactggcagaaaaacacaggagttgtttgccataccctagacctggagtctgctacccctgggccatggacaggtagcagtccgaggcctgttggcagctgggccacacagcaggaggtttgttataagctgaacatccaccagacaactggtaattttatactgatgtttggaacagaagttcatcttcttattactgtggacgatctgtttgaaagttttgctaccttcaggtttgtgagtggcagaaacggcgttgaagtgtccaaccctcatttttatgatgcttctcaacaaaacgttgatttaattaccaaaaaagaatgtgaagaaataaacccggaaattgaaacacaaatacaggaaattccagggcatgaagtcacatacgatgaaaatagaactgtccccagaagtttggtaggggtcgtctagaagttcaaatacttctaagcagagtgaaagcatatcgggtagctctggcaatacatttcaggagggaatatgcacgtgcaggtccatatttggaagtaaaggacgcaggatggccttgtcaaggccttactaaaccaaggtcctggagggacttgtgttcattgctaggcaggagactttgccttctgtttgctgcttggcctcacaacttcccattctctgagcagatgtacaagccatttgccagtcatagaaatttccctttctaaaatcaatacaactttcaaaatgaagctgtgggtttattaagataattgcaaatggtaacatatctgagagaaaatcttaatagaaagttatttagaatacaagtcagaaaaaatcaatgtgtttattgagttttttgaggagcctcaatactgttctccagagactatactaatttgcattcccaccaatggtgtatgaggcttccccttttcacagtgatttctaaggactttacctttacatatgggaccagagtatgaacattttgaacaccatatgaggtgatatggagattcaaggctccagtccctgagtagcactcagttgtccctcaaagccaccaacacc

SEQ ID NO: 468857 - DNA, 546 bp, Homo sapiens
cggcagtggctgctccagatgggctgctgctgccatcaatattttatggtagatttccagaaagttccaccagtatggcacctgggcgacttctctctatccactcggagaagtttgttattaccgaccttctgaagcctacttctgtcaactcatcaaactcattctccatccagttttgttttcttgctggcgaggagttgtgttcctttcgaggagaagagacacaagcctctcagttgcaggtctgttggagtttgctggaggtccactccagatcctgtttgcctgggtatcaccagcagagtctgcaggaccgcaaatattgctgcctcatccttcctctggaagcttcgtcccagaggggcatccacgtgtatgaggtgtctgttggatcctactgggaggtgtctcctggtcaggctacacaggggtcagggacccacttgaggaggcagtctgtccattatcagagcttgaatgccatgctgggagaaccactcctctcttcagagctgtgaggcagggacgtttaagttggagaag

SEQ ID NO: 468858 - DNA, 698 bp, Homo sapiens
agccaaacaaaaggcagcagaaacctctgcagacttaaacgtccctgtctgacagctttgcagagagtagtagttctcccagcatggagtttgagatctgagaatggtcagactgcctcctcaagtgggtccttgacccccaagtagcctaactgggagaaactccccagtaggggcagactgacacctcacatggctgggtacccctttgagatgaagcttccagaggaacgatcaggcagcaacatttgctgttcagcaatattcactgttctgcagcctccactgctgatacccaggcaaacagggtctggagtagacctccagcaaactccaacagacctgcagctgagggtcctgactgttagaaggaaaactaataaacagaaaggacatccacatcaaaaccccatctgtatgtcatcatcatcaaagaccaaagcaatggaacaaagctggacagaggatgactttgatgagttgacagaagaaggcttcagacaatcaaacttctctgagctaaaggaggaggttcgaacccatcacaaagaagctaaaaaccttgaaaaaagattagatgaatggctaattagaataaccagtgtagagaagtccttaaatgacctgatggagctgaaaaccatggcaagagaactatgtgatgaatgcacaagcttcagtagctgattcgatcaacc

SEQ ID NO: 468859 - DNA, 791 bp, Homo sapiens
gctggtactctgtgatagtggtgtaagctgaccaagacagcagaggaagtagaccgacctcctgtgaaggggcaggcacaggacacgtaggggtcaggcaggaagtccagaccagcacgtacaatatgcctctgattccttctcattttgcaggtctcattttaaaactcaccaacccgggctttcatgagaccctgacagaaggttcattcctgtcctatgttctcacagcattcactccatctacccctctgatatgtacacaggaagaaaggggcaattgctttgctcattttctgggtcccaactgtcaagtaagctccctgaagccaaaatctgccccagagggtagcacacattgcgaccccttggagcagctgtttgctgttgatgacataaagcaaggagagctgctgtcttctgggacccagcatgtgctttttgaccatttcttccattgtaagctcttccatagtagagcctgggctttcttcagtgccacattcccaccagtctggggcaaagcagtgcctgtacctgttagcgtgctgaatatactgcagcctgagcatgtggagctcagtttcatgtgtttatttcaagacaacagggctgactgggcttccggtcatttccggtgatttctggaagtatcttttgataatatctagcccacttgcttgtgttctttataacttcaaataatgtttatataatgacagaaaaagtttggagattgtggcagtgggataaagcacagattagatgtctaattacttttaaaaagttga

SEQ ID NO: 468860 - DNA, 710 bp, Homo sapiens
ccttaagactgccactgattctctacagacagtgcagcctagtatctcccagacttgtacttcctatggccctgcacttggggccccactgcctggtagaaatgaagctttcgacagattggatgatgcctgcccttattgcccatgaggaagatccaaagagaactttggccttaactaagcttcctacattctcctggagtcggtggtttatgaatgtggtgccatctggggaactgacaacccctgatgtgttcactctgctcgtcttccagtgtcagcccttgggaccaaagatccaagaatccaaacctctcatgtctgagggtaggaaaggatggctgtcccagcttaagacgagaaagggaattcacccttcttttgccttttttgtctatccaggcactcaacagattaaacaatgtgcacccacattggtgaggaccatctgctttactcagtctactgactcaagtgttgatctcttccaaaaacaccctcactgacgcacccagaaatagtgctttacaagctatctgggtgtcccatagatcgtaacaagccacttcctccatctcatgttcccagaccattccagcccacagtaatttctccttttcctgactcctcatgttacctaatgtctttgccaaagactttagctcatggattttctagctcataatgttgttgaattgtattttgtgtat

SEQ ID NO: 468861 - DNA, 854 bp, Homo sapiens
gctgaggagtgtgggcgcaaggcgcctgcagccccgctaatctggtggggatgtggagaacctttgtgactaactcagggattgtaaaggtaccaatcgcgccctgtcaaaacagaccacttggctctaccaatcagcaggatgtggctgtaacactcaccgcgaaggtctgcagcttcactcttgaagccagcgagaccacgaacccactgggaggaacgaacaactccagacgcgctgccttaagagctgtaacactcaccgcgaaggtccccagcttcactcctgagctggcgagaccacgaacccaccagaaggaagatactccgaacacatcggaacaccagaaggaacaaactccggacacgctgcctttaagaactgtaacactcaccgtgagggtccgcagcttcattcttgaagtcagtgagaccaagaacccacccattccggacacactaggatcacattagctttttcactcaccacttcacccagttactatatatcaatcttactttctacaaaaagttttaaaattttatataaatgtaattgttaagccaaatttcttgcattgctataaggttttatattcccaagagaaggttgttatacttatgcctatacacttttagtatattctatttgatcttgtattttcaatctaaatggaagttactgcattctcaaagccctcctactacttaaccgtggctaatacagtttcctagaacacaaggagagtgatcaagactcatttgttagtgtaaatgtcttttccctggcattataaatgactagtgtcagggaaaattactaagctgatatttaggaaatttttttctattttt

SEQ ID NO: 468862 - DNA, 871 bp, Homo sapiens
gtcttttctgagacaaggaaatggccaactcgggcctgcaactgctgggcttttcaatggccatgcttggctgggtgggcctgatagcgagcactgccatccctcagtggcagatgagctcctatgcgggcgacaacatcatcacagcccaggccatgtacaaggggctctggatggagtgcgtcacgcagagcaccggcatgatgagctgcaaaatgtacgactcggtgctcgccctgccgggagccctgcaggccactcgagccttaatggtggtgtccctggtgttgggcttcttagccatgtttgtcgccacgatgggcatgaagtgcacacgctgtgggggagatgacaaagcgaagaaggcccgaatagctatgactggaggcattgttttcattgtggcaggtcttgctgccttggtagcatgttcctggattggtcatcagattgtcacagacttttataaccccttgacgcccatgaacgttaagtacgagtttggacctgccatctttatcggctgggcagggtctgctctggtccttctgggagatttgccagaggactttgaagagaagagtctggtcataaactcagagacatcaggcaattcatggttggaattcaacatgttcattgactgctccatctcccgtctcatgtcaggatcacttgtgttcaccactttaggcagaagcacaaatatcaataacgggagaaccatcatcataaccattgggttcatcagaaagtctgtccagccccacgattccctcttaataaagtaagaaggtggacctgaagatttcatttggagaggatagggtaatctgaccggacgcgtgggtcgacgatatcccggggaatc

SEQ ID NO: 468863 - DNA, 759 bp, Homo sapiens
gtctttgttccaatggatccagagaacctgcctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaagttggctttaaaattcagcgtggcctggcatcgccagcaggtctacgggctgttcttggaagggacagcgtaccatcagggaagtctcggggcccacagctgctttcgggaggtggagccctactctgtctcggtatcaggaagaggtcggggtgactttcagaaattctgtctttagagtgagatttaatctatggttttaaggaagaaaacggacttttctgagtgccttttgtgagcctcatcacgtgtggttttgctttcacttgtgctcatttagtcttcatgaataccctgcaaggggctgttattcccatcttggaggagacaggccaagtggcttggccaagaattcacagagattctctgcagaggtcagcagttacgtattcaaagc

SEQ ID NO: 468864 - DNA, 483 bp, Homo sapiens
actgatcatagagcttcgctcaatgaagcaccccgtccaagaccctttaccacctcctggtggcctggaggactcattattgagcccttggctgcatggaaaattcttccaggggcctggggaagatgacaaggcctcccatggccagagtccatttctctactatggcagctgcttggaggtgcttgcagcctcattgccaacccactggcacattcaggtcaatgcagaatgtgcctccaacttatcacactggagcacattagacaatggaacagacccctgtcttaagccctttgggaccctgtcagaagagattccaagatttctggctgaaggatggcaaagagggtctcaggggacaggaaggttctgcaaagatcacggagaggcaagagctcagcaaaatgcccccataagctgttcatgaaccctttggcttaccctaaagctgcatgtgcatggatctgatcctaaatagca

SEQ ID NO: 468865 - DNA, 2268 bp, Homo sapiens
aaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcatgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagatactcgagtcccctggttctgccttctgacccccgtagagaggaggagaggggtgggcagctaggaggaggcacaggatgaggtggggaccccctctagacctaagtcacctgccctcctctgacctggagctgggggccaa

SEQ ID NO: 468866 - DNA, 660 bp, Homo sapiens
tctatagcattattattttttattacagatttggtaatcccattatgactcctttaatgaccagcagcccagcgactttcctctggcatggcctcaagcactgcttcagctccaccaggagcaccaaggcactagaggccaggcaggagcagcccaggtggaaggccccagggcgaggaggagccccagcagcctgcctctttccctttcgagggagaatttgtcatttggtgaacaccttgcaagtaccagatactctgctagctgcttgtgaacactgtgttacttcatcctcctctgattactcccacaggatgaaatcctacatgtggagcactgggtcagccaccgtccacattttcagtgaggcctttgacaataaggccaaatggcccccctgaaaaattgcaatggtttataatggttgcaatggtttaattacccatttgctgagtaggattttgccaggtgaaaatgagggcaaaggcacatcagctgcaaggaaggaagtaaaagcttagaagcaggcaagctctgagatgctaaatcatgtaggggtttatgttcatcctgtgacaccagatgaggccctctggcagcagtggcatgtattgtgagaggtcagatggagaaagggagatccattagtggttggtggaa

SEQ ID NO: 468867 - DNA, 2387 bp, Homo sapiens
cagtctcgccatgttgaagtcagaatggcctgtattcactgtcttcgagagaacagagagaaatttgaagcgattataggaggatcatttgaaggatatttaaagcgcttggaaaatccacaggaatgggtaggacaaatggaaataagtgccctttctcttatgtacaggaaagattttataactaatctggaacctaatgtttctccttcacaagtaactgaaaataattttcctgaaaaggtgttactgtgtttttcaaatggaaatcattatgatattgtgtatcccgtaaagtataaagaaagctctgctatgtgtcagtctctcctttatgaattgctgtatgagaaggtatttaaaactgatgttagtaaaattgtgatggaactagacacgttggaagtagctgatgaagacaacagtgaaatatcagattcagaggatgacagctgcaagagtaaaactgctgttgctgctgctgatgtgaatggatttaaacctttgtcaggcaacgagcagctgaagaacaatgggaactctactagcctgcctttggctagaaaggttcttaagtcactcaatcctgcagtctatagaaatgtggaatatgaaatttggctggagtctaaacaagctcagcaaaaacgtgattattccattgctgctggcttacaatatgaagttggagacaaatgtcaagttaggttggatcacaatggaaaatttttgaatgcagacgttcaaggagttcattctgagaatggaccagttttggttgaagaactgggaaagtacacatcaaagaacctcaaggcacctcccccagaaagctggaacacagtgtcagggaagaagatgaaaaaaccttccacttctggacaaaatttccattctgatatggattacagagggccaaagaatccaagcaagccaataaaagccccattagcactacctcctcgactgcagcatccttcaggagtaagacaacaacaaaagccagcagaacatgtgtctttgtcaaatccagctccccttctagtttctccagaggtacatctaactcctgcagtgccttctttaccagccactgtgccagcctggccaagtgaacctacaacttttggaccaacaggtgtccctgctccaattcctggtcggtcagtgacacagactttgacccctggacctgattctgctgtatcccaaactcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttcttcactgtgtcagactggggaggacctacctaaagataagaatattcttcgattcttcttcaatcttggtgtgaaggcatacagttgtcctgtgtgggccccacattcttacctgtaccctctgcaccaggcctacctggcagcctgcaggatgtacccaaaggtccctactgaggctagtgttaatggtcaaatgctacagccagtgattggaccgccgacattttcttcacctctggttatccctccatctcaggtgtctgaaagtcacggacaattgtcttaccaggctgatcttgaatctgagacccctgggcagcttctgcatgctgattatgaagagtcactgagtggcaagaatatgttcccccagccatcttttggacccaatccattcttaggcccagttcctattgcacctcctttctttcctcatgtttggcatgggtacccttttcagggattcatagaaaatccagtaatgaggcagaatattgtcctgccctctgatgagaaaggagaattggatctgtctctggaaaatctggatctgtctaaagattgtggttcagtttccacagtagatgagtttccagcagccaggagtgaacatgtacattctctccctgaagcaagtgtgagcaattctaaacagagagagagagaaattgtgcctgttgaacttgaacctaaaaggaccattcaaagtctgaaagaaaaaacagaaaaagtaaaagatcctaagactgctgctgatgtggtcagccctggggccaactctgtggatagcagagtgcaaagaccaaaagaagagagttcagaaaatgaaaatgaagtgtcatattttgagaagtggggcggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacgcttgacggtt

SEQ ID NO: 468868 - DNA, 1669 bp, Homo sapiens
agtgacctagtgcctggccttctggcatctctcagctcccctcctcccattccttttaagccaccatgttgatcagagccaccctgggctgtcactgtggcccagaggctgccagaggaaacttctggctctgtgtcattcacatcgttgtaatggccttgagcaagtcacttaaccaggatccacattcatctatagactggaattttcgatgtgtacctcacagggtcattttagtattagatgaggggctgatgctgccctcagtgctgagttgccaaaccaagaacctcatcacaacgcagtgccccagttgctttgctccttcagtcactgctccaacggagcttaaaccaacttcagctaaatggaattgcaacacaattggtggcttccagggacatatttatactttaacgaagaactgtaggggaggcaaacctttaactccaaggaatgagtccctagttattggatattaaccactataatagctctctttttattgctgtttgcattgtatatctttatcttttacatccttttaatttcaatctagttgtacttttaaatctaaagtgagtctcttggagacagcgtatagttggatcatgttttttaaatctattcttccaatctcttaattggaaagtttaatttatgtgcatttaatataattgaaaaagtaagatttgtctgccactttgctatttattttctatacatcatatgtctttttaaatctcatgttctttcattactgccttcttttatgttaaatagatattttctttcattctcttgtttcatttactatatatttttgaattattctcttggtagttgccctggggattaccattaatatctgaatttataaccatctgttcatgttaataccagcttaatttcaagtatacaaaaatgttgctctaaagtggtcctgttttcccctcccatatgctattattgtcacaaatttcatcttaatacattttgtgcccatcaacatacatttataattattgccatacacattttatttaaatcagaaaaaaagagttaccaacaaaaaataaatttgtattgttttatatctgacttcataatttcttttcctagcactctttatttcttcatgttgatccacattactatcttgtgcctttgcatttcagcctgaaggattgcttttactattttttgtagggcaggcttgttagagacaaactctcttgttagagataaagtttctcagtttatctggaaatgtcttaatttatccttcatttttgaaggatagttttgccagatatagaatttttgattgacagcttttttttttttttaaagaactttgactgtgtcatcccactgtttccagccttcatggtttctgatgtaaaattagctgttggtatcattgaggaacccttctatttgatgaattgtttctctctttgtgctttcaaaattctttgtctttgtttttcaatggtttcattttgacatgtgcagctatggatctttttaagtttatcccacttggagattgttgagcttcttgaatgtgcagattaatagttttcatgaaattgggggagattttggtccttatttcttcaaatattctttctacttctttctctcctttccttctggggttccc

SEQ ID NO: 468869 - DNA, 1382 bp, Homo sapiens
aaatgcaggcacctgctgtgtgtggtgcacgttgttcccagtgggtcaggctgcctgtacagggaggtcctgtgttccctgggcacagagccatcctccagatgaaccagtgggcttatgcccaccatcttgcttttacctttatgccaaatgaagcagtaaggaacaccctcctgtttgcagccggagagataggagatgaagaagcgttcccagccaaggtcacagatctagggtgtcaactgcaggcctctgtcttttgcggagctttggacggggagagcaagccccatggccctggatccctcacaccagcagcttggggttcatctaagttacatgccggcttccagccccatgcgaggagcattactggccatgcccgcaacagacaagagggcatcattgttttgtttggttggtttaggagggctattaagggagattgtggagacaaatggagagaatatgggagcaaagaactgggccctctgttcactccttttgacactcctttgcttcttgtacatgtccccactctggctgactttggtgtgtttctggactcacacaccacagcacagatagagttgcagagggggcaacaaatatacactgtgcacaaatattcaccaagtgtctgctataagcttgaacctccaggccctaagaaatgcatcaggacccagcccctgaatgctgagtgctagttgttgaagagattaaacttacacccaagaataggtgagaaaacagcccagtgcagattgagtggcacccacctggccacacctggagctcccaaaaaggaaaggtgggcagagcctgcaggcgaaggcagcaggcagcaagggtggcaggagagctcagctgtgggggtagatggtccaggcgtggatcctggctatgccccttcctctccgtgagaacttccctgtgttatgtgacctcactaagcttcagtttcctcatctgtaaatggagaaaatgacctgtaactcctagtgaggtgcatggatgcctgcctgagctgaactcagtagagggtatggagcacccaagtgtctgatgaccacagtgaagtggtttggaaaagggcccatggtgaggagggggctctcagatggtgaccgctatgggattgtctgatgctggtctcctctgtcagtagtccagaggtctgtgacctcctgctggttaggccccaggccaaccaggcaccccctttcttccctttccaactgttacttccatgctactccccacagacaactatgggaaggaaagtgtctgcaccccaacagcctcctctcccttcctcaccgctcatgtgcaagcgcatggccctgcttagagctgaagtgtccttattgtgaaatgcc

SEQ ID NO: 468870 - DNA, 650 bp, Homo sapiens
gggacttctgtttccctgccctgggcctggagaatgttaaccatgaaaggcaaatgggcttcggttggaaacaagccattattagccactatttcaggcagtcacatttcccacaaggcacttgtgcaacaagttagcagggaagaaagaagccgagcctttgtacggcggggccagaacacaaagctcattgtgatgtttgtgcttctattcagacgccacgtgaatatctttttgaaaataatccaaacgaggcacaaatgggaacaagacagtttccttgatgggaaacacctgaaggcacaatcagacacttccgtagagcagtcagacctcagaagaaacccacagcaggaggggacagctctgagaggaactgggcagcacaatgtgtctcggatgagcagcaatctgatgactcaaaaccctgctgagctgcaggctccctcccatggctgcaggtccctcccattcagcacgcccaaaacgcagtcaacaacatctccctgcgacccattcatcccctattcctaatctcagtaagtgacgctccatcgcctgtgaaatgctcacccctttttctcagtgtcaccacttccctccccaacatgcaatgctttaccaagacacccccttctgcagctctcctc

SEQ ID NO: 468871 - DNA, 869 bp, Homo sapiens
agtaggtacaggatttctctctcttgagcatctgctacatgccagatacttgtactagtatggcgatgaagggtgatgagcagccacaccactgccccattcacctgctcaggaagacactccccacaactcactgggacatgagattggctcctgggagctgggagccaggacttcagaattcaacaaccattctgaaaaacacaggaaatgagaaagatcaatttacatgtggaagatgtgcatattcatactcttcctataatcctatagacttccagtttggggcgctggagaggccacagatgaatgcagaagcaaagtggaaaagtcctgtgggtttttttctgctctggtacgaggaaacacatgcaaatgatctttttatgagaaaacccattgagaacagtttcccacccactgtcaaggtccacagagtccagcctcctggctggagaactgacctttaaaactcttgtttacatctaaccacatcttcaactccagtctggcctggcatccaaaaccagaaagccaaacaatatactattcagaatgcatcaggctgcaaataatggattaaatcagattaaaatttgattatattaaaagaaatgattttttttttgccctgcaagacacctggagatcaacagttaaactattaggctgtatcttccttgtaacctaggctttacagttcttaagaaaatatataattagggcaaaatcaaaatatggcaatgggtataaattgtctcactcaagtactgttttcaattatccttctctaagctttggctttctttactcttttgcattttctaagtgatttcaggcattttaaaactcttttgttttaaacccaa

SEQ ID NO: 468872 - DNA, 702 bp, Homo sapiens
agacttaaccgtccctgtctgacagctctgaagagagcagtggttctcccaccatggtgtttgagctctgagaacagacagattgcctcctcaagtgggtccctgacccctgtgtagcctaactgggagacacctcccagtaggggccgactgacacctcatacaggcaggtgcccctctggaatgaagcttccagaggaagaatcaggcagcaatatttgctgttctgcaatacttcctgttctgcagcttctgctggtgatacccaggcaaacagggtctggagtggacctccagaaaactccaacagacctgcagctgagggatctgactgatcgcagctcctcgccagcaatggaacaaagctggacagagaatgactttgatgagttgacagaagtaggcttcagaaggtcagtaataacaaaattctctgagctaaaggagcatgtcctaacccatcgcaaggatgctaaaaaccttgaaaaaaggttagacgaatggctaactaggataaacagtgtagagaagaccttaaatcactcgatggagctgaaaactatggcacgagaactacgtgatgcatgcacaagtttcaatagccaatttgatcaagtggaagaaagaatatcagtgtttgaagatcaaattaatgaaataaagtgagaagacaagattagagaaaaaagagtaaaaagaaac

SEQ ID NO: 468873 - DNA, 725 bp, Homo sapiens
ctgaagatggaactgcccccagagatggaggccactgggttcaggaccagtctcacagatggtcccgcaggactgatgggtcctggggctcaaaccctggcttcagtggctcaaactgccattatagcacaggagccccggctaattctggaaattaaaggaaggaaagtagacctccttctaaacattagagccagtctctcccttttctcctctctaatccaggcctctcctcttcccataaaagggtacactcgccagcagttttgccaggagagtacactgaacaaaggagacagggtcatttataacctgacgcgtccaccctactgctgtgtccagtttccaatagctggaatgggacctcacattctgtatttgtcccgattggctagcaacttagaactttttaaaagaggcaaaggtagaggagaacaaaagaaggaggaagtaacttgtggaatgctgggaaaggaagtagccagaaagaatcgccatccaacaccccctgacagcagttaggtttgcttctcttgagcgggggaatgatacaggagttactaagaaataatttttaggcagatagaaagggtaaaaggaattctcgaaaggcaaattaaagggccaggctggcaagctttgatatgcaaacgcaggccattagaagctgagtccacccaatatggtgattcgtgccttcttcttgtcaccaggtatgccaagtg

SEQ ID NO: 468874 - DNA, 958 bp, Homo sapiens
agcaggggcacagcgtggctccagagagggctggagagagatgcttgctggccatatttgtcgggaatgtgcagaggtgtggggcccagctccacctgagcccctggctgccaccctggagctcttggctgtagggcctcaacctcttgctggctgttggctagaagctgccttcagttccttgctgtgggggccttcccattatggctgcttgcttcctcaacatcagcaagggagagagagtttcccagcaagagaggttacagtcttgtgtaaggttataacagaggtgatgacccgtcatcctggctgtattttgttggttaaaaacatgtccaggtcctgcccactcaaggggagggaattacactgggatgaatacctggaggtgggaatcatgggaaccacattagggactgtcagccacaatgaggaaacaggggtggaggttgcgggagggtttatatcatgaacaccatcttaagtactatagtatgaatttgttttttctaaggagcctaaagggagagacaatgactggatagagaagcaaccaaagtttagttcccagggccaaagcgccaatcagggaatagtattcagctattaacttgtcagggaatgtacttgagtaggtaggggactcaatctgaaggtaaatggtatcaggctacctgttttaactgcattttcttagattctgtatgtctatttggtatctacttatcgcagggtcaaaccataagtaaatatggtaaaccatatttacttttgtccttttcaacaatatgaagctatattaattttaagtgactacagcataaccatccctgcagcaattgaacatttgtcagacagtgcatatttaacaccttcacattttcaaaggacgtaaagtctggctgtttttgtagaaatcaaaccatccattattaaagtctttagtatttttgtcttc

SEQ ID NO: 468875 - DNA, 576 bp, Homo sapiens
tgacagctctggcatctgcagctgaggacgcacctggacaggtggtttaaaaaaagtattaaatggattgttttatgccaaaagaaattattggggagaaggtgtggagatggatggcaatactaaaaccattacaagcagaaaggacagatacattacatagcagagaggaaggggatgtggtgagagcaaagtactgcaaaatggcagtgggagatgagactggaaatgtggacacgaggccaatgagtgtacagctgccggagaaagacagtgcaggggatgtcatcacaggctctcaggtgcctatgatgtcccttccaatcctggttcttccacctatcagcctcagtttcctcaactgcaaaatggagatgataacagcaagtagcctcagagaattcctgtcagtattgaataggagaacttcttccacagtgcatactgtatcaagggatcaaaaaagcatgagttcttattattcaccacattgggtcttgttgggtcttgttgtgtcaccattagtgaggtcttgctctactgtgacatgacaaatcacacatctggaaaacaata

SEQ ID NO: 468876 - DNA, 726 bp, Homo sapiens
taagaattacagagggtgcagggagtgagaatcagaatagataactggctagaagatgtttgttgtggtcaaggtgagaggtggtgatggcttcaatcgggtagtaaatcctggaggcagaattactcaggcaaatattatgtactttaaaaagtttttgacacatattgctgtatcctcctctagcctggacatctaccagagattgtctattttctctcactgtgatcatgagtgtgaatgtattttaaacaaacagcttaatacaagaatcaacatctccctggcacccaaaatccccaaaacatgcaaaacagcctgcgatggcctgaatgtttttgccccatgttccaccaaatttattagtgccctatcagagaagccccaagagctgtctttccccttctaccacatgaggacacagagagaaggttccatctacaaaccaggaaacaagctctcaccagacaacatctgctggcaccttgatcttggactctaataagtaaatttctgtggtttacgagctaccccatctgtggtatttggtattttgttatagaggctgaatggactaagacacagcaacaaccatcttattaagaggtgcatattttatatgtaatgtttatttatcaaaattataatatatttatgttataatgtattaataataaatgtaataataatttaatccaaaataagttttaacacttacaaggtctt

SEQ ID NO: 468877 - DNA, 836 bp, Homo sapiens
ggtgacctgaaaattagtgactgaagaatgaaactgaaaatttggagcatgaatttcttgttttcatcttttcctcttttcatagaagttattttaccctgtgacagcgttacctcttccttggatgttgggtctgtctccacacacaggacactgtctccttgcaggaaacccacactgcaaggaaaccaacatggctttgcctgccagtggagagaagtggagaagaatgcttcaaggcagagagcttggactccacagagatggctaaaagggacagacataaaagaaactcagcttgattcaaggtttctgagcacttggtgcttgattaagctttcctctaggttcattggcctctatgttccatctggtccaggtgatgcatttgggattgacttaatttatgatattaagataccttacatcctctcagagatgaaacaataaatattgaaatatgaaactttttttgaatcttaatcattccctgattcaatacttttctgtattacagaaaaacagtgtaaaaatattgatgtctgaaagtatctacagaaggtatctactaatgtgccagcccatcaagctgtcttctcctctcttaaagtagggacacttagtgtgcctaaaaaacagaccacaaaagaattagacgaaagcctttttatttagtctatgtttacatttaaagcatttgttattataatactattttataactgtctgagacaacttttgtctactgacatcaatttaaaacataattactacagaagtgcttctttaaggcttatccagattaagtcacttaagcaaacgaggatggaccaaat

SEQ ID NO: 468878 - DNA, 540 bp, Homo sapiens
gcaggagtggagctgcccaaggccatgggaactcacctcttgcatcagtgtgacctgggtggaagcatttgggatcgtcggctctgctgctgcatgataggtttgggactccgaagactggcatttcctccttctaaacttggaatttcaatacattactatgaggaagacaaagatggatattcaattgccccagcaccatctgttgaaaatagattttctttcccatttaattttcttgacaccttcatcaaaaatcaattgactgaaaatgaaaggggttatttctgggctttcaattatattccattgaccaatacatctgtccttatgctagtaccatactctctgtattaccttatctttgtaatatgtaaagaacttcccaatccatcatgtcctaaagtgctccattacccccactctactcaactgggctccactttccagcctgaaacctggtgtgatcctataagcttcccggtccttggtccctcttctcactttttctaatcaattgccaagttctgcctattttaa

SEQ ID NO: 468879 - DNA, 575 bp, Homo sapiens
cacatccatgaagatttctggtgccatggcaacatcccctactgctttgaacgtgaagaccttcagccattttcgattcaccccaaatctgaagatctttagccatgtctggtccaactcccttgtgtttgcaagtccaaacaacaggtctcagcagggagccccaaagagtggtagacctggtagacctgggctggctgcagcatacctcaagatagatggggaagccatgggtgctgcagtggatgctgggttggctcaccataagcaggcgctgaaacagaaggaacagaaacacccaccagctgccatcctgcaggaggaagtaaaggaggtacaaaagcaagagcatctgaaagttcaggatggatttcttcggaaaagtgatgtgttcctgcatcaccaccacggagccaccctcctcttcacctactcccaactccactgacttccccttgacctgtttttggtgaagctgagccatgaagaattccataaggaagaggaggcctatgaagataaagataaagaagtacaaagttcctgttatagaatcgtaaaaccttttttttttt

SEQ ID NO: 468880 - DNA, 550 bp, Homo sapiens
agatgtttaatcttttccgagagccagctgcggtgcagggaggcagaactgaggtgggttccccgacgtgaggagatgaagcttggtcctgggagacctgggcagcgagagttcacagcagagagttccagagaggagacagctgcacagacagccaactccagagatctgcagagggactctgatgggaatcagcacatgcatatatgtaacgaagcctcttcacctaatcccgatcctaatggccaagacaggaataaaaacagagctatggaccaacgccgttaccccattatgacaacaaatacttgctgctctcagactgtgagtaggatactcagccgagctcattctggagcttttacatcagcacccaatgggtggattcctggcatgttttctcagcacctccatgggtgttttcctgctttccagcctcagccagccacacgtgcttcagtgaactcctctgccatcggtggccctatagccgtacttctccaatgagatgtgaatctcagccttggatggagggctttcttccacattc

SEQ ID NO: 468881 - DNA, 985 bp, Homo sapiens
cagttaaaggacatctcctcatgactatttctcctttgcaattaaattcacgcacattgggtcagcagtgccctgccagtagagagagtaccagagtcagccaacagtaaaagagaactaggtggccacttgggttggcttctgaatccattgctgaaggggggccactgaaccatgggcagggccattgtggtttgttcggggttcaccccagaccctatttgcctgggtctctcccacccctgtagatgtcaccaggagaggctccagaatagcaaagatggctgcctgctccttcctctgagagctctgtcccagaggggcaccaacttgttgccattaggaggcacaggatcagggacccacttaacaaagcactctggctgccccttggcagacggggtgcactgcactggggtaaatccaaatcccacttgtccggactgccaggattcctcagagccaggagggaaaaagactaagtctgctgatccacagagattggccagccagcccccactcccaggggctctgtgtcagggaaatcagagttctgtccataaacccctggctggagttgctgaaattccagcagggtggacccaactgatgaagagagatgggtcttgttccagcctaaagaagcagtctggccacagtctgccacagacactatgctgcactttggagaattactcctgggtccaaacctcccagacccccaagtaccagcagggaaaaatggcagactggagctgcagtgatggctgctgcctcagaccctgtgagctccatcgtcttaggcagcaggcacccacagtgatggtggccacccttccccctgggaactctggagtcttaggcagtctccagctgggcagccacagagaatctgcacagctttgtgcttgggacccaaggcccttgtggtgtgggctcaccaggggatctcctcatctgtgagttacacagacctgtggaaaaa

SEQ ID NO: 468882 - DNA, 504 bp, Homo sapiens
gagaggagaaccaagattgactgcagccaagtgaacgaggccatggacttttatcggtctgtggcctgttaagaatggggccacacagcaggagtagtgtgactcctaatgtgaacttcacatatgagggatctaggttgcatgctccttatgagaatctaatgcctaatgatctgaggtggaacagtttcatccccaaaccacctcctcctttatccttggaaaaactgtcttccacaaaaccagtccctggtgccaaaaagccacacaaaaatagagagagacttcaagatcccactgacaacattagatcattgagaaagaaaactaacaaagaaattctggacttaaagttgacagttgatgaattggacctagtggacatctacggaatacactacagagtacatgttcctcttatctgcacacgtaacatactccaagatcaaccacatgctcagccataaagcaagtctcaataaattcagaaaaatcaaaatcgta

SEQ ID NO: 468883 - DNA, 850 bp, Homo sapiens
tgtcatagatggtctgtgtctgcgtttgagatacagatatgacctgtgctcgtgtcatgggagggctgcccttaagcccctctgcagcatggtgttgtggcagttcaggtcttaatcagggatctgtgccccatgctctggaagctgagctaggaggaagaagagaaagcgacagcaaggagcttccaggttatactttgcctggagctggaattcaactgcagcccaggaccttcattcacttaattgatttattcagcaaacatttgcaccaggcactgggcctaagcgcaagtcttgcaccagtgaacacgagtgacaagctccctgcattcatggagctcacagtctacaacaaaaaatatgcatcaggagaaaatggggtcctgtccactgagaagggtgacatgagcaatgccagacttccctcttcagtgggtgtagtacaggtggcttaccaagagaggctgcagtccaggagagcaggttagatgtttgtccgtccacatgaagtcatgagaatggcaagacgaaaagaaaaacaattttaaatcaagtatagaatgttgctgccagttaagatatagagggtcataaaagattgccaaacatactctaataaaaactaaagacaaaaaaccagataagctacaacatcacaattttttcaaatcaatcagagagctaaggaagcaaggaaacctgtgtggcctaaactctagaaagtgaaaagcccttcataaacaagaaaaggctaatgggtattcttgtccttagtgcaatggaggggggagaaagaatatgacatagatgaagggggagaaatcagctaaaattttaataaatattt

SEQ ID NO: 468884 - DNA, 1110 bp, Homo sapiens
cccggcaaaatcggcgcccagacagcaaagctagaaatgaaacatatggtcagtaggagccttgctgccaggacccgtctcgggtcaacgaaatctgagacagtcaaggtaacagaggcagctgttcgaatagattcattggagagtctaaggcagctctccggaccaagctgtaaaggagataagatagaaataatcactctggtaccacagcagacaggccttgaaggctgtgagtcccaagtgaaaaacatcttactgaaatattttattaaatttgatccaggggacacagatgaaactagaagccatcattctcaccaaactgacacaggaacagaaaaccaaacaccgcatgttcccactcataagtgggagttgaacaatgagaacacatggacacagggaggggaacatcacacactagggcctgtcgggggataggggtatctcatctccagccaatcaaacttgtattctaaagcagactgcctaaaagaattactgtgcaaagaataatcattccattaggaaaaatgtatacctgatccagttatccaagttcagaaatcttacttggaaactacttgacgaaagttatctagagaaaagggacctgattatacctcttgctctgaggcactcttgccctgggatctttgccaaggtatttaatctctttgtgctttagcttctgagtctgtaaagtcattttgtgtatttatctcttataaatcaaaggagttttaggtagctcattaaaatacttgccaggatcacatgagatcatgtaagcaagcatcttaatccatgtactgcactaaacaaatacaaggtaatgttgttattagtatatggttaaagtcctgttcaagtaaatatcattaaaataaaactgtatctttaaaaaaagttcaagctctaactgatgtatatttattcaaagcaatatcttcaaagtgtagtaattaagaaaaaccttgagaaattgctacaggataattttctttttgcaatagtcaattatgttatttctcttataagatacagagatatttgaagaaataagtgttcctgatcacctcaaaatgtcacattagctagtatatt

SEQ ID NO: 468885 - DNA, 700 bp, Homo sapiens
ctgattgttctatctgttattgagaatggggattcatgacaatgaaatgtccctgatcactgtgcagcaaggttgtgtgaaagaaatatttgaaagaaaacgcatttggggtcagctttggcctgctctggacctctccaacagccctgtcaggttcctggtgcctgctctgtccccagcacccactgcccacattagagcaagagatcccttcaaagacaaaccttaccacattgctcttctctttagaaccccaaaccttgtccgagacacttactgctgccacagggcctttgcatatgctgttttgccacctccttaccctaaaactcctattcatacccagccctcacctccacatcactccacaggaaaaccagacctcctagaccatttaggtcccttgaatatatgcttcctaggagccatgtcaccctttatgacaccatgccaggcagaattccctgtgggaaggctgaagagttccagcttcccagtaaatatgcatagcttctttgcaccattgatgtcgtaatatagcactccgaagggtgataatgtggccctttgtgggccacttgctgagttttaagaacagagcatcatcatactttattttttaaaaagaaaaaaaaggtcagatgcctccctgtgtataaaccaatgcctccttctagtaagacaccaacgtgaggctaga

SEQ ID NO: 468886 - DNA, 659 bp, Homo sapiens
cggagcagtttaaacagacagggatggttagaaagactcagagaaggtggtgtgaaggaaagagcctggggaatggggagcgaagaggaagcttattcgtagtagaagatggattttcaaaagccggatggaagagagaagagtggagtaggcccgaggaggggagaatgctggaagagggaattggcctcttctaccagcactgcaccattaacaagatcctaacctattccatgttatttcacaaaacatacttgaagaaggtgagggggaagaatgagaatccaccatctatgaaaatggagatgggaattcagcttggactagaaaaggccaaacaatatactattcagaatgcatcaggctgcaaataatggattaaatcagattaaaatttgattatattaaaagaaatgattttttttttgccctgcaagacacctggaggctttacagttcttaagaaaatatataattagggcaaaatcaaaatatggcaatgggtataaattgtctcactcaagtactgttttcaattatccttctctaagctttggctttctttactcttttgcattttctaagtgatttcaggcattttaaaactcttttgttttaaacccaaccagccaaaccaagttgttttgaacccaaaccaa

SEQ ID NO: 468887 - DNA, 718 bp, Homo sapiens
ctgttagagatggagtgcgtgcatgtggttgaatttgaagagccaaaggtggcttttcctatctcctcctgcttcatctctgctgaatttgaaaagttggtcacatcttcttttgaagccttctctccccactgctggtttcatgttaccactctcattgtattcttctccaagtttccaatttgccttgatctgaacatcatgaccaaatctccaaaactgtcctttcttccttggcctcatcgactcgtcctcttcctggtttacacctttaaggatggcattccttccagggtgaggtggggaacattctgtgctttgcctcttgtctcctctttgctacccccatttatgcccaactccatccacctccaacaagctgatgactctcaaagcctgctgggctccaggctcatgcccatgaccacaggctccctaatatccagcacgcccaaaactaagtcagtatcttcccactgcaacccatccatcttgtatttctaatctcagtaagtgacgctccatccacctatgcagtgctcactcctttttctcagctttatcactttcccaccccaacactaagccatccccttctgcagctctcctcaatgaacatcttgcgaacccaccattccactcttctccctgctgctgccctgcctgaggctgccctcctcatttatcattgtaggggtgtgtttggtggttcatgtat

SEQ ID NO: 468888 - DNA, 3895 bp, Homo sapiens
gtgggagattctggatggatctgacctgtggtgcacggccctggcagcctggtgtctgtgcctcctctcgaggtgagatttttctctggcacccacttgggttaagtccagctgccaccttctctgtcctgtgtggggcggctgagcgctgctgagaccacatggcctcatggatctagacgggtatgagctcctggcctctgcttcgtccttggtgctgcccgtaagtcctgtggtctctggccagctttatgtcctactcccccaatggctatgacagaccctcgccggtctcctgaagctttctttcctactgactcgcccctcgccagccccagctcccagcgaccttgccctctgcttcaaggaagatgaaaagtttcttatgtgggaggaatgtttgcactttctagactccctctgcagagaccctcttcctggcaacctctccttctacagccatgggcggtgctgaccaggagaggagccactgggagtcctgcagaaggcctcctggcagccacggcctccccactgtccccagcagcagcagtgcatcttcaggcagctctgactgctggaccctgcagactcagacccccacccctctgcagcaggaacccacccctctgtgcccacggaacccgctactgagggctcagcatgaggactgtgtgcagcctctcctgagaccctcactcaccaggtacttgcagatttcctccaggacctacatgcatgtggtcgctgagcgtggcacgcagcaatggctggatgaggaatttccaaagttgcttccacaacttcttcccaccttcctgatggtttactcacagcttcagaagaagctctgtgctccagaaactggtccccaccctcaccctgacatataagccagagacttcacagactaagaacaggtcccttcctcttctcctcttgtcctcttgcaccctctagagagctctttccctccatcactgggaaggtgtatgttggacggggtgggaggttgaggtgacacaagtttagagctgggaaggacctgacatccctgagacacaggtttatgggactccagctctggcatctataactctctcaacttgtgagccttggatttcaactatttttgtattggtctcatctcctctatgactttggacacctgctggtggcaaggccaatgtcagactcacctatctttctgttatgtttaaaatttaccatgtgtactatacttgacttaactaagtctgaagataatatctttttccttcctccaaatgatacaatccatggatctttgaatgcttgaattctgatcacagcctcccacatgatatactaatgttgcccagtattaaaatactgggctaaagctccacctttgtatttaacctgtaaatttgctctttatgtcatcatcttcatgactgtcatgattttgtacagttaatactggtttagatctacccatatgcttacaaatttcttggcttatatttctttcttccagctctttcctcccttttagatttattttgtttttccttcctttgtggttccttcagtgagggtctcttagtagtaaacatttttagtctttgaaaatgtctttatttggccttatatttgtctctgctttcagcagtctgtgatgtttctaggcatacatttccttggttttagtctgtttgaggttcactgagcaactttaatctctaaattgatacctttcaccaaacttggaaagtttttactattatttctagaattgttgttcagccccaccatgctctttctcttcttttaggactctcacgacacaaatgttacaccttttgttatggtctcaggtcacaagatacttttggttttgaatcatttttctctctgttcagagtggataatttttattgatctgttttcaagttcactgattctttcctttggcatctccattttactatggagcctacccaagcttatatttttcagttctaaagctttccacggtttttctgtatgtcttctatttctttgctgagactatttctgttatttcaagagtgttcaccgtggctttttggaacactttgcacagtaaccgctttaaagtttttattacataattccaatctctttccccttgacttcagggcatgttcattttcttcccatgtgagttgaaatgttcctggtcctttgcatgctgagtgattatggattgaatcatagacattatgaatatgatattatgtgactgtgggtcttccaagagtgtcctggtaattttagcaggcaattgacctatttaccttcaggctgccaatcctgtcagccgtccgcgggttgtgattccaatgccagttcttggttcgaagcctctgctattgtgcatttgggccaccagccagcctgggacctggatagtagtccatcctgtagttcagttctcattgtctatgacgtgctggtcagggtcagacctgggtatgtaatgagctcgggagttcataaacacctttataggatcactttcctcctctctgccacctccctggtactttacagttccctggggctccccttcttcagtggccagaaagctggggcttttgttgctccacagtgccaggcacttctgtgactgtccccacatctggtgctaagtggcaagcggcagagaagaaataaagcaatgggaattttcctcatcctcttgggcccacagtgactgcaaatggagaggagggcttccctccctcagttttgttttctgcaggttcccatggggcctgcttggaggctgaggcttgagagaccgagagaaaaagaaacgagggatttcttcacttcctttgagcattgtgaagtgtttctggctccttgggtgttacctagagggattctctcagagctctctctgtatcccggtgcatacacctccgtttctggttgtgtggcttgcaggctgtggatcccaggagatattacaacccatgccctggggggttattgggaccagtgatgccctccaacccctagtaggtggagtgtcagcaaactttttgtttttggtccctagagatttctcttactctcctgcaagctcagctatgcatatatataatattttatctagtatatcaaggtgtttagagtaagaaggttgttatcttccatattgctgaatttggaagtcaggagctatagtccaagtgagaagtactaagtggccatcacctacacagaggccacctggggaaatggtaagagctgcaccacagggcccctcagatgtgggtgctgggtgctgctttgccattcacccagtcatgtggagggaggcagggcactgaggcaaagcttactggtctcatcatctgtgaaactttcttctactattttggttcacatgccctcttttctcttctgtctgttccatttttggaatttacttggatttattctctatgtttcttaatttctcttccatatttcccatttctttgtctactttggaagaatttctgggctgattcacttttaacgaattcaccctttagttgtggttattctgctattcaacccacctattgaattttcatttaactttttgtttttctaatgcagaaggtactctatatttttctcttctggatgatgttgtggtatcttgatagttatttcattattctgtggcgatattgcctgaccagtgcctgtattgatttatttattgatttatatataacttcaaattttgaatttctaagcactttaggaactgaactcaatatcttttaagaaaaagtttctggggattcaatagtactttctctaaagttttgttcagattttattgttaactccatccttggatggtggg

SEQ ID NO: 468889 - DNA, 1358 bp, Homo sapiens
accaaacacaatgcatgatccttggcagcagtgccaatcctgagacggcagcacgtggtgaagggggtctcctgcaaagaaagctgaggagcctgtatggttatttctaccatggcctcaatcttgatgatggcaaggaagacccttgcattcctcagagggatatgttctacaatggtttatattacacacctgtaagcaactatggggatggagatatctataatattgtcaggagacatggatgtgggacctcgtcagtgtcgagctctgccaatctttcgttcctcattcctgatacgataacccaatgggaggcaagtggcttttgtgtgaatggcgacgttggatttggcatttcctctacaaccactctagaagtctcccaacctttctttattgaaattgcctcacccttttcggttgttcaaaatgaacaatttgatttgattgtcaatgccttcagctacctgaatacatgtgtagagatttctgttcaagtggaggagtctcagaattatgaagcaaatattaatacctggaaaatcaatggcagtgaggttattcaagctggagggaggaaaacaaacatctggactattatacctaagaaattgggtaaagtgaatatcactgtagttgctgagtccaaacaaagcagtgcttgcccaaatgaaggaatggagcagcaaaagctaaactggaaagacactgtggtcaaaagcttcttagtagagcctgaaggtattgaaaaggaaaggacccagagtttccttatctgtacagaaggtgccaaagcctccaagcagggagttttggacttgccaaatgatgtagtagaagggtcagccagaggctttttcactgttgtgggggatattctaggacttgccatgcagaatctggttgttctccaaatgccctatggaggtggagagcagaatgctgccctactagcatctgatacttatgttctggactatctgaaatctactgagcaactgacagaggaagttcaatctaaggctttctttctcttatctaatggcattcacatctctcctgaagttcagccatgaatttcagattaagaaccactgttctaagtaaagccgtggcctagtattctgtttctctctaaacaataagtgagtaaacattttcaacttaagtgtggctcaccctagccacctcccaatccatagattagatttccaaaatctattcctgaactaagatgctaggaattgtcagggtcattagtataccctgaaaattatcttcagaaatgtaagcctctattttaggcattagaaaaaaaaaactcttaggcctatgataaatttggatgctttgcc

SEQ ID NO: 468890 - DNA, 1117 bp, Homo sapiens
tgcagcaaaccaccataacacatgtatacctatattaaattgcttaatccagacaactctccaatcccaaatgaagttgttcagttgcatctgaaggacaaaatcgtgggaaactacaccacagatgtaaatggcatcgctcagtttttcttggacacatatacgtttacatacccaaatatcactttgaaagcagcctacaaggccaatgaaaattgccaggctcatggctgggtgttgcctcaataccctcagcccgagtactttgcatatcgattttactccaagatgaatagcttcctaaagattgtccaagagatggaagaactgagatgcaaccagcagaagagggtgctagtgcactgcattctcaatatggaagactttgaagacaaaacctacacagcagacttcaattatttggtcaacttaaatttttctaaagaaaaaagtttaccaggatccaatgtcgatcttcaagtctcggctgcttcaaactctctttatgctctttgggcggtagaccagagggtattgctactaaggaattatggtcagctgccagcacaaactgtgtatagtcagctacattccagcgaactacatggctattatttcagaggacttaacttagaagatggccttaaagtgccgtgtcttgaagatggacatatcctttacaatggaatttattacacacctgcatgggctgactttggaaaagatggctatgaccttgtgaagaattcttagagtacaaatttacaattagtactaatgtctgagaaataatatctcaaataatgttataatagcaaaaagacttaataaagttcttatagttataattatataatagttataatattataaagctataatagttattctatatagttacaataaattatagttataatatatttttaaaagttgtattaatataattttatttaaaagttataaagttataattataaagttataaggttattataatgttataataaggttaagttataaggttattagaacttcattataaaactataataatattttaaataactaataatattataatattaggaaaagaactaatatgtgagggaattat

SEQ ID NO: 468891 - DNA, 524 bp, Homo sapiens
ctctattcctccttgtggcccgaggctatggacaaatctacgcaaagatgacacttagcatccaagaattgcagaagattagccacggagggagtgcaggtgggaaagacgacccaggcctgagcccagatggaggggcctggcagaagcagaggagcagttgccaccagggcagctctgcagaaccatctgaacttgacaaaaccccagaggcagcagaaggagaatgggaaggggctcagtcaagatacagccttcaggggaggcatctcttaagaagtcttcatagcatttctcctttccaatcagacctctgcggcaaacatcctccaccagatcctcggccaggccaagaagcttccaagcttgatcctcctcttaatatttattggagctggaggtcctggagcagcactgtatgtcttgcatctggcactgttcgatcagatgttagtaggggcagaaagaataacccaaaaaccctgagacaaactgggtgccaatgatcagtacaagttcaactc

SEQ ID NO: 468892 - DNA, 1069 bp, Homo sapiens
gctgtgaaccctcttcccacattagccggctctcacactgtgactaaagagaccagccaccacatggtcccggttacaggggcagctggggccttgccatctggcaggacctgctgccactggcgctcgctgtctgtgagcacagggtctggtgggcaggaggtgactggagggcatgtcttcccaaaggagagctcgccaggccactcctcagaggccccagcccacaccaccagctgcctctgctcctcccaactgtgcacctcgtgccatcgagggagggctgggacccagctccagggctgcggctggcagagaaggacctggcctcctgcccactgggacagagagacaggccctgttgctaacacttacacccagcagttccgatggacaagctgtaaggacagcctcgccccaggtgccaggcaccagagaacttacaactgacagccaaggccagctggtaagcccttggttcccagcgagagagcctgtgagcacagtggagcctcaggacagcacgatcagagctggcttctcaaaggcggtgcccttgagctcagtcacctctcgcccctttgccgcccattgctggcacctggcttgggctctccgtctgcccaacagctcacttcagaggaaacaggaaaccaacggggccttcgctgccctcctcagccaaacccatgcaaggccagcccatggaaagggagccagggagggtgagagtggaggggcagaggcctggctgcttctcctgctgtgatctgggcacacactaagctgcttagccaacagctctatctcctgggctcagggctcagccatgtgaggaggaagggatcagtacagccctgaggaagagtgaggacctcaagtcagccagagctggtgccccacaaactgctgtggaacgcgagcaacttacttaactactctgagcccccttatgtgcaaaataggaacaacaaacaggagctcccacctcctggggttgtatcggaaattcagtgaggtggtaaagcaccccgctccacgcctggcctatgagagatgctccacaaac

SEQ ID NO: 468893 - DNA, 772 bp, Homo sapiens
cagaagggccatcccagatccagagctctccatggacccactgaggctcagctcgacttttctatctgccaaattctttgtctttcaacacttacagggtcgtgacaaggagggtgaagaagaaggcgataagcaaggagctgagtggggctctgcattaggaaggaccctcttacaaagcaagagaggtgttagacagccagcttcctgctgccttcagtgtatggggatgctgagcttatccctggtctcctggggaggaaaagccaggatctttgggtccagttccctgccttcccacggtcagccctcagaggatgaggccctctgtaaagcgtactcgacgggaagactcggtctgacaggcacacttttggatgccacactggactttagtgacctaacaatacagcccagtatcactggcatcatcctcttccccccttctctccgggatgggagctctgcatactcagccctttagtagtgtcccctgtggtcattactgccccctgctgagtcccctcgggtgtgtggccgtgtgtacctgcctcccctgtgtcatcctcacctgattctcatggggccctggaaggaagtgatgactgtttcattttatagctccacagcagatgacacccaaggttgttttgggcatggcccaggccctggacatgccttctgtccaatgcctggagccctgggatgccacccagtctgtcccctgtcccctcctccatccaccagtgagcacggctcccattctgcagat

SEQ ID NO: 468894 - DNA, 653 bp, Homo sapiens
tggtgttccatacttcttcccacagactctgtgaacatctaatggctaccatattgaacagcaaagacatacagaacttgcctaccattgtagaaagttcaactggacagtgctacaacatctgtgggatagaagaaaaggtgagtttagttgcaaataagcaagtaagcaacactgacttcctccaccctgtcagacaactgaatgatgagaggccacaagagaaggagagcttccatgtgaagaagtggccaccaacactaacatccagatccaagagggatgccaccttggatgttctagccccacacggacctccagctggattcagcctggaagatggtgaacatttgaagcccatccatgtaagcagcatcttcttatcagatggcttctggaagcatgctgactggcttcaagttcttccccgtgttccagagcaaccatattaagcataaaatctattcaagtttgagtccaaagagtggatcctcttgcttatttgaatttatacaggattgcagtctcataactgaaaggagccctgcagggtacctacgcttgatatttcaacagtcagagggcagccaacaaagggactggtcttggaatgttgtgttgcctctgcccaaaacactctcccttttcctgtt

SEQ ID NO: 468895 - DNA, 656 bp, Homo sapiens
tgtttggggtgatggctttgctgggcgccctctccccagccatccctggatgcttgtacctgctctgctgcccaggggctggccctcccgccctgttggtgccccgggcgggcagggggagtcagtgctgccgcagtagcctctcctgctggcctgttgtggctcgggggcatctgccgaggctgagtgagagcccaggctccagggccaccctcaccttttccgggtattatcgggggacccacggggtcattgtggtttacgacgtcaccagtgccgagtcctttgtcaacgtcaagcggtggcttcacgaaatcaaccagaactgtgatgatgtggctgcgctgactctgccttcgtttgaagtgggtaataagaatgacgaccctgagcggaaggtggtggagacggaagatgcctacaaattcgccgggcagatgggcatccagttgttcgagaccagcgccaaggagaatgtcaacgtggaagagggaaactgaggctccaagtgttgaagtaactcaaggaccaccacctggctagtaagagactgagtaaacctctgtcccacaccaaagccaagcacagtttccactccagtcctctgcctcattggccgccttgtgctgtgtggagcccagaggcctgtggaagtc

SEQ ID NO: 468896 - DNA, 502 bp, Homo sapiens
gttctcagaacctgcctcatgggattgccgtgaggtttaaatgagaaggctccaggaggaagcagaggaggcggcgaggccagtggggtgctggtgttgggcacagcgccgtgaaggacccaacccgggactcgggctctccttgagctcagcaggaagcctcacggcggagcaaggaggaagtggccctgagcatgagccctgcaggcccaggctgagcagcgtctgcctgcccaggagagcctcaccctggcctgtctttaggaaagggatttgggagcagcttgtcttacacaaggacgaaggaaaaggtcagggatcgagtggaagagatgttcttggtgtgggcaagagcagtttactgttgcgttttgcagacaacactttctcaggcaaaaagggctaacttgtttacatttgtatttccctaatcactgcatccctggcctccacccactaaatgccagcaacacttccctccccctgctgtgacaaccaaaaa

SEQ ID NO: 468897 - DNA, 7224 bp, Homo sapiens
ctgcctcaatgcttttttgaggccaaatggggtcagtaagctttatgggttctctcgggagagatcaccgtgtgctggaacggccaggaaaggctttccgaggagccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgacccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaataaggaaaggtttgtacctgtttttttaccaaagaaatgaaggaatttatgccgattgctttccagatgacacatg

SEQ ID NO: 468898 - DNA, 1686 bp, Homo sapiens
tggaatgcctactggtattgagcagcaggtccttgaaaccctcatgaaccgggtcgtccccaggaatgtttattgccagattttttcacaagtttcagggtgtatagcgctggatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagggccacttaactgccctgtctcatactcagctgggcatcttacagatgtctgcagggcctagtcccagcgactgggtggattccatcagcagagcacaggccctgctcactgtggggcaacccaggaagcagggctattccagatcactggtgccattagccaatcatttcgaagtactgacggtgaaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcagctcctgccctatttcaagacctgcatcctttcacaccctggctatggtcaccacttcccaatttatctgccttcccccagcccgcccaccctcacacgctttggattgatcttcctgaagcgtgacttgaaagtgggacgccccttacaagttctggctggggcacaaggacctgagaaggtggtggtgccctttgctgaagcatgggccacagaaaaggtgacactgctgagtgtggagatgactgccctaaaagaggagagagaccgactcagagtcacttctgaggacaaggagccaaaggagcagcttcagaaggccatcagggaccgcgacgaggccattgcaaagtgagtagggatggcttcactttattcttaagataaagttgagtatatagaattgagcatatgctcaattttttaaattaaatcatacaaaagaatacaaaggtaaaagttagtttccccgctacccacccccacccccacccccacccccattcccattctcctccccagacacatgctggtattgaaagttagctgtgcattttttgcagctctttttcttatgcatatgtagaacctcatgtcatggtgtctgtcagtttctagttcattttagaaattattcttggtgaatcccacataacgatgtatctttgctgcttggatttccactatatttagttaatggatacttaagtaacagtgtgata

SEQ ID NO: 468899 - DNA, 924 bp, Homo sapiens
ggtagacctgaagccaaagaagaagtgctggtcgcagcagtggcctgagcactttgcaagtgggatccacctgttcctttttctggccgcacttcggttagtgcggtcggtgttgtgaagctcgagctaggcggcctctgcaggcggatcctctagctgcccttgagccctgcacattagcaacatcatagttattgttgcagctgctatttgttgtgagttcagggtcagagcctgtttcctcatcctgggactccaggtgccccaagtaaagaccaagatgcctctggcacaaggtgtccatgttcaccctggcttgtctgttctcaggaagaatgctgtggagctggaacttgccaagtgcaggatggatatgatgtctctgaacagccagttgctggatgccattcagcagaaactgaacctctcgcagcagctggaagcttggcagcattcctacattggatttagcgtagattttactgagcacgtcatggaggggcccagccagcccaacttcatgccctcatctcgtcagtggctgctcggaaccaaagaggtcatctgccctggccacagggagcctgccctgaacacaggcctcacctgtcctgatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttc

SEQ ID NO: 468900 - DNA, 2795 bp, Homo sapiens
ccattttctggaagaacagacccaggaactcaactacttgggtgttgaagaacaggccttgagtcagatggacctggattcaaatccctgttccctcctcttactgtttgagggactttggacatgttacctgacttctctgaacttgagcttcctgatctgtaaaatagagacagtaacacctcgaagggttgttgtaaggagtctggactatggcaagtaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccaacccttagtggacagactccacaaaccctctgatgagacgattgatgtggccagggtccagttagcatcagtagaaggatgtcactaggaaaggcccaggtatctggtgccttacgtgtggctctgtcccttacgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagtacgtctccctcgtcctgtctcctgattgttgggcccgttgtgttgctgaggggagcaggggcgaatgggggctccaggtttctcttactttggctattatgtggcccttctgtaagtagttgaactagagtatagctggcttctagggtgattgaggaattgtactggactttaggcttaatatttttgctttatattttcccagggtgagtggctttgtaaattgaaagttt

SEQ ID NO: 468901 - DNA, 1631 bp, Homo sapiens
cgtgttgcagttttgcttatgtagtttgatgatctgctttgacaccccaggcctctgagctttctttaggtcatgagtatgtcccttctccttgcttcacgttctcctcaaatgaagcctggcaactgtgtccctggccaaatgatcaagagggatgtgggacaggacagggctgaggacgaagcccgggcccatcccttcaaggtggtccgcctggagagaggctctctggtgagacagagcaactggtgtcgggatcccggggctggatcgcttgtcttcagacatttggttgaatgcagtgaccatcgtgctgtccccctccgtctctgtcctgtggacacccacttcctgtctcccattcctcacaagcgcaggcctgctgcccactgcctggcggcttccccactcccagtctctcaagtcttgcttcctctgcctaactggttcccattcctgtcatctttggatctggaaatctaccgcacgctaaagtgctcctccgtaagtgctgcagttagaatcttcacagcctccctgcaggatgtttgtatcaagcacctgctaaccactggctccgtgcgtgatacaggatccccagcccaagcctctgctatttacagcaaggcccagagttacggagagaaggctgtggattctactcttgaacgcactgtggcatccctgcgtgaccttgtgtgggaatggctgccacaccccctccccacaagccaagcatgctaaagcaagccctgcagagaccgcaggagtagggggtcaggatgtctggttttgttcactggggggcccagtgcctcaagcttcactgaaacatgactgattgcctctaacggacaggaaagggctctggatttcaagggaaaggctgaggaggaaacagatgatggctggagcgggaagaattttgtgatgggagagtctctgcgcatgagacagttggaatctgaacctgcagaaatttgagtttagagttttgcagatagaaagcaccctatacattgcagggaataggaataatttctggattaaaaagtcttacctggtttatcccttccaataagaggaagaagcttgagttggatgactcgatctgcagtgcttcagctgacacgtgttagcagccattgtcctagaaatgatttcactgttggaaactgctgaagaaatgtgattcggtgaagtgggggaggctgtcctggccactgtgcactgaagaccagaaagagaccgagatggcttccttctgagcctgtaccgctgacatagctctgtagagaagggggttgtataaatgatgtccctaaggcatgtactcccatgtatagacacgagtgctgcattcccaggctctgacgtaaacgctaggctttacaaaacagaaacgtacacacaacatgggatctggtgagcagtaacgtgagagctgctaagcagacacagcaggttctatttttaacacttgattggcaaaatggaactcccttcccctccaccctcacagagaacgagtacttttgtttttcttgtgggtgacctaacttacctgtttacccaaggcctgtgagcctgctacaaaagtaattcagacagtagcttagtcccaagccacc

SEQ ID NO: 468902 - DNA, 1024 bp, Homo sapiens
attggtacagaagacaaggagagaaaggacagccaagattggtggggttgacatgaagaagaggatggtcctttccctgcctcgtgcctccaaagcagacctgtccctgaataccagtcggtgtctacttgttactgaaacacaagggattcacgcccccctcatcactctccttctaggctctgactcaaaagttctggagcgaggccaagaagttgcgtttcttaccaacccccaggtgatgctgatgctgtggcccatggaccacacttcctgtagcattgctgagatagacagctttccaatgtctgtcccattcatgaactcctgttctgagaccctcctgttcttattccaaaataataagtccctgtggcaaggtatgtactactccatgacccctgccctcagccataggcaattagaccataggagaaggcctgacccaagctggaccaatcggattttctctcttgggaatttggaattcagattcagcaatgctagtcaatctctgctggtttcatgaactgagttgtataggtacggagctgtggcacgcccattctctgccatgtgcctgaaaagcagaaagccaagctgcaggatggtgagtgagaagaaacagacttaccaagagaatgggagatgagggagagtaataataacagccaacattcactgagcagttattatgtgccaggtaattctaaaaaatattttagtattaattttttaaataaaatttattttggaataattttagatttacagcaaattataaagatagtatagagaatgcctgtatgtgtttcatccagtttctcctaatgttaacatctcagataactatagtacatttgtcaaaactaagaaattaacactggtactttgctattaactaaatttcagactttatttggatctcaccagtttttacactaagctaatgtgctgattttctatctctgtgttacatttgggtaattctcatgtgtgttctgatggctccataaaccagctg

SEQ ID NO: 468903 - DNA, 1135 bp, Homo sapiens
cctccagcaaactccagcagaccagcagaagagaggcctgactgttagaaggaaaactaacaaacagaaagcaatagcatcaacatcaatgaaaaggatgcccatgcaaaaatcccatctgaaggttgccaacatcaaagactaaaggtagataaatccacgaagatgaaaaaaaccagcacaaaaaaaactgaaaattccaaaacccagaatgccgcttctcctccaaaggatcacaactccttggcaacaagggcacaaaaccagacagagaatgagtttgatgaattaactgaagtaggcttcacaaggtgggtaataacaaactcctccaagctaaaggagcatgttctaacccaatgcaagcaagctaagaaccttgataaaaggttacaggaactgctaactagaataaccagtttagagaagaacagaaataaactgatggagctgaaaaacacagcacaagaacttcgtgaagcatacacaagtatcaatagccaaatcaatcaagcagaagaaaggatatcagatattgaagatcaacttaatgacataaaacatgaagacaagattggagaaaaaagcatgaaaaggaacaaacaaagcctccaaggaatgtgtgactatgtgaaaagaccaaacctatgtttgattggtgtacctgaaaatgatggaaagaatggaaccaagttggaaaacacatttcaggatataaaccagaagaacttacccaacctagcaaggcaggccaacattcaaattcaggaaatacagagaacaccacaaagatactcctcgagaagagcaacccccagacacataattgtcagattcaccaaggttgaaatgaaggaaaaaatgttaaagacagccagagagaaagatcaggttacccacaaggcaagcccattagactaacagcggatctctctgcagaaaccctacaagccagaagagagtgggggccaatattcaacatttttgaagaacagaattttcaactcagaatttcatttccagccaagcaaattcttcataagtgaaggagaaataaaatcttttacagataagcaaatgctgagagattttgtcaccacaaggcctgccttacaagagctcctagggaagcact

SEQ ID NO: 468904 - DNA, 878 bp, Homo sapiens
gacggtgagacaaatctgacgggagcaggctggggcacccagcaatggcacatgtagaccagttccaggtccccaaactggccctggctgtccatcttctcaccaaggagaaactggctgtcagcactctcctcctgcaccagacctgtgatcgggtagagcacaattccagttcctacagcttgggtgctttccatacttgttctggctgtggaggctcctactcagctccagagcaggcctgggaaaatgcctacaactttgtctggtgtccttccctttcagtgtctccaagcttctctccaagttggcgccaaggctttggaggaacaaagtgctctcccttagcctggttgcatggatccccagtggaaagaaggccacactacaaggcagtttgtgatcaacattatgggaatgacccagctaagagttatcggagttctctaaagaaagaaatccctggttcctgtgggaaatacgggatgagaaaattccttggaggagaaattggattcactgtttctaaaaagaaaataggtgtagtaacccagtcctctggaaaagttcagctacatccagcatcccatgttttggactcaacacaagaagatgaaaaggccattcatgtggatttctatcagctcagatatttgcaggcacaatgaatttccagagcacatcatgtttaaggggaagcttaaaataattgcaccaaaagcattgtccaagggagctccttttcttgtagccagttccgaaaaaatgtttttcttttttgcttaagttctattctgtttaagaatcttttctctaccattaaatttagccaaattgtacccttttgtctgtgagtctttgatgttaatagcaaagaa

SEQ ID NO: 468905 - DNA, 647 bp, Homo sapiens
gcggcttgtcctgctacactatatttgtattatatattatttatgacaatttatatatatgagaatttatgttataatttcatcttgagatatgtgcccatgacacagcctgaggaagtcctgacgaacatgtgtccaaggtggacagggtacagcttggttttacacgttttagggagacaggaaacatcagtcaatatatgtaagaagtacactggttccctccagaaagtcagggacaactcaaagcagggagggggcttccaggtcacaggtagagttttaggcccctctccccatcactgctgcagcattgctgggggactgggaagaaaaacaaaaagaaagagagaagaagaagaggaggaagaggaagaggaggaggaagaagatgaagaggaggaaggaagaaagaaggaggaaaaggagggaggagaaaggaagaggaaagaaaaacaaaacacagagatttccccttctctctgagcattagaaattcttattcttgctgtttaagcagagctaaaagtcttcttgcactctttctgtttatgcccttccaggcttatttgagttcaagggatatcggggttaaatgggaaacttattgcttatttagtggccctttgaattcttgtcttttcaga

SEQ ID NO: 468906 - DNA, 545 bp, Homo sapiens
tggacatcaccagtgccaggacaggagcggagaggtggtggcttgttgcaattatgaacaaagaaaagggaacaatatgtgcaaagcctttgagtacggagagtatctttggaatgttcaagaaaaagcatggaatcccccctatgtctggagcagagtcaacaaaggggagagtaatcagagatgtggtcagaaagataagacaggtcttttgtattacatttggaactggacaactacactggtccaattcaggcaaatggatagagttcacagcaccaaaccaggtaggagtcaagccacagactgtctgtctttactcagagataagtggccattatcatccttgtgcctctttgtactttactttgaccaaatgatccctttggctttcgacttacctggaatctgctgcttaaactggctagcctttattggcattcaggatctgtgggtggaaattggttgctggtatttctgagatgtgaaaatccttacccacctactttggttgaagtggttctagattgcaaagtattgaatac

SEQ ID NO: 468907 - DNA, 692 bp, Homo sapiens
tccagcagctgcctctgcaatgtccccaggttcgctggggagagaaagcccaccagtgggcacaggggcagattttggaggaaggggttggcaacatggaaggtgctctttccaccaaaatattagggcctagagaacgcctctattcttacaagagacacacacaaaacaacaatcatacagcattcggagaggaagcgaatgctggaactacacggtataatggaagaaagaaaccaggctcagccaaagcaagactaagcaaaaagaacaaatctggaggcatcacactacctgatctcaaacttcactataaggccacagtcaccgaaacagcatggtactggaacaaaaataggcacatagaccaacggaacagaatagagaacccagaaataaacccaaatacttacagccaacggctccttgacaaagcaaacaaaaacacaaagtggggaaaagacactcttttcaacaaatggtgctgggataattggctagccacatataggagaatgaaactggctcctcatctctcaccttgtacaaaaatcaactcaaggtggattaaggacttaaacctaagacctgaaactataaaaattctagaagataacgttggaaaaacccttctatacattggcttaggcaaggattttatgacaaaaccacaaaagcaaatgcaataaaaa

SEQ ID NO: 468908 - DNA, 687 bp, Homo sapiens
tctgatggttttaaaggggcagttcccctgcacatgctctcttgcctgctgccatgtaagatgtccctttgctccttttttgccttctgccataattgtgagacctatctatgcaagggcagaaataaaacaatgctacaagtcttgagtaaaaaacaagaattcagtggaagctgcaagttaccatggaactcgccattacctgaccagaattcccagaaatatagggagttaaggcctggctatttgaaaagcatcacagtgcatctcacagtgcgtgtgcgggagtggagatgcctggaacagaattccgataggactggattacggatggctaaaagaagaagatcccacgagtggaaaaatactgaaaagtgtcgtagtgtaggtgaagaaactcaagtgaaattactcagagcagatcacaaatattttagaccatataatgcactcagcattgttcctagagcatcataaacactcaatatgaataaagtgacaaatactttgaaggctgaaaccatagccttgtttctctgtattcaccataataattagaataatgttgaatatatagtaggtcttaaataaatgtttattgactaaatcataggtatttaataattactggctgtttcactgtcttccctctgtgtgatcagaaaagcacatatatattactttatt

SEQ ID NO: 468909 - DNA, 991 bp, Homo sapiens
tctgaggtttgtcgctgggctgtgcaaacaaatgatcgacatcttgtgggaatggcaggacctggaaaggctttcagcaaagaaaaaatattataggattattatttttctctcaaaggtgtcaaacattctagaagaagaccaccagaaaacagcctggtataatactcctaagactgctgactttgaattccattttgagcttgcaagccttttaaaaaaccttatttccttaaaaggaacaagaagccctgtttttgtccctcacagaggaatttgtgcaggaaacaaggaggtaacgggcaagaggcagagtgggaataagataaaacatgaacaaatgaaggttgtccatgtggagaaggacggacatgaacaaatgaaggttgtccatgtggagaaggacggacatgaacgaatgaaggttgtccatgtggagaaggacggacatgaacaaatgaaggttgtccatgtggagaaggacggatatgaacaaatgaaggttgtccatgtggagaaggacgggagagaaaattcccgggctggctgctagagaagccacaccaaagcctttcttctctacttcctgaggaaaactgacttacgccttctgtgataggataatactttggatttacatagaaaaaaaacacccattccacaaaatattgacaattagacgaactaaatattttctcaaaaatttttatgtataaacatttctcttaaatttacaatataaaccttataaaagcaagaactgtgtttcactcaccactgcattcccaatgcataggacacctttgtcattcttgtgtcatattttataaattcttgtgaatagtaaattctgcaaatactgcccagatttagttcaattccacttaataaacaatttattagctatgaggtaggtacagtaatcatgttagcataagacccagttttataattaaggattttgcatccagagagataaaaagtaggtatg

SEQ ID NO: 468910 - DNA, 645 bp, Homo sapiens
ctgtctgaatacatgacttctcatccgcagtctgactagccatggagcaagggaaattgcgaggcagagtggaactctcagcactgcatttatcagcatcaggaacaattcacttcagaaggaaatttccagacacacattccttagttgtgaagtatttgaattatagcaatgtcgtctggtgcatgcaacaggaatccttgaagtccatgctgacagcacctactatggaaaccattcagtgccattatcgtcactaccctccatactctggacccagcaaacaagcaagacctatgtgtgttgaattggtgttacttatacacttacatgtggtcaaagattttcaggagctagatgaaattgctgctgatttgttatatcaccaaagcgaattatgcccaagcccttattttgcttctgagtccagtccacatttccagcatcagcaatacatccccgggttcttccacctcacagcctaacaatccctgttctgtaaagcccaaaaacatgagaaagtaagaacttgatatcaaacttcaattccaatgtcacttcctccaggaaaattttctgacccctctcactctctaaatctaatacctgctgtttaaaattataaatgttggcatttataaaact

SEQ ID NO: 468911 - DNA, 556 bp, Homo sapiens
tcccagacgaaaacctgtgactcagagggagaactgccctatttgcctgccctttcctgatcgattatttctggataatgccttttttcaatcaaatgttgccttttctgatactaccaacggcttccctgggcatgcccatatgcacactgaggggaacagggcagagctgccaggaatctgcaccttatgctggggaggagtctagctttttcagctcctgtgtggaagtcttgggactccactgggaggatgagcacccctgggctctggcccagtggcagcttccaggggtgggtgtctgtgactcccaaagcccaagtgggcatgtattatggtgtgctcttttagccttgccatctacagatggcttaagtattagacagctcagtggaccttctgcctttttgcaagggcagagggccagtgtaacagctctctatatcccaggctcttgtccagcatccaggaaaagtctgattacacatgggcttgagggatgaatgtgggggttttattgagtggtggaggtggctctcagcaggatggatgggaa

SEQ ID NO: 468912 - DNA, 771 bp, Homo sapiens
ttaaggggcatatggtctgtgtcactaggttatctaggtttgctacttggtgcttatctggaggagaaacaaacttcttacatctttatgacaggggaagttgtgcaagctggggcaaggggctgcagatgttatgcccttaccttcacactgagaggaagagttatcttcctaatgatcttgtttgtgacctgaagattgaaaagggacctaaggcactgctgaccctgggactaagcctccacattaagcttcctggcattctttctgagtttggcctgctggagctggccgatcctgtgtgcatttctgatcaaccatcaatatttcaaggccaagaatttggagatagagttactatcagccagactgatagtagctggagacaatgaaaggcaaagcagcattgaaatatcactagtaaatctgtaagctttatcagaaaaaacaaagggtggagtccatagacatacctagttactgaaaatcaaatatcataaggaaaatgtcagtggacatatagccccagaaactgtgctgaaaacagccatcatttgaaaatagagaatatgtcttttataagatcttcctagcataagaggaaaagaggacaatatgtttggaaattatcactctctgtatcaagctctccctgttggctcatgggttgaagtattaaagccttcataagcttgaatatcctctgtttgtagttacttctacttcagggagattttatggaacgtaatcaagccaaaactgtcagaagct

SEQ ID NO: 468913 - DNA, 664 bp, Homo sapiens
aacgtccagcaacattcctgtttctctctctctctctctctctctcttttcatggcctcttctggcagaccagaatctgctgctttgagagacaatttcagtatctgtccatacaggctcatggttctgcaagctgagaactccaaaggcatggccctggcttctggtaagggctttcacgttggatcacaacatggtgaagaaggtcaaaagcctaaggacttggtgccctttgtccaagctgctccagccatggctgaaagggaccaacgtagagcttgggctgtggctttagagggtgcaagccccaagccttggcagcttccacatgatgttgagtctgtgagtgcacagaagtcaagaattggggtttgggaacctctgcctagatttcagaagatgtatggaaatgcctggatgctcaggcaaaagtttgctgcaggggcagggcactcatggagaacctctgctatggcagcgcagaagggaaatgtggggtcagagcccccacagagagtccctactgagaagactgccagtgagggcttcctggaatgcggaaaatgtttctggagaaatgagactggagaaaagcgggtccttgttgtgtagtggtaaaaagtataacaacactgtcacctgagtcaaagaaaggggtgacaga

SEQ ID NO: 468914 - DNA, 595 bp, Homo sapiens
aaaagttgaaggaaaaaaagccattgttaatgaggcagatgactctagaggcaacattttgcaaaaccatccaacagaatgcctcctcatccctaaaggacccagttcctggtccctcaattgcttttcatgtttcttctcacctgaaaacaaaaaatacagtggacagttacctttccatcaaaacacagcatggtagagacggaaagcctgccgttgtctgttgctgtctaacagctgagacagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgatctggctgccacccagggacccccaggcttcaacatctgcctcctgcctcttccccccacccctgaccctaccactaccaccacccgttttattcccatgctttccaccgggtcctagggatcatcttcgagcagaaagcaaattccacagtggcaaaacaggaaatgatgagggggtgggggaaatgtacctgcagaatctcctca

SEQ ID NO: 468915 - DNA, 1470 bp, Homo sapiens
aataggaacagctccagtctacagctcccagcgtgagcgacgcagaagatgggtgatttctgcatttccatctgaggtgccaggttcatctcactagggagtgccagacagtgggtgcaggacagtgggtgcagtacactgtgcatgaaccaaagcagggggaggcactgcctcacttgggaagtgcaaggggtcagggagttccctttcctagtcaaagaaaggggtgacagatggcacctggaaaatcaggtcactcccaccctaatacggcgcttttccaacaggcgtaaaaaacggcacaccaggagattatatcctgcacatggctcagaggctcctacgcccacagagtctcactgattgctagcacagcagtctgagatcaaactgcaaggttgcagcaaggctgggggaggggcgcctgccattgaccaggcttgattaggtaaacaaagcagccaggaagctcgaactgggtggagcccaccacagctcaaggaggcctgcctgcctctgtagggtctgcctctgggggcagggcacagacaaacaaaaagacagcagtaacctctgcagacttaaatgtccctgtctgacagctttgaagagagtagtggttctcccagcatgcagctggagacctgggaatgggcagactgcctcctcaagtgggtccctgacccccgagcaccctaactgggagacatcccccagtagaggcagactgacacctcacacggctggggactcctctgagacaaaacttccagagaaatgatcgggcagcagcatttacgggtcaccaaaatctgctgttctacagccaccgctgctctgcagccaccgctgctgacacccaggcaaacagggtctggagtggacctctagcaaagtccaacagacctgcagctgagggtcctgactgttacaaggaaaactaacaaacggaaaggatatccacaccaaaaacccatctgtacatcaccatcatcaaagaccaaaagtagataaaaccacaaatatggggaagaaacagagcagaaaaaccagaaactctaaaaagcagagtgcctctcctcctccaaaggaacgcagctcatcactagcaacggaacaaagctggatggagaatgactttgatgagttgagaggagaaggcttcagacgatcaaactactctgagctacaggaggaaattcaaaccaatggcaaagaagttagaaactttgaaagaaaaatagacgaatggctaactagaataactaatgcagagaagtccttgaagaagctgatggagccagagagaaaggtcgggttacccacaaagggaagcacatcagacaaacagcgaatctctcagcagaaactctacaagccagaagagagtgggggccaatattcaacattcttaaagaaaagaatttacaacccagaatctcatatccagccaaactaagcttcacaagc

SEQ ID NO: 468916 - DNA, 892 bp, Homo sapiens
gaacatcagaaggaacaaactccggacatgctgcctttaactgtagcactcaccgcaagggtctgtggcttcattcttgaagtcagtgagaccaagaacccaccaattccaaacacagtgggaggtggcactttcaagagagcatcagctgtggtagtatggggagaaacaggtggtggccaggaccctagaactcctaagagtgtatgccctttgtcttcagctaccaggatgggtagggaaggaccattaggtgggagggcagggctaggcatgtctgagcttagactctcctctggtgggtcttgctgcagctgctgtgggggatacaggtgtggttcccaggtcaatggagttatgttcctaggaggattgtgggcacctctactgtgtcatgcaggttgtcagggaagtgggggaaagccaacagtaataggtctcacccagcttccatgcaacccaaagggccagtctcactcccattgtgtcccttccaacagcaccaagtctgtttccaggcagtgggtgagcagggctgagaacttgccccaggctacccaccccccagctgcgaaagcaagtagggctttcatgcttcccttgcctgtggagtctgcacaccagattcacaccctcccctgaattctggccaggaaacttctagatttgttcaaattgttacaaagttcagctggaggtttccttctccctgtggcctttccctagtgcctctggccaccctccccaagcacctccatgaggcaaggcagaaatggcttgctaggggacatagtgagcccatagggcttttcctgctgtttcctctacccctgtattttgcttagctctctaaatggacttagctccagatgctgttatggatgaaatgttt

SEQ ID NO: 468917 - DNA, 950 bp, Homo sapiens
gccatttgatatcaaatattgctaagatttacacctaccacgggcagcagcagaggagcaaatgcagacctatgtggaggagcgtgtggttggcaagcctttccaagccctgctcattgccatttctctaagagcagcagacttcactcctgaagccagcaagaccacaaacccaccaggaggaacgaacaactccggacgcaccatctttatgaactgtaacacttaccgcgaagcaagaccacgaatccaccagaaggaagaaactccagacacatctgaacatctgaaggaacaaactctggacacatcatctttaagaactgtaacagtcactgcaagcgtccgcggcttcattcttggagtcagcgagaccaagaacccaccagaaggaaccaattccggacacaatgctattcatttctgtttattacatttccttcttacagtcaggcccctctgctgcaggtctgctggagtttgctggaggttcactccagtccctgtttgcctgggtgtatcaccagtggaggctgcagaacagcaaagattgctgcctgttccttcctctggaagcttcatcccaaaggggcacctgccagatgccagccggagctctcctgtatgcggtgtctgtcaacccctactgggaggtgtctcccagtcaggaggcaggggggtcagggaaccacttgatgaggcagtctgtcccttagcagagctcaattgctgtgctttggagacccattgctgtcttcagagctgccaggcaggaacagctgctacccttaatcagttttggcagttgggtcacctctattcatgcttgtcacattattttggtcttgtcttaggctaggttcttgtttccttccctctgtgtttgtctctcatcattgtgctgatccagcacaacttgtacccaagttctgagacagaataaaagaaat

SEQ ID NO: 468918 - DNA, 501 bp, Homo sapiens
accgtaccataattaagtgtgtctcatctgtttggctgctatgtgctcaaaccacttacaggaggaggagcacttagatgggcagttgcaggagccagggcaagtgattttgggctccagccccacagtaacctctaaggacagcttaggtgttaaccagctcagtgccctcttggtacctaggtccttgtccagtgtccaggaagaatcaggtcacacggacaaattaaaggatgataaatgcaggggattttattgccagatggaggtgactgtcagtgggaaggatggggagctggaaaggagatggagtggaaaaatgatcgtcccctggagttcagccatcccacggctcatctcctctctgaccacccccagccgaactcctcttgacattcagacactccttctcctctctccttctgtgccacactgctgttctgctcctctgctcttctgctcgtagaacctggggtttggggtttatatgggtacaggata

SEQ ID NO: 468919 - DNA, 781 bp, Homo sapiens
gtgatgttccctgccctgtgtccatgtattctcattgttcaactcacacttatgaaggtgccctgcccggagaggaggaatctacagaggcagtctggctacagcagctttgcctagctgtggtgggctccacccagttcaaacttcctgacaattttgtttacactgtgagggaaaaactgcctactcaagcctcagtaatggccgacacccctctccccacaaagctccagcatcccaggtcaacttcagactgttgtgctggcagcaagaatttcaagccaatggaaatgcagaaatcatccgccttctgcactgatatcactgggagctatagaccggagctgttcctatttggccatatcttgccagccacctccttctctttgaaatctattttatctaatgccaataactcttagatttgccctttgggggttattttctaatctttccctatgtacaaaattagaatattggtttgtgatctttataattttataatttattcatttaaatctatacatttttctattaagcattgctttcactgcattctgttccacatggacacaggaaggggaacatcacactccggggactgttgtggggtggggggagcggggagggatagcattaggaggtgtgcctaatgctaaatgacgagttaatgggtgcagtacaccaacatggcacatgtatacatatgtaacaaacctgcacattgtgcacatgtaccctaaaacttaaagtataataataataaaaaaaaagaaagtga

SEQ ID NO: 468920 - DNA, 547 bp, Homo sapiens
ccagcactattcaatagctgacaacaatgaatgtccacatcatgctcagtatccctccccaagctccctccaccagattaatacttgacctggatttcatcctgacatctgaaactttttctagcttcttccttataaaactctgtctataccctataccattttttatgagattagtttttgattttgatgagaatagtttttggctaatttatgaattcagaaaacagctcagctggtgctctcctgaaagcagttatccagatttccatgtgctttcctctatattctacacaagtgaggagatcaagaactcaatactatgtgcaaaaatccagcacaatatgggaaggagacgacatgacagtgggaatgagacaacccagcagcaacttacacagaatgataagtgaggaccaggggcaatgaaggactctgattggatgcttccatcatagatgcagggaagacagagagaatcttttaaaatatcaagttcactgtaattatttagtacttccaggccaaagaaaaaaaatgcaaatat

SEQ ID NO: 468921 - DNA, 1593 bp, Homo sapiens
gagttaatgagtgcagcacaccaacatgtcacatgcacacatatgggatctccccttcataaaaccatcagatgtcatgagaattattcgctatcatgagaacagcacagaaaagacacaccccagtgattcaattacttcccccgggtccgtcccacagcaggtgggaattatgggaactagaattcaagatgagattggggtggggacaaagccaaaccatatcagagacttgttgaatggcttcgaccaaaatgctgatagtgatatggacaatagagtcagggctggtgtggtctcagatggagatgaggaacttgttgggaactggagcaaagatgttccagtttatgctttagcaaagagactggtagcattttgccaccaccctaaagctatgtggaactttgaacttgagagggatgatttaggttatctggcagaagacgcacctgaaggaatctcctggtttacgggttgcaaagatcatggaaaaagtgtagtatctgggccagatagcatcgtccctcatggcactgtccctcagggctccccttggctagaggagggagttccctgaccccttgtgctttctggaatgtaaaattccttttgataagctgtgcggtcaacatcatactagggaaaaagtacattctgaatatgtcatattccaacaaaagttcaggaaggacatcagagaatttttcaagagcaataaaattttgcaaaattttgctcttccaatccaggttgcctgtaatggcaaactaaaacttaaatgattattaaaccaataagcaaatattcatctagttttctgtgctttgctgtttgcaagatatcacatacatggactatatggctctaacatgttggttttatccaataactactaacttcatttcttttttaaatagtactgattggcccacccaatcagtaaatgtgtgttcagcttcccaaacttttatcaacttttccaccctaatccctggcttcacccacatcccacaatgtaacaccaatatagagctgttctccaggactatagcaatatagaactgttttatcagtatgtaaatttgttcatcagatattttattagaaaattcataagtcaaactttcagatacttcatgattagtaaaatatttactacaacagattctcaaatattttccactatgatgccttctaaagttctatggcatgactttcaaatatttatactcttctaaaatgttcagttctataaggtatattttagcttgtttcatgactaacaaattgccatgagggatatgctcactaattctttgttaaatttattctttcaatacatggtacaattttcattttgggctagtgaaatatatatatttttaaaaatttctgttctggttaattactgtcatttaaacctttttaaaaagcaagaacaacacaaactgcttctgagacaaggtagctgtatcgtagtctttgaattataaactccgtaaagagagggaccatgtctctcatattcagcattatattcctattcacaaataaaacaaataaaaataatgacaaggaaaaagcatgaat

SEQ ID NO: 468922 - DNA, 473 bp, Homo sapiens
tacttgtgcgcatagctttctcctccatttcgatgagtatggtctccttggcagaaatgcccagtagacctgatgggtggctagacccagaagagagacaacaatcaatgcacttcagcttgcaggaagccacacccataggaaaagggggagtgcactatgtcaagggaacaccccgtgggacaaaagagtctgaacaacagtcttcagccctagacctttcctctgacagaggctactcaaatgagaaggaaccagaaaaccaaccctggttttccaaagttaagacaaaggaaagaatcttaagatgtgagacagaagcactagccaagaattttgtatccacgaaaactaagcatcatacaggaagaaaagatacagtcattttcagacaaacaaatgctgacagaattcaccattaccaaaccagcactgtaaaaactgctaaaaggagctctaaatcttgaagcaag

SEQ ID NO: 468923 - DNA, 1307 bp, Homo sapiens
agcaagatggctaagaacataggctctggaatgagactgcctagtgggaagcactatgattggcaaacatgtgttatctatcaccatcatcaccaccatcaccatcaccatcatcgccatcgctatcatcaacatcatcatcaccatcactatcaccgccatcatcaccatcgctatcaccatcatcatcactatcaccatcatcactacaaccattattaccatcaccatcactaccatcactatcaacatcataccaccatcaccatcatcaccatcactatcaccaccatcatcaccatcaccagtcatcaccatcactatcaccaccatcatcaccatcaccatcaccaccatcatcatcactatcatcatcaccatcattaccatcactgtcaccacatcatcataccaacaccatcatcaacataaccaccatcatcaccatcaccgtaatcatcagcaccatcaccatcatccatcaccatcaccaccatcactatcaccaccaccaccatcatcaccatcaccatcatcatcatcatcaccatgttaagtctccattccagaatcttttccaagactgacagctccctccaaatttatagttgctgaaatcaatcctctgggcagggccaaatagaaagcagggtctgcagaacacacatcccagaggtgataatgacagttaatccctgcagatagttagatctaggagactgtccctgggcttcagggctccctgcctctgaatcagactatttgcagtgcaaatgcaagcctctatgttccccctaaactataggtggctgagcagccatggtgttgccagcatttctataaaggaggagctcaaggcagcaatctcatcagatgtgaggctggggctggccttgaatttagattgtttatttggggcagtttgcaaggagggggtgccatgatgagattatgtgagctaaatcccccacataaaaccattttgtgccactgctcctgtgccaactgaccagaaagactagagtgatttcttccctctctcctttcctggttctgttctctgaccctgggtgattaatgtaacctagctatgttcaattacccatccttttcacgatgttggcatgtctgccacctgtccctggtgctcttcttggtttcctgtgagccgtgacaatgggacgcttcctctctttgcaccatccccggacgcctccctctctccttacctcgccatcctcctcccccgctgcccctgcctctgccccccccccaccacttcgctcacgcgccagcagccatgacca

SEQ ID NO: 468924 - DNA, 684 bp, Homo sapiens
acacaaattcgtaaactttcttaaatcggtatgagattttttttttttttttttgagacagtctcactctgtcacccagaaacaagcggggttgtgtcctcacgcttccggagactggagttgctcctgtgttctcaggagaggcgggagacggcgcagggtctgaaacatgggggacgatgtgcacccgcaacaaactaccaacactggagaggagcccctggatgttatcgggctcagcctagatgaaaatgaccgagagcttcaaggcagatcacatgcttatgatcaacatttaaatatgatcttgggagatgaggaagaaaccgcgactactatagaaattgatgaagaaacatacgaagagatatataaatcaaggaaacagaatattccaatgctctttgtcctgggagatggtcgtgctggttgcccctccattgacagctggatgaaacaatttgtcctgtatggaaaatacgagacttcgtacagtagcctttctaaatgtacaaggcattcaaaagagaaacctgcatacattctgatattaagaaataattctggggattctcccactcctgaaatgaattgatttgcagataattcacaacttcttaagctaaatggcattttaacttttctaaagctcttcaataaatatgaccaccaagatgcagagct

SEQ ID NO: 468925 - DNA, 674 bp, Homo sapiens
ttcagataaaaactgcagttacacacggtcttgcgtggccccaagaaagaaagacggaattcaggagccatgggaagccgctgccatggctccttcccgggacttaccgcctctgaaatgctgctgggattcgggaaacagcagctctctgtattactagctcttggggaagccacctgccatacggcttcacactcaaccctatggagaggcccacatggcaaggaaactgaggctttctgccaacagctatgtgagtggggtatcttggaagtagattgtgcagccccagtcaagccttcagatgaacacagccctgattggcatctgaactgcaaatctgagtatttaccatatgtcaagcaatgctgggcacagggctgtaccaacaaacaagacctggtcctattccctgagggctccctgagggctgacaagctgggatctgcacatgggctaaaattagtaattctgccacctcttctgctgaagctaaatgggagggagagctggatctggtgggatgtgcgcccaacattcccaaaccaaaggcaaaaggacgttcagcaaggtttagcagggaagaaggactgtgctcaggtgcgcatgtaaactgggcaggagagctcttgaaacaggaaaaagacaacttgttcatgttgctcaatgttttt

SEQ ID NO: 468926 - DNA, 602 bp, Homo sapiens
tctcctgcagctagaattccagaagtctatggatcttattaaaatgaagactaattcagcagacctagggtggggatggagactccacatttctaaggagcttccaggcaatggggatgctgtgggttcaagcaccactcttcagatgctgaaacaacttcggaggtgccagtggaagacagcacaagatgaaacagctgctaaagaaacccagattaagaagctgaacagcgagtacacttctcctgaaacaagcaagaaattcggcttccagatattattgtacaatttgagtgttgagaagtacatttatctgtacaatgaagacgccaacgaagattacaaggtagttgatggagaacataatgaaactatcaaggctttttctaaagtggttgtaccattttacactcctaccaataacatggaaattgcattcagcattccaaaaagccaatttacaagcaaatgttgggagcataaatttaagctgaagcattcatagggtttacatcatttctttccctccttttagggatcaatgcactgtattgcttgttgttcaatatctgaaaaccattgttctgcatattttatctgac

SEQ ID NO: 468927 - DNA, 667 bp, Homo sapiens
gaatgtttgatcaagtccctgaagtcctgatctagacatggatctgatcacctttccattgttcccacatattaggcaagctgcatatggcacagacttgaagaagcagctgtatttgcagttacctcaccaaacgaaagatacaaactgttgtggcctttcagggaccttctgtttctcagctgataacactttggccctgggagctgcatcccgcatcacagggcctacatggaggaagtccaagatcaaggcactggcagattcagtgtctgctgaatcctgtgaaggtcccgtcctctctctgggagacccgggattgaacccatcctgttccacatcaaccatctccaaaacaacagcccttggcatcgtgtctcctccagtattctttcaccctcatactgttttctctccccctgatctttcttccttcccattctttatctcaaacatttaacagtgccttctgaaatacccatgctatggtcaacaaatgcctcaatattctttatctcttgattaactcttccctacacctcttggctacattgggagcagaaaaggatgatgtttcggggatagaggacataggagtgcgaaggtcctaggttctaacttggatatatgagtgttcattttcttattcttttaatgtgtacatatt

SEQ ID NO: 468928 - DNA, 1224 bp, Homo sapiens
ttctcctggctttgcgaggctttgtcaaagatcagatgtgacatcacctacagacatgtatgtagaggagtattttatgttcaataatgtgatcaattttagatattttgccagtattttgttgaggtttattgtatttacatttcttagtgatattggcctacaggtttttgttgttgtggtggtggtggtggttgtggtgtctttgttttggaatcaaggtaatgctggcctcacagaatgggttagggagaattccttctcatcaattattttcaaaagtttaagcagaattgatattaatttttctttaaatttttggtttaatttagcagtaaagccatcaggtcttgggcttttctttaatgggaagccttttattatttctatctcattctcattattagtctgttcaggttttctgtttcttcatgattccatcttggttggttgtatcagtctaggaattttccatttcttctagattttccaacttactggcatacagttgctgataatagtatctaatgtcctttgaatttttggtggtatcagttgtaatgtctcctttttcatctttgaatttttttatttgaatcttttttccttattagtttagctaagcatttgacaattttgtttatgttttcaaaaaaccaacttttcattttgttgatactgtgtttttagtcttaatttcatttatttcttctctaatctttatttttttccttctactagttttgggcttagtttgctattgattttataattctctaaggtgcatcattaggttgtttattggaaatcttttgctattttttgatgtagatgtttattgctataaaatatcctcttagaactggttttgctgtatcccattggttttgaaatgtatacatttcttctagatcttctaatctattgttatttagttgttcctagtctcttatgattctttgtatttctgtggtatcagttgtcatgtttcctttatcatctttgattttatttatttgagtcttctctttttcttatttagctattttatcctttatgtctaagatttctacttttatgtgtgtttttatatttttttctttgtcaattttctcattttgttcctggattgtttttcaaatttcatttaatttttttaatctatactcttttgtgcttccctgaactctttaagatttttctgaattctgtcagacatgttac

SEQ ID NO: 468929 - DNA, 615 bp, Homo sapiens
tacaagacagctgctaaatttaacatgcctttactggaacaccagtgcctgctgcacaatagcaggctatctcctgtctgtgtagacacatggagccctgtgataaacagagccaaaccaaaaatcagagcattagaatttcattgcaaaagtgttggatgtgtgaggctattggcgctctgtctgtgctacactgtagttcttctgcaggcctgtcaacaagaatgttatctgaagtcagcagttcaagcgctgcacagagccagggaaagaatatctgctttatatcaacatgctcgcttccgagactttctgtttgacagtatttactcgaaaggagtcaaacttcttacaaagaaattaaaggctccaaaatggaaagttccaaaagctccaagtctgaactgcaagccttgtcttatcatctttgcaatattctcacaatcgtaattaatgattattaattcattttttaatgtctgttgtgatatattgtaaggtccataaaaaaacaagacaatgtttgcagtcattctgctgagcccatgtgtttatcagagtgtcttggacacagcaataaatatttgatgaatgaattaaagaataaatgaatta

SEQ ID NO: 468930 - DNA, 617 bp, Homo sapiens
gtatgccacctctaggggcagggatgaccaataagtttcatccaagatggaccctaaaactcagtggcctacaacaacaggaactcattcttccactcagctcatgtgttctgcttcaggctacagtagtggctcagagccaaatgatgagccttcccatggctacatggctgtgataacaaatagagttatacacctgcgctctaaactcactgagaaaggaaaattccaaattgccaaagcaaattggagatttgtagcagggcctgaacctgaggacttcactggagaggaattcaaattaggccttaacagatggaactgggacttcagtaccagactcaaggaacagtctggaaagagggccctgcagctgtattcttcttcttgtattgatgaatttccaaaagaacttctttgtcaactggaaaatccccctctttcagaaaaagacttacgtgaatcatctgccaagattcagcaatcgagtaacactcccccatgggaaggagtgagtgaggacgtgaacaggccaggaagttgctgccataatgttcagtcaaaaagtcaagaaacactgacctagatgcactagatctcagactccagattttatc

SEQ ID NO: 468931 - DNA, 663 bp, Homo sapiens
ttctgcagtctggggtatgggatgaagggctacacgataggaagtgaacctggacagccatggttaaggtctgtattagtctgttttcatgctgctgatgaagacatacctgagactaggaagaaaataggtttaactggagttacagttccacatggctggggagacttcagaatcatggcaggaggtgaaaggcacttcttacatggtggtggcaagagaagagaggaagatgcaaaagtggaaacccctgataaaaccgtcagatcttgcacattgtttgagaatattaatgtttataataccattaagacactttcaaagccaactgaaatagcaaaacccacagaaaagggaaccggaactaagggaggtagcttttgtgataaaaagctgcattattatttgatggcaaatggtttggaaagccgaagatatgtcacagatttatttcagggcctacagtggtgcatctggagtcagctaatcagtagcctgaaaaaaatgtcaacattggtaaaccagacccaggaatttaggagaatctttgaaaatcagggccttattgaaccagtagcttagtttcacgttgaggaacaggagataaagtttctcccagaaggatagctgtcacgttttcatgtaaaactgagttgctgctac

SEQ ID NO: 468932 - DNA, 605 bp, Homo sapiens
ctcctcaagtgccaccaaagtaggagcccaggcagaggaggcgccgagagcgagcgagggctaacagtatgggggaaaccattcccatgattcagttttctcccactggatccctcccacaacacatggaaattatggaggctacaattcaggatgatatttgggtggggacacagccaaaccatttcaatggtcttccacaaaatggttccctggggccaaaaagaataccacatactgagtactttataattagtaaagatttgttggctatggttctggaggctggtaagtccaagatcaagggaccggtatctagtaaggacgatcttgctatgttatcccatggaggaaggacaaagagaagtcttcccgagaaggagacagaaattagtttggggagaccaactgggtggagtatttttggcacagagtatcacaaaggagatggctacactaagagaaaccagcatagactggaagagagagacttcctcaaatctttggttgtgtgctaatctctgtatagcaaggaaaaactgtcttaaatcaaggaaagaactgccagaagggaatagatcagacaatttatgcagctcacacag

SEQ ID NO: 468933 - DNA, 1163 bp, Homo sapiens
ctctctcccactgtgtctagtttctagttctgatgtgtagcattcctgattttgctgggggttggatatctgacatgcaactcacagaaatgtgtctgcattgttgaatgaatggagccacgcacatatcgggaaagaaatggaacagctcagaggttccaataggtagggaaagagtcgaagccaccagagcccagtggtatgcagcaggccgagatgggatgactccctttgaacaaaaatgtcatgctgacctggcggagaagatgccaggatgtaaactctgcaagtggtatctggcagctgctatcaaaaggacagagtcaatatacaatcagagtgacctgaaaccgccaatcacacaccactgtcttcagggacacgaagctccagcattttcagtatgcaatactgtccttctctgctcatcaaacaagaaatacttgggaatcctggtgtcagtgggtgtcaaggagtactaccggggacgaaaccaaaacccaaaaaccaaaaagctcttccgttgtggatattacattccatgaggaatataatgtattttataatgttctttcaactatataaacaaacaaaataagcaagcagagaaaagaaactgaaaggaaattgtactaataatgctgaacatctttacatgtgctcattttccattcgatattttcatttgcaaagtttctgttcacatcttttgctcaatttttaaaatggacaaaacaacaacaaaaacactgaccgtaaaagaaaagattgataacatacttctattaaaattatgaactttcttcattaaagacaatgttaagagtgtgaaaaggtgagtcagataagataagaactgtgtatatttgaaatttgattagggttaaacatgttttcactttccatgggtgataaagacaggactgtgtgtgctactttcccagtgctgcacgtggtgcttggcatagagtatatgttgaatgaatatctgtgaataaatgcatggatgtgtgagtaaatgaataaaggggatgaccttatttaaaggtatatagaagaacaccctctaatgcactgtttgcttttcctaaggttaagagaaagttcaatcttagcgagaacgggactctgaatgtgacttaatagcaatgcgagagttggcc

SEQ ID NO: 468934 - DNA, 561 bp, Homo sapiens
tccctggaatcttcttgggtccaaatgtcccctattcccatggccacttcatgctcacctcatgtaaatgaagtggtagcccacaatcagtctgattggttgcagaaagcagccaaccagagactgaatatattcatatcttttgacccagaaattctgcttccaggaatctatcctaaggcaattgatgaattaagaaataaaggcttgcctgcagttctggttacaattggccaaccacatctcttaaataagtttaattttgttaaagcatactttttcctaagtgtggctgcgacaataaattgtgtcccagaaaataaatttaagacagtaattaccaacaagagcaaaccaaacctaccaaacttggaagataataaacatgctggcaataaactataaacacaagtaaattacagagtgtgggcaaaaatgataagtgctatggagaatataaggagtagaggttggagggggacgagttaccattttaaaatcgtgtggttgtaataagtgtgactccattttgatgttcaatggctgacagctttcaagccc

SEQ ID NO: 468935 - DNA, 488 bp, Homo sapiens
agcagtgagggactgaagtgtgagagatggaagcttccatggcatgacccctttaaagcaagaaatttggagtcccagcttctccagaaaagcctgggcactgaaaatagagatcctgcccttaagccatagtctgagcctccatgattcagagcagggcagcgttgctcaaggctcagcagaagtgagaaaaccaccctcactgcctgcctggaagctgaaaaggcggctctgtgcatcacatctacccatgaagactggtagggaagctgaatgttcaccttcaactctcttcttctgtaaaaacagtggagtctcagcaaactgctgtgctggattgagggaggggcagtatggtctaagtgaaattaaagttgctcctcttaacctttatgtgctgctgttctcagttctgtggtctatggaggtatcccagcctcactcctgagttctaagatattcactagggtattcttgtctgtggatag

SEQ ID NO: 468936 - DNA, 1181 bp, Homo sapiens
ttgctagcacagcagtctgagaccgagctgcaaggtggcagcaaggctgggggaggggcacctgccattgctgaggcttgagtaggtaaacaaagcagctgggaagttcgaactgggtggagcccaccgcagctcaaggaggcctgcctgcctctgtagattccacctgtgggggcagggcacagtcgaacaaaaggcagcagaaacctctgcagacttaaatttccctgtctgacagctttgaagagagtagtggttctcccagcatggagtttgagatctgagaaaggacagactgcctcctcaagtgggtccgtgacccctgagtagcctaactgggaggcaccccccagtaggggcagactgacacctcacatggctgggtacccctctgagacgaagcttccagaggaatgatcaggcagcaacattcgctgttcagcaatatttgctgttctgcagcctccgctgctgatacccaggcaaacagcgtctggagtggacctccagcaaactccaacagacctgcagctgagggtcctgactgttagaagaaaaactaacaaacagaaaggacatccacaccaaaaccccatctgtacgtcaccatcatcaaagaccaaagttacataaaaccacaaagatggggaaaaaacatagcagaaaagctgaaaattctaaaaatcagagtggctctctccctccaaaggaatgcagctcctcaccagcagtggaacaaagctggacggagaatgactttgacgaggaggaagttaaaacccatcgcaaagaagctaaaaaccttgaaaaaagattagacaaatggctaactagaataaccagtgtagagaagtccttaaatgacctgatggagctgaaaaccatgacacgagaactactgatgaatgcacaaccttcagtagtcgatttgatcaactggattgaagttgattcgatcaacaaaatatgggactatgtgaaaagaccaaatctacatctgattggtgtacctgaaagtgacggggagaatggaaccaggttggaaaacactctgcaggatattatccgggagaacttccccaacctagcaaggcaggccagcattcaaattcagggttacagagaacgccacaaagatactcctcaagaagagcaactccaagacacataatggtcagatt

SEQ ID NO: 468937 - DNA, 630 bp, Homo sapiens
ctctgtcaggcatggggcttagcagggctggcttctgctgcttgttaaaaggagttcaggagaacacgcagtgtcgggcctggagaaccatggacatgaaagggccagaggcacaggtgaggggagagagcagcacctgcctgaagaatacacttgagaaactggctgcatgcacaggccttgttcttacacagtgtggggctaagatctgccagagagatctgtggaaccttgaacttgagagagatgatttggggtatctggtggaagaaatttctaagcaccaaaacattcaagaggtgacagagcataaaactttggaaaatttgcagcctgacaatgcagtagaaaagaaaaacccattttctggagagaaatttaagctgcctgcagaaatttgtgtccttgtctcacaactgggaaaaattcagcatgcagatacattgaaaggtgaggaggatggaatttatgtagtgaaaggaaagctctcaacagaaagaggtggggagacaaatggagtaaacttttggtaagcatgtggaaagcctgctgatctaagcatttggatgctatgggcatcagccaggaaggtttagaaagggtatggagaatattcattcatttggcaag

SEQ ID NO: 468938 - DNA, 705 bp, Homo sapiens
gagagcgagctagggctgccagcatgctgtcacctctcaatatgagagtgtataagtcaaacagtgtccctatccttgtttcattcttacctctacaattatatatattaaattcaattttttttgttgttgttcatacttttcttctaatcctcttgaccaggttaactcttactctgttaaaacttttaaaaactgttttggaggtggcaagaagtcccattaatgaccatgggttttctgggcttcatattctcatttataaaatgatcagattaaataagattagccctagagtcttttctatttctaaaatgctaagatatggtatccaaaatgttgccagaaatggatcccaatccagagcccaagagggttcttggacctcacacaagaaggaatttgagaactcttcttcaaataaaatccttaacttccagcaatgagcacagattttggctttaattaacaaatctctttggtattggtatgattacattcttgtaatctttaatacccttagaatctttaactgctgtaaaattcagtgctgtgcctggttgaagaaacatgggttgtttatttactcttccgtgtctgcactggttgaatgttatgttgtgcagaaaactgcttttgattcaaacaggcaacatgatttcagacctaattactacagaagtaattgctccttggcaaatgggg

SEQ ID NO: 468939 - DNA, 1332 bp, Homo sapiens
gagttaatgggtgcagcacaccaacatggcacatgtataccctattgaagacaaaggagaattcagtgttccaagctgttatgggaatattaaaaatgacaacggtggttctagtcttacctttgagcatcctttggatgatgtaaatgtggttgatttgaaatggatccacgactttgtattaaaatctctggaagttttatatcaagtggaaaaatgggaaacactagtatctcttgccattcagttcaatacagtttcacatgagaggtatacagaacaagtgacaccacttctggtgtatgcacagcgccagcttctgctgagaatacagaagttcaagggcccagatattacccaacaaccttgtgcaaggtatgaggctgaatatggagagaagggtgatctagaagacttcttggagatgatggcatttgatgagaggggccagccatacagtgatctagggaaagaacattgtagcccaagagaaaaagaatggcccatgccctgcagtgggacagaaagaaggcctgtatggctgaagtgtagcaaacaaggggcatgggagaaagaggaggctgctccttccgaggattttttgttgcttcttcttctccccagtgtcccaattcctgcaaactgtgattcctctctcttggtcctgcttcatgatgtatgcagcaatgctgcagctgaagtcccaggccctcactcactcttcagagacctcgaagcaactctctcccactatctcccctttctgggcacttttcaggacaaatacagccgagccaaagcgcttgtctgcgtgcccgtggacgtgacagacaccttgaggtgttttagagagacactggaaaaatccaaataccataacagatcaatccgacacagcagaaagttgctttcattatttcttgcacagacacaaggagagaaaggagaaataaatgattcaaaatgtacttctggaaaggtggaattttgcctggggacagaggagatgcatatgtcaataccccctgacctttctcaggagcacttcagagtttttagttccgtggagaaaagcaaacttccatattcacaacttggacttgtaatttcttcttatcaccaaactattgatgtgcaacctaggtttggggtaccaaatggcatctactgggaactgtaagtctctgatagcatcttaaagttccgataaacttatgaagcatgtgctagatagattatttcacttattttcaacagtatagtttcctagcatggaaagcaaatcagtatataacatatcctatatttaatatttggctaaatttgattatt

SEQ ID NO: 468940 - DNA, 1217 bp, Homo sapiens
ggtcctgacatcatagagctggagcagaggcataccctgaacagtctcatagaggtgtcgatggggccacacttgttctaatggctctaggggagaatccttccttgcctcttccggcttctggcatttgctggcggtccttggcgttcctcggctttgctgcaatagtattttctacacttacacttctccaggattcaaaactttttgaaaagaaggtagtacaggatgacacagagaatcctgtctctccaggaacttctgtcactgaaaataaagatgacagtgagtttttagatcctatttccctaaatgcccgagaatatttcaacattcatctgtggttgaggtgccgcttagcattggtgactgcatttgttgcacagattcatggcattggaattgtgaaaggacatacagtggccaagcaagtatattacaagaataaaaggaaggacccctcgaagtggttacctgctcttcatctgtttgatgtggcactgaagctctgtagaacaacagcagtggaggaacatgaggtggaagctgaaatcctttttcagaaaggcaaaatagaacgtcaaatactaatggaagagaaatctccaagttttcaacttgagagtttatatgaagctatacaactaagcctgaaaaatgatcaaaactcaggctcagaaattgttggcaaatgataccaatgattatgcatggtgaagctatttaataagtacagtgctatatcattttagattgataagagactcctacctagaaatggctctattgtattttcatctgaagaagccaaagataaaaatttcaggatcaccattaacacttaagaaaatgttggcatcaaatctttaatttttgagacaacataaacatgatttaaaacctttaggcaaatagagtctcagtcaattcttaccaattattcatatggcagctgccattcatatggcagctgccttagactgagagattagtcaaaatctaagacgatgactgaaacttccaatatggctatttcttcttcatactgcctccttattacttctgaatgatgtgtttactttaccctagtcatttccttgtgttttcccagtttttagggcagggatgaccaataagtttcatccaagatggaccctaaaactcagtggcctacaacaacaggaactcattcttccactcagctcatgtgttctgct

SEQ ID NO: 468941 - DNA, 646 bp, Homo sapiens
tcatcagttaaggcaaggaccggccattttcacttcttttgtggtggaatgtcatcagttaaggcaggaacaggccatttaaatatcacttcttttgtgatttttcagttacttcaggccatctggatgtatacatgcaggtcacaggggataggtccactccagaccctgttttcctgggtatcagcagcggtagctgcagaacagtggatattggtgaaccacagatgctgctgcctgatcgttcctctggaagttttgtctcagaggagtacctggccgtaagctttgtcatacactaccagcagaattccacaaagccctacaacttatcaaatatgtcatcagtaaaactagtcttgcatttcaggtccttaagattccaatttgtcactttagagctacacaactgctttgctgtgttccacttgcctggagtctctgacgtctactgctttgccatgacgggcaacgtaagacaggtaaacaaggagtggcaacctggttctgatggaccaaatgccctccaaacaatagagggattgggagctccttaaaacctcaaacccttgcctacttactgaccctgtttcaaggttttctcagaggcctaaagagaaagtatggtaggtaataggagctgcag

SEQ ID NO: 468942 - DNA, 3307 bp, Homo sapiens
agcagtaggtctaagagaatatgaagaatgaagcaccaaagaaggataaagtctcccaggcaatctctccaagctgccctcagaagaatagacaaaaactctgtgtgggcctggtgatgacttttagtcttttctcctctctggtgcttaatctttcttggttatttaatgagattcctagaaagggagcttcaagactattggttattgcaattcatgagaaattatctaatcttgctcaaatagctgaactatcattgccagcagctcctgaaattacctcaaatgaaaacatatatgaagtagaagtggaagaggaatcagttgataatgaaatggaagccatgaactccttatgggctctctgtgttttgttcatctcctattcctccttcgtggcctataggaggaatttgattgatgttgaatggataaatggtgaaaggattttgttctgtaagagagggctgtgggaaagcagggctggatcttggggcctaggacaaggatcctagatattatatattatatataatataacatgttatattatatataatataatatattatatatataatataatatatattatataacatgttatatattatgtaacatgttatattatatattatgtaacatgtgttatatattatgtaacatgttgtattatataatatgtaacatgttatattatatataatatatgttatattatatataatataatatattatatatattatataacatatataacatacataattatatattatataacatattatatattatttactatatattatatatattatatatactatatttacctataataattatatatacatatattatttacatattatatatgatataatatataatatatatcaccctattgtatattatatatatcatgctataatatattatatataacatatcacgatatatattatatattaattagattatataatatattatataaatatcacattacataataatatgtatcatgatatatattacatattatgtaaccatagtatatattacatattataatatataaaatatataaattagtatataatataatttataatatataaattaatatataacagaatatatcatatatattcatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatatagtgtgcagttatatgtgattatatatagtgtgcagttatatgtgattatatatagtgtgcagttatatgtgattatatatagtgtgcagttatatgtgattatatatagtgtgcaattatatgtgattatatataatgtgtaatatgatacatagtaatatattatattatgtataattatatatgatacatagtaatatattatattatatataattatatataattatatttaatataattatatataatacatagtaacatattatattatatatagttatatataatatataattatatataatacatagtaatatattatatatagttatatataatatataattatatataatacatagtaatatattatatatagttatatataatatataattatatataatacatagtaatatattatattatatatagttatatataatatataattatatataatacatagtaatatattatattatatatagttatatataatatataattatatataatacgtattaatatataatatataattatatattaatatattattaatatataattatatattatatatattatcagaaaagcaaatttttgctttcttcattaccagacactggcaacattgtgaagtaggcatagttaatctctgacaattatgtagttatgacttcttcagttcgtgacaagtggaaaatagtatatcattattgtatttttattgttagtaaggctaagtatagttcttgtgttggttggcattcgtgtttctcctttagcaaaatggtatttattcatttagtcagctgacagatgtttagaagaactatctctgtgtcagaaactcctttctgtgcactgaagagct

SEQ ID NO: 468943 - DNA, 600 bp, Homo sapiens
aggagagcagcagtcataaaggaaaagaactaggacagatgtgcaatttgggggtataatacttggatataatttaaactgagatatcatgatgaacctgatactgtgtatttactgtgaacgtgatgagaagtatatgcactccttgataaaccaagtctggcctcattctggatacaactgcactttcctgaagtttagtcattttgtgtatgttcacagcagctctgggaatgtgatggctgacagccctcaactctcaaccctctctagcaacttctttcaactgaaggacatgaactctttctggagggaagcccacatccaattactggttgatgtgggagtacaaagacccaaccccaccaccaccacaattcaggaccactctgaagggccaccccagcctcaaaattcccccatgggaatatacaaagtgaattccaaattgattgtggcaataaatgtggaagataaaacaataaagctagaggaaataataagagattatcttcatgaccttggtgttagcaaagctttcataaataggatgcacttttgaaagtaccaatcataaagaaaagactgatggattggact

SEQ ID NO: 468944 - DNA, 678 bp, Homo sapiens
ataggaaactatactcttgcacaatgagatggtacaaacctgtacagcttgttactgtgctgaataccgtatgcaactgtaacacgacttcagacctctcttctgcaggtctgctggaatttgctgggggtccactccagaccctgtttgcctggttatcaccagctgaggctgtagaacagcaaagactgctgcttactccttcctctgaaagcttcgtcccagaggggcagagccagccggatctctcctgtatgaggtgtctgttgacccctgctgggacgtgtctccccgtcaggaggcacaggtgtcagggacccactttaggaggcagtctgccgggagatccactgctctcttcagagcctgtaggcagggaacgtttaagtctgctgaagatgcgtccacagcctccccttcccccaggagctcagtcccagggagagaggagttttatatataagcccctcgctgggcctgctgcctttctttcagagacgccctgctcagagaggaggaatctagagaggcagtctggctacagtagctttgccgagctgtggtgggctctgcccagtctgaattttccggcagctttgtttaaactgtgaggtggtttaaaccgcctactcaagcctcagttatagcagatgcccctcccctcacccagttaaagtg

SEQ ID NO: 468945 - DNA, 955 bp, Homo sapiens
tcactaggggaggcattcctgggaagtctactgcaggcattgttgtcataggagataacagctccatgtgttttattgcccctgaagatcttccagagggacaagatgtggaggtggaagacagtgatattgatgatcctctggaactgaatcctattaaaaaccacttgaactttgaagcagatatttctccagttgtgccttcagatgagaccccagccctgaccatccctttgattgcagtcttgggtgaaaccatgaagcagaggacccagataagccatgctcagataagcctgaccaacagaaactgggatagaatttcaacatatgaattttggggagacacaagccttcagtctataccacctactgtatctgaaggagctttctggaggagcctttatggttttccagataatgacatagaggcatttgaagacaggaagtccctagggcaaggtctgattcgctcaagtgcattggtgaccatcagagacagtacagcacagcggttgcaagcccaggcaatggaactaggattcaaatcccagtaccatttctcgggtgtgtgacctttggcaagttatttgttcctctgtgcctaattttcatcatctgaaaaatggaggttccattttctttgaatttctccttatactcgttatggaacatgcaataaggctatctgtcacctttattgagccatttgtcaaacaggtattgaacacttgtgctggggatattatgacgtattatggtgtctgccttctagtaacttatagtctaaaatgggaagaagaggagttgtaatagttatcacataattagactcttcacaatgtacataggaggggttgattagcaattgagcttggtggtcagagagagctttgtagaggggataatgatgatgcaaggaattgaagaagcagagagaggcagtgcaatgcat

SEQ ID NO: 468946 - DNA, 595 bp, Homo sapiens
ttcagggcagttaagcagcgggaatatggctttggtttctgttgtgattcagacatgctgggaggagagcctctgcataggagctggattagcctggtttgatcattctcatctggtgacaaagaagggagtgacagctttcttatgggcttgtcccactatggggcttgaaagctattttagaaggagcaaggatgaaagcaggaagacagataaagttattgcaataatacttgggaaaaaggatggtggctatgaccagggtgagaaacttctgctgatgtcaaatgaccacaaggatattaacaactggacttggagcctgtcggccgctgttggatacacctcctttaccaaggcggctttcttcactactgccactgaccttgcaaacagctccgacaaagaaaatgatgctaccactgagtggtttcagaccacattttgataattaattacttcgcatttgcagcaaatttttataagggaagtatattccattaaagttaaagatccatgaacactttgaaagccccctctttcatgtgcatccatgtgaagagaccaccaaacaggctttgtgtgagcaataaag

SEQ ID NO: 468947 - DNA, 1524 bp, Homo sapiens
tgctagcgtagctggcctgtatcccaggagtcaggaaacaatttctctgcagtcatccaggcatgcgcaatgctggccagacaagagatcagacatgtggaaggggcctggtagaaaactcaggtctagttagaaaccaaagaaataaagtctggaggaatccagaatatcagaggtctaaacacagagacactgagctcacgttgggatgccccacctacctctgtgtgcctgcccccagcatcaactcacctgctccctggagggttgtgtcccgcttacttcacaactgtgagccaactctggctctgggaacccagcaaacttctcgaccattcatgttctctaatgctgctcagtgccaaagagctttaataaaatgcccaaggtcacagagcaaatccattgtagaatcaggggtggaaccagctgttgtgaatttggagcccacatctcttttcagggtctcagactgcctctcagagccacaagagatactcttatcaatgttgtttggtgggtgtccagtttactgcagtcgatactgccaaatgaaatcttcaaatgccagaagtatgctgtcagacagtcttcacctttatgaacttcagcgttataagcagcagcagcacagacacagccaggaaatctatagccacagttaatgctgattgttaaaagtgtgtctgcttagaagttgtttttgcctgacaatgattgatgctaacattcattaaaacaacggtgacaaaaataacaaaaaccacaacccacctgaaacaaaatctaagctaccagaaaggtggtccatggcttctatagggaacctggaaatcatgtcccaattaacccaactaatctaatacaaaatgatagtcatgttgaatatgctgtttccaaacacttcttccttcctccttccttttttcttcctcttttccccagaatattatgatgccttgcccctcactctaccctccagtcattggtgttgggtcaaggcctgttgaagtaggagtatggagacctggatgaaaaataatttaatgtaaattgagagcatgcattctaacatttaaaatatactaactactcagggcaaatactgtgatggagttttagctaccttcaccctaattcttacactactcttacaaggcaaattttatagatgaggaaaccaaatctcagagaaggtaacttgctcatcatctagatggtatgtgattggatttcaaacttgggtctttctggctctaaatcttatcctttttctgccctactcctcaccttccctttaagaaatggtaagttacattaactagtagtagtggcttatttatttatctttaacaccaactattggtgtttggttggggttgcaataacaatcaatgtgaattggccaaaatgtgagcaaaccctgggtactgaaagcagaaaaagttaaaatagttaaaagtcagtattctgactctgctgtataggttttgtttttagattaccagttgctaatcataaagt

SEQ ID NO: 468948 - DNA, 1660 bp, Homo sapiens
ttgcttcaggccatctggatgcatacgtgcaggcttggactcagaggcctgacaaagtttctcactacaaaaatgataactgtcttagactcagccagcagagaggagaagcagctgttatgtcagagactacagctggagctcagagagaagctgcttgacgtcagaggcttcaggggtcctgggcatccactacaagatgctgccacagagtccgcatggagtttcctcctgctggtgcccaaaagtgctcaccccagcttccgcaccaactcatctctgtgctccctccctggaggggtgaaatgcaaggtggggccctcacacaggggccccactggggcactgcctactggagttatgagaagaggaccactgtcctacaggcctcagaatggtagaggcaccgacagcttgcaccatgtacctgaaaagctgcaggcactcaaagtcattcctggagagcagccttggggactgaaccctggaaagccacagtggcagaactgcccaaggccttctgagcccatcccttacaccactgttccctttatttgaatggataaaaaatttatatatacatagagagagagagagttaaaatcatgtaatatatattacatatgaaagtatataaatgtattatatattatatatgttatatgtactaataatataaataaaatgtatgtaatataatatatacttccttttataaaaagtattatataatacatattacatataatagtatattatatatatactgtattgaaaagatattaaaggaaggttattaattcttggtatatctggaacaaattcaaacaggtaagtctgtatttgaatttgagaaatggatgataattcaccaggacaacaaaagaaacattcatattacctttcaaaggaaaaatgtctattttagacaaattgtacttgttttcatatttttatacccagtaattgctgacaaagatgttcacataatgacacttaatctactaaaattatctgaactttagtataagccctttaactttgaattaaataatatattcagctgttaaaaatatttttaagcactgacaaatatatttatatctctcagtacagacagatttatacacttgtgattatgctatgattaatatagaggttatcatttcaaaatgaatttgtctgatctcttagcaagataaagtacttgtgctatgccttgagctatctgtattatttgaaaggtatatgcttttcaatttcaagtccatgaaatagcttttgtggaaatttaaattaatttatttatattgttttctattagattggctgaaatgagtagtacgattgcatttgactggctcaaattcattatttctgtgtgctgtttattatcagttgggtaggtccacttaccagtgtcatataaatgaaagtatgcaagctggtgattaaagtctgatggctagacaaggataaggcccatgctggaaagcaattcttccatatttttgccaaaataagattttgcccataggacagactgtcagaggtctgctacagggatctgatggtgctgttcagacccactgtggaaagcaatactgctctttggggaaaaataaatttttccagcccatacaaccttccaaggaaaacc

SEQ ID NO: 468949 - DNA, 480 bp, Homo sapiens
ttttcaggcttcaggctgcctttggcttgaagagaacagcatgataaagacccagcccatgattcaattacctcccactgggttcttcccattacacatgagaattgtgggagttacaattcaaggaagctcctcccctgtggttttacagggaatagcccctctcctggcagctttcaggactggtgttgagtgtctgcagcttttccagatgcacagtgtaagctgtctgttggtggatctaccattctgggattatcgggaagaaaaccgagaagcagctcccatggtggcagtggcttcctcagtggtactaatagctgggatagcctggggccggggtgccatccttaggaggcagctggctggggtcctccagcaacaagggcacattttggaactgctgggccgtgtagcgagtgaggaggatgccaacgccctcaatgagggccaacaggatgccccccatcatcgctgagc

SEQ ID NO: 468950 - DNA, 653 bp, Homo sapiens
ctgctccagtcacacctggaagctgtctatacatggccaaagcatgaggaaactcatcgtgggactcattttccttaaaatttggacttgtacaataaggacttcaactgaccttcctcagactgaggactgttcccaatgcatacatcaagttactgaggtagggcaagaggttaaaacagtctttctgttttatagttattatgaatttactggaactcaaaaagggacttgtttgtataatgccactcagtacaagaaggcccaaactagcaacttctgggtcttaaagagttccattattgggcaatattgcatagctagagaagggaaaaacttcaccgcccctgtgggaaagctcagttgcctaggacaagagctgtataacagcacagcaaagatagtcacctggtggggcctaaaccatactgaaaagaacccattcaaccatcatactggagttgagtgggcccttaacactctaatatcaatgttgtccttacaaaaatgggaaacttggacacagacacacacacacagggagactgccgtgtgaacatcaaggcaaatgtcaggcaatgtcttggcaagctgaagaacaccaaaatattgtcaggaaaccaccagcagtcaggggagagaacagattctta

SEQ ID NO: 468951 - DNA, 788 bp, Homo sapiens
gcagtcacacgatagggggggtcgacagtgttaatgacccacaaattgtgtttgcaccaagcctttgttattaaatctgtactaaataaatgcgagcgtctctggcttatgagggctgctgctgctactgctgcactcttgttggtggtgctaagcagcagtcccctagccgcgctgtcagcccttgcattggcctctcatcatgacaggagtgaaaaaccaaacttttccaatggccttcaaggcccttcacaatcaagctccccttgctgtagctacgctggtgtccttggtttaccgcccatctgcccatgccatgaggatactcaagttgctctgtggagagatccacatgacaaaaacctgagacccatcaacagccagcaagaaattcaggactgtacagttgtaagccactttgtaagcaaatccttctgctcctgtaaagccttcagacaacttcagccctagtggatacttgactgcaactttgtgggagaccttgagccagaactatccagcgaagccatttccagatacccaactttcagaaattgtacaagagaataaatatttatgtttttaacgccaaagttttaggatattctgttacccagcaacagatcatgtatagcacattagcatgtttagctacaacagttgtagtattttcacaaagctcttgaatactctgtccctctaaacgtttttttttttctttttgtgtttcactttaggttacttcttttgatctattttcaagatcagtaataatttccttgctgtga

SEQ ID NO: 468952 - DNA, 677 bp, Homo sapiens
atttaatctcctgagtacagccatgtctaagccaaatccaggactaaactttctatctgtagtattctgttatagcagcataaatgcactaaagacagtaattgatagaaagtggaagtgttactataaaaaatacttaaaaatgtgggagcagctttggaactgggtaatgggcagaggctggaagagttggagaggcaggctagaaaaagccaagattactataaatgaagctattccagaaaatgtgcaggaaaactggagttgtggctacctcaaagagccccagtttggacaattcttagtgatgccattggagattgaggttattagagacagcataattggtagctttgaggatcgaatcatagtatattggatgcaaatacctaatccaagactgaattcatatggaggagcactgctagtggatagtttcagctggagttgctgtagcttatattcgtgaacttaagatgtttacactataaagtattaaaataaatttggtttagttattctaaatcaataattaatttattctgtgcgctatgcactgctctaggcttttggcatacactgttgaatataactggccaagatcacttacttcgtggggtttacaagttcatatagagggacagagaaggagccttaagtttctaaatagtcaataa

SEQ ID NO: 468953 - DNA, 555 bp, Homo sapiens
gaaactggtccctggtgccaaaaagcatgaacttcccactgtataaccttttttctggtgtcctgctgctttcctgttctactacagctgttaaattaggttatctcactttggatgagatcgttaaagttgctgaagctctcattccccagcagaaactggagtgcaggggcactggaactagccagccactctggcgctggcaggggcgaattccactcactcagaccctctgtgcttcacccctctcaggatggggagtatgcagtatccaggaggaacaaggtcacacaaatgaattgaagacagtaaatgtgggggattttattgctgatgaaagtggacctcagagggaagggaagctgaaaaggggacagagcggttgggaggaacatggcccatttacatgtatatatatgaagatgaagcctttggaggaagaaattgtcaggcctctgagcccaagccaagccatcgcatcccctgtgacttgcatgtatacatccagatggcctgaagtaactgaagatccacaaaagaagtaaaaatagcctt

SEQ ID NO: 468954 - DNA, 602 bp, Homo sapiens
gtggagaacctttatgtctagcccagggattgccgggaggaaaggaattgcatcttccagttactctcttgacccagtgttctggctgttcagctcagacaggcccctgtttttcatctgcagaaattctgatgttcatgttgaggagttgtggttctaccccttatggaagcctgaacctggaggccactcctcctggctgcttcaagcgggattaggggcggcgtgggaacctagagtgggagagattaagctgaagggagatcttgtggggacagacttaccttccactgtgatagttacccgaagctcggcatctgtgatgggctacagggcttctgaggcgatcgggcagcatcagtcttcagctgctaagccgagaaggagtcagtcagagagccttgggccggagttccaggggctctgggagtggctgccagttttatttaatgtcgggagcagattgggtaataaaatgtatattgagaataagacggccttttgaccttttagggtctagggctgtaaagcgtctcagggttgctgccaaacgagccacgaactgggctgggtttttatatttgatgaaaaagagcctaaac

SEQ ID NO: 468955 - DNA, 669 bp, Homo sapiens
tcactaaagaccatgtacgaccaggaaatctgcctcttaaaggatagcagagcagtgatgctgacacctttgggagaagatggggaacctgagctgaaagtggtccctggccaagagacagcgctgaaatgtggacctccatcctacatctgcaaggaaatgaattctgccaacaccagtgaccttgaaagatgccctcagtttcagatgagaaccgcagccctggccaacaccctcatatcagttcaggaagaaaaccataaaacaagatgttggaggtggagcactggggagagaacacatgctgtagcagtgcagttgctgaaaaacaccgatgagagagcagtgaaagacgactcactgagtgatggcaggtggatttcacaatctatgacaagtctaataaactggccatggcttcccaaagaactaagcaaaggaggatgcacagaaaaacaattataaatttatattaatgggcacacaatgtgtacaaatgtaatttgtgaatatagcaatattaagggagagaaatagcaaaaaaaaaaaaaaaaaaaaaaaaaaaaaaaatcctaaaatttgtatggaactccgaaaaaccccaaatagccaaagtaatcttaaacaagaagagcaaagctggaggcatcacacttcctattttcaaac

SEQ ID NO: 468956 - DNA, 958 bp, Homo sapiens
tgctgacctaactgcagaactcgtgatgaagcaggagagattagcagacgccagaccacagggaccctctaaagacatttggatgccatatttaggacaaaggaaaggagaaaagaagaagaaggagaaggagaaggggaaagggaagaggaaggggaaggggaaggggaagacgaggaggaaggaggaggaggaagaagaagaggaagaggaagaagaagaagaggaggaagaagaagaagaggaggaggaagaagaagaggaagaagaagaaaaggaagaagaagaagaggaagaggaagaagaagaggaggaagaacaagaggaagaaaaagaagaagaggaagaagtggaatggaagaagaagagaaagaagaagaagaggaagaagaagaataggaagaagaagaggaagaacaagaggaagaagaagaagaactgctatacaaatacccaaaaatgtggaactggctttgaaactgggtaatgagtagaaggtggaagagtattgagctgaatgctagaaaaaaacctgtattgccataaacagactaataagggcaattctggttagggcttaggaaagttatagagaaagcctcaatcttcttagagaatatctgcatcattgtaaacagaatgttggtagaaatatggatgataaatgttattttgatcaggtctcagatggaaatacaaccacttaggtattcactattttaaactggaggaaaggtgattcttataaagtgacaaaaagtgcatcgtgttcatgtcctagttttttgtgaaggtaaacttgtgagtgataaaactcacaagatatttggctgaggaaacatctaagcacagcgttgaaagagtagcttggcttcccttgaatgtttatagtaaaatgcaagaaaagaaaaattatttaaagatggatttttttaattaataggaagacgatcttaac

SEQ ID NO: 468957 - DNA, 548 bp, Homo sapiens
agatgggggagggaggggcagtcattaaaacttaaagttccaaaatgatctcctttgactccatgtctcacatccagggcatgctgatgcaagaggtgggctcccatgagcttgggaagctctgcctctgtggcttagcagggtacagctcccgtcctggctgctttcatgggcttgcattgagtgtctgcagcttttccaggcccatggtacaagctgtcagtggacctaccattctggggtctggaagaccatggccctcttctcacagctccactaggcagtgtaccagtggggactctgtgtgggggctcccactgtacatttcacttccaactgccctagcagagattctccatgagggctctgcccttgcgtttttgatcaatcattctgacagcagtattaaagatggatttgaagagaataaaccttgagagggaatgaacaattagattctgcttaagctaaaagatactgaagacctaaactagtatattagttttctattgctgttaaaacaaattaccacaaacttagtgagtcat

SEQ ID NO: 468958 - DNA, 634 bp, Homo sapiens
aaagccacgagaattagacaccatggctctaatatccatcgcccaaaaaatcaacactgattggctaatggggtgcatgggcagacttgctgctggagtccttgggcaggttggactggtgcctagaaccacagggactggcctggtgcccgagtttatgggggtgggtatggaacctgggtctactggggcaggactggagtctgggtccacgtgggtgggcctggtgactgggtctgtgaggatggtcccggaacctaggtgcaggggtgggcttggtgcctcaaaccatgggtgcaggcctggagcctggggcagtggaggccagattggcactgtggcaggcttgagtcctgattctatggaggccggcctggtactatggtttactagagcaggcctagtgcttggatgtgcagcaaagttgaatgttcactctctttcctccatgtggagagtacctctcttcatgctgtgcttcctgggattggtggaaagccataaaaaggaataaaataatatattttgcagcaacttggatagagctggagaccgttattctaagtgaagtaactcaggaatggacaaccaaatatcatgtattctcacttacaagtgagagctaatctatgag

SEQ ID NO: 468959 - DNA, 765 bp, Homo sapiens
gttaaaggtaaaactctcttctctactcctccagcaaagctgcaatcctcttaggccaatgatgattaagaacatccacgtgctttcacttccatgccatgctatctctgacagatctaacctccccagtcatgttagactaactggggggcctgttcttctctgtaagacctctgaacttgaccacatccatctggttcaggtgatgtgtctgaagacccaacccaggacccaaggctgtgaagctcagtgctcaattctaccaccttgtccatcagacatctgccccagaaagaagcatgtcctggctggagatggaagtggaaccatgaaagggttggactctatgcccaatccagctccctccatcctccaaaatctcagcaaacacgggccatttcaacaccctattagggtagcttacagtcctgagctcttgtcatatcttgtttcctctggcagtgttcccctacccccacctgtttgttctgtggttcctgtgagtcagtaaatgcacttcatctctgctgaatatccattacctgtcagatgttctgctgagtatttctaggcatggagaaagaataacttcattgaacttttttaaacttatttttgatgttttctcttgattttattttaagttgacatgactggggtattataatctctacagcatgtataacctcttaagaacacctcttaagtcttaccctctgtcttttgcctgttgccaaattttcacgacatctccagttataacct

SEQ ID NO: 468960 - DNA, 902 bp, Homo sapiens
tgtttcagaggatggaaaccccaagccttggcagcttccatgtgttgttgagcctgtgggtgcacagaggtcaagaactgaggtttgggaacctccacctaggtttcagaagatgtatggaaacacctggatgtccaggcagaagtttgctgcaggggcagagccctcttggacaacctctgctggggcagtgtggaacagaaatgtgggatcagagcacccacacagagttcctaatggggcattgcctactggagcttgcattgggaagtcatttgaagggaattgagcaggggtctcatatgatcttgttttcagtggaaagattattgtgtcagcttcatgaattgcagatgcggcaaggtagggagaaaatcacagctattgtagcaagatattcccactttgtggatgaggaacctggggctctgaggaattaaggaacttgccaaagaccataaaactcctaagtgacagagccaggattctgccagctgtctggttgcccagtggagtctctgtccatcttgtcaccagcccccgcactgtgtacaggaatggaatcagcattcattgctataaactgcagtaaggtcaaggaggcagaatttgctgcaaggaagtaaagagtcccttctacctttgccagtgctacttaccagttaaaaaaagacatcgttttttgtgatccatactcctgaaggccaaaagcacccagtggacagacgatggctcttacgcctccaatgccaaggcaaatggtcagcagtgctacataaaacagcctgtgctgctctgtttttgctggatggagccttctttgccacaaacagagttgagaaagctggggacagaggagtgtgagtggaaggagaggggacctaaagtgacaaaagaaggtc

SEQ ID NO: 468961 - DNA, 539 bp, Homo sapiens
gtctgaggtacaaggcataggccatgaccttgggtgtgagtggagtggaagctgaggtagattggagatcagacattggaggtcaaggaactggacaaccaagattgaaaggatggaaggacccaggacctacgagtcagcattgtactaagcactttacatgtagtattgcagtctctgtaatatcatacagatttgttccaagcaatgtcagaggaacctccatgaattttctgacactgttcaatggatttggctgtttcacaggggcactgctggtgaagttggtatatctcatctcagatggtaaaaatagaattcatgctccaagaagaattaatgtcatgttaattctgaagcttcacatactctgtgcaaactcctcttacactagtcagagaaacatggtgataaaaaggtataatcgcatgacatgcaaagtgctgatgtgaaatgaaaaggacagaaatacaattgggatattaattcaagaggggaaaaaatagcactgtttgaataggcttagaaggatggtttag

SEQ ID NO: 468962 - DNA, 1082 bp, Homo sapiens
tggctttgaccaaaatgctgatagttatatggacaatgaagtccaggctgaggtggtctcagatggagatgaggaacttgttggaaactggagtaaagggcactcttgctatgctttagcaaagagactggcaggattttgcccctactctagagatctgtggaacttagaccttgagagggatgatttaagtaacaaggagccaaatgttaaccaacaagactatggagaaaatgtctccagggcaccttcacagcagcctctcccatcacaggcccagaggcgtaggaaggaaaaatggtttcctggactgtgcccaggtcccccctgctctgtgcaacttcaggacatggtgtcctgtgtcccagtagattcagctccagccatggctaaaaggggccaaggtacagctcgggccattgcttcagagggtgcaagacccaagccttggcagcttccacgttgtgttgagcctgtgggtgaacagaagtcaagaactgagaagtttgctgcaggggcagagccctcatggagaacctctgctggggcagcgtggaagggaaatgtggagttggagcctgccacaaagagttcccactggagcactactaagtggagccatgaaaagagggccactgtcctccagaccccagaatggtagatccactgacagattgcactatgcacccagaaaagctgaagacactcgatgccagcccatgaaagcagacaggaggggggctgtaccctgcaaagtcacaggggcagagctgcccaaggccatggaaaacttatttgtgcttcgaacactaaagatttattgagacttaggaaaaacttttcttaagagtcatgggtccacaggttaattaacggcgattgtgagagtctgtgctatgcaatgatttcagtaatggtcataacacgaacgatgactttcattttgaaagcaaaaattgcaggcgagatgccttacatttcactacctcagtgaaggtattcagacgtactaataactaccatttattaaggccttaatacatgacaagcactgtattagaacttttaacaaatagtgtact

SEQ ID NO: 468963 - DNA, 1006 bp, Homo sapiens
gacagggcgctgattggtccccgccagactcaggagcccagctggcttcacccagtggatcccgcaccagggctgcaggtggagctgcctgccagtcccgcgccctgcgcccgcactcttcagcccttgggtggtctatgggactgggcgccgtggagcagggggcggtgctcatcagggaggctcgggccgcacatgagcccatggagcgggtgggaggctcaggcatggcgggctgcaggtcccgagccctgccccgcgagaaggcagctaaggcccggcgagaaaccgagggcagcgccggtgggctggcactgctggggaacccagtacaccctcctggcccgggtgctaagcccctcattgcccggggccggcaggaccggccggctgctccgagtgcggggcccgccaaacccccgcccacccggaactccagctggcccgcaagcgccgcgcgcagccccggttcccgctcacgcctctccctccactcctccctgcaagctgagggagccggctctggccttggccagcccagaaagcggctcccacagtgcggcggtgggctgaagggctcctcaagtgccaccaaagtgggagcccaggcagaggaggcgccgagagcgagccagggctgaggatgcctgaaatcagtgcagatcccagagagacctgccatattaacagagattctctatagatgcaaatttctcccacaaaagacagctttgcaaggccatttcaaaatatgccaaagaaatacattttgggctaaagcatttttatttccttcagggtctgctatttgttatatgatgttatatcagaatcaggtttgaatttggtatcttactgccacaaagagtgtgttttgtcaggcttatgatctctaatgttaatgctgcctagttatgcctaaaccttagaagggagggggtttgagatgtgtccaacctcccttcctttcacgggtgggaattcagtttttcaggtatctctgaga

SEQ ID NO: 468964 - DNA, 1058 bp, Homo sapiens
aaagtatttttaattagtgtctctctctcaatctctcgctctctctctctctctgctgagccacctggaacttggggtatggtgatgcaagcacccctgtggccacagccattgaaactgtgctctgtcagacttgaagccagcacagcactgggtcttgccccacacacactcataggaatcacgggaattctgggagctacagtccaagatgagatttgggtggggacacagccaaatcatatcaccatgaatcaaggactaaggattaaagacttaaatataaaacctaaatccataaaaaccctggaagaaaacctaggaaataccactctggacatagaactagacaaagatttcctgatgaagatgccaaaaacaattgcaacaaaaccaaaaattgacaaacgggacctaattaaactaaagagcttctgcacagccaaaaaacagaacaaaaacaaaaacaaaaaaaaaaacaaaaaaaaaaccatcaacagagtaaacagacaacctacagaatgggagaaaatatttgcaaagtatgcatctgacaaaggtctaatcccaaatctataaaaaacttttaaaaaattacaagcaaaaaaaccaaacaaccccattaaaaatgaggaacataacatgaataaaatgattcatttcaaaaagatgattcatttcataaagcacttagtctagtgtctaaaagcctaagtgatcaatcaatgtagccattattactactcagtaatttttaaaatgagataaatgtgcaagtactgatatgttaagctaaaacaataaacaaagggaagaataatatgtgatcttcacttcatcctatataccaccattagaagaatctttgaacacaattattctcaaattattcctagcccaaaaactcaaatactttctaaataaattttattcaaatcaaaactctctagcatagcgctgtatatcccaacatgccaatttcaccttctttatttcattttccattcaactgtatgccaaggctctactttgagctcatctgcttgttagatcagctt

SEQ ID NO: 468965 - DNA, 761 bp, Homo sapiens
ctctccaggcgcggtggcgtttggggaggagtgaagtcctgtcctccattttgttagtaacctgattatggatggggcattatcacccaaaaaggaaagagatactatggtatgcagttacagggagccggagcaagagcaagacaaagaaattccctcatgtcttcaatgcagagccggcatttagacctctactccaagcagggcccacaaatctctggcagccgtgcttcttttctgtcccatggcaggcagcaccaagagaaggcttctgcaaagccgagagctacttttacccatggatcaagagaggatcagcaggtcaagaaatagtagacaaacacaagatagtgaaagctgggtccaggatggtcaccgccttcttgtccagtggtgctgtcaatgcactggatataccagcatttattatgaagtttagtgagggcagaggagcaatgtggaatcctgtattggcaaaagctaattttaaagaggtgaaacattgaattaattcacctttagtgggagcaacaatcagtatatcatccatataatgaagaatgtaattatttgtaaaagtctgtcagataggttgtaacacagtactgacaaaccactgacaaatagtaggactgttaatcattccttgaggtaaaactttccattgatatctagttgcaggagctgaattgctaatggaaggtatagtgaaagcaaatttttcacagtctgacttgtctaaaggaatatgaaaaaagcag

SEQ ID NO: 468966 - DNA, 676 bp, Homo sapiens
ggaggagctatttagagccttatagcaagatggttaagaacataggctctggaatcagactgcctagtgggaagcactatgattggcaccatgtgttatctatcaccatcaccatcatcatcatccatcaccaccactatcaccaccatcatcatcaccatcaccgtcatctccatcaccatcatcacattaccatcaccaccaccgccatcgctatcactaccattatcaccatcaccatcatcaccattgctatcatcaacatcatcatcaccatcaccaccaccatcatcaccatcacgatcattaccatcactatcaccaccatcatcaccattaccatcatcatgaccatcaccaccatcaccatcactatcactaccattattatcatcaccatcattaccctcactatcaccatcataccaccatcaccatcagcaccatcatcatcatcaccatcatcaccatcactgtcacatcatcataccatcaccatcatcaccatcaccataataatcagcaccatcaccttcacccatcaccatcaccaccatcttcaccaccaccaccatcatcataccatcaccattttcatcaccaccaccatcatcaccattgccatcatcatcaccaccatgttacgtaagcactttgcctacattaactgatttaa

SEQ ID NO: 468967 - DNA, 641 bp, Homo sapiens
ggtcccgtccctgcgtggcgtcctgctgtgcgcccacagtgcgagtattccccagattgttcggggatgccaggtgggtcatcagggcagaacccccactcggtgtgtgcgtcggaggagctgcagcccggggcagtgtgtgtgttaatatatgggacagagccctttagagttgtcatggctctgtctgctcagggggactttctcagccatttctgggctggtttggagaaccctctgttcttccactcacctcatttcaatgctggcccttgttggcaacagcaagcttctgccccacaccaaaggaaacagagtgttaccccattaatacgtttttgccaatctcctgtgtggagctctgcaaagatagtaactggcagccagatatggaagcctcagagctatttctggccatcactgctgctccttatacaccatgcaactttctgctcgccagcacgtacacaacaatctgagatgcgaaaggcacagaagcttgtcttaatctgagcaaatcaacagctttcagaagctgcaaggaaatgaagcatcagagaaagtgaaaattgtccctaacgatagttcagaaaatagggctgattaggcaaactatccctgagtttcagtggatcccagac

SEQ ID NO: 468968 - DNA, 925 bp, Homo sapiens
ggcttaacaaacggcacaccaggagattatatcccacacatggctcagagggtcctacacccacggagtctcactcattgctagcacagcagtctgagatcaaactgcagggtggcagaaaagctggggaagggacacccaccattgccaaggcttgagtaggtaaacaaagcatcccagaagcttgaactgggtggagcccaccacagctcaaggaggcctgcctgcctctgtaagctccacctctggaggcagggcacagacaaacaaaaggcagcagtaacttctgtagacttaaatgtccctgtctcacagctttgaagagagtagtcgttctcccagcattcagcttgagatctgagaacaggcagactgcctcctcaagtgggtccctgaaccccgagtaacctaactgggaggcaccccccagtaggggcggactgacacctcacatggccgggtattcctctgagacaaaacttccagaggaaaaatcaggcagcaacatttgtggttcaccaatatccactgttctgcagtcactgctgctgatacccaggaaagcagggtctggaatggacctccagcaaactccaacagacctgaagctaagggtcctgactgttagaaggaaaactaacaaacagaaaggacattcactccaaaaacccatctgtacatcaccatcattaaagaccaaagcaatggaacaaagctggatggagaatgactttgacgagttgagagaagaagtcttcagacgatcaaactactctgaggtaaaggaggaagttcaaacaagtggcaaagaggttaagaacgttgaaaaaaaattagatgaatggctaactagagtaactaacgcggagaagtccttaaaggacctgatggagctgaaaaccaaggctcagaactgagtgatgaa

SEQ ID NO: 468969 - DNA, 1209 bp, Homo sapiens
agcgcctggagctacccatcctcctgcagcccacgttcctagcacagtgactggaccccatggctggccagtccttgggacccccgacaccatgcatgagtgcctgcagaagcagctgtagcccagtcaggcagtattttgggtccctgggtggtgatcacaggtgcactgtgcccccgctgctggagcagaacaaaaaaggcaaggaaaaggcaatcttcccccccaacactccccccacacatagacaccccccgacccctgtgtcctggcctcctggagctgggacattcttcttcctttgcacatcagaactccaggtttgcctgtctttggactccaggacttacaccaacatcacccactacctgggattctcaggcctttggcctcagactgagaattacaccatcagcttccccagtcctgaggcttttggccttggactaagccatgatacagcatatcccagggcctctagcttacagatggcctgtcatgggacctctcagcctctataattgtatgacccaatttccataataaatcacctcctatctatctatctcctcttagttctgcctcttagaagaacctaatacatgtgggtttaattacacatgtctatgctttatgtaatattattaagttgtttacttttcattttgtgtattttgctttttgtgttttatactttataattgagatggttaaatttaataactataattagtatcttaatgaagggactatgcatcagatatgctaggcataattcattttcaataaaccagaaaatgaatctgatatgaaattacctagaatgccaaatagactccacaaccaataaaaaatatttaaaataatttaaaaatcatggagaaattgtaaacctctgggtacatgaagtatataacctttgagctgagttcattcccttgcctctgggccattgctcatttgaccatcacctgtattttcactacactacatggtcatttaaagttctgggcttgttttaatttgtttgtttaaaagttgttctagggtttaattttgcaagtattcaagcctgaaccttgtcttttaccctacttatttaacatatttttgtcagaccaaaattatactgatttttcccagtatttcctgattaaaaagcaaagtgaagagtaaaacccaaacatttttcctagaaatctagggggc

SEQ ID NO: 468970 - DNA, 625 bp, Homo sapiens
gacttgcctgatttgcaactcaatcagcagtgtgcctcatcgtgccaatatgtttcttgttggaattcggtattataaaaccacttccctgcagatagccacatttttctttatcagatttaggaaccctaatggagctacttcagcctctacaggagtcaaattctgccaaacacacgggctagtttcaaaattgagcatgcaaaatggagcatttgaaaatgaagttaaactaatggacaaatctgtcctgggagccctctgcggaacaagcagacaccgctcgcgatccaatgccagagaatcaaacgcttgccgactactgccgcgaccttggcccggaatctccttgccttcatgtaaactttcaagttggcttgtcatttcaaaaattgactcacagccgacttggaactggcataggaagtaagggcagtcttgcaggactgagcccttcttctgaggagtttaggctaagctcagggagtagtgtcagaatttatttgaattgtgggacacctacttggtgtccagacagttggtgtgggaaaacaacaacaacaacaatagcagcaacatacatttgatgtcagcagtgaagtggggtgagtgttgagagtaaagt

SEQ ID NO: 468971 - DNA, 739 bp, Homo sapiens
cggcctctgcctctggtgcctctctaccctcgaaaccatctttagaatattatatccatctctccacttgatcagcaggacatggccctggcacaggctgggctgctggggtgcacgtcctgcttgatactacccaacaccaggccatgggggcttcgaagtctggcggagtcaaaggaatgagaaaagacaggttaagagtacataagttgggtccagggggccaatgctggtatggaagctgcaaaggcctcgagctctgggagcccacactatttattggtgatcaaacaaagaagcaggtggtgaggacaggccacgaggggctttatgtcatgagccctggattccatcaaagccacgagaggttttatgctctgggcttagatttgtggtgcggcagggcagccttccaccctttggcacagagcttggcgttccaaaggccacgaggagttttagaccctggaccctggacattttccaagactcttttatattatgacagacaagccagttctgccttagttcttctaccaacaagcatatatacatgaaggccagcaataaggactggaggtatgcactaggcaggcagacacatgagcagggctcttaccatagcttggatatcagatccctgagttattttggtgctaagaacaatcttgtcctatcagggtgtccctcagtgaccttaccttctaggtcttcatataggcaactaagtgaattatat

SEQ ID NO: 468972 - DNA, 681 bp, Homo sapiens
ccagcagacaatgacatttaattctgaattcaaaggtacctcttttttgctggagtccttggctggactggcctggtgcttggagcttgagtcctctgaagcgggactggagcttgaatccatgtggttgatcagtgtggagcttggcactactggtgctagtctggtgcctaaggccttgggatcagcatggagcctggggccatgggggctggcctggcactggggcagcttgaaacctggccagcatggtgcatggggccatggggacctagagccttggttcaaggacaaagctggtgctgggacaggcttataccctgggtccatgtcgagggggcggtcacttagtgacagggttcatgagggcaggcctggtgctggggtccatggcaaagatgagtgctcacttcactctccttcccccacacagaaggtatctcccttcactctgtgagcatgggcttagggaaggggtaatgtgagaaactgtctttcctactctcttcagagcatgttttcttatttctgtgctctgctctggtgctgtggtctgtcacctgcattccttagctcttgtgaaggtgtttctgagcatgaatagttgtttgaatttacctttctatgagggttgagcattggaaactcctattccatcatcctgctgatgttactctggaa

SEQ ID NO: 468973 - DNA, 752 bp, Homo sapiens
ccttgcaacactaggttgcaaaagcctggttacttataaatgggtaaagacaatgtggtgtgtatatatctgcaatggaatattattcagctctaaaaaagaaggaaatcctgtcatttgcagtaacatcatgaacttggagaatattatcctaagtgaaataggccagacacagaaagacaagtactgcatgatctcatttatacatggcacaattcttaaatgcagggatcttgtccacaacatagtgctagtacgaatgaatgtgatccttagaattatgaataaaccaaagcacacgtccatttggttgacgaagcatctaccatgtatgattgtaccaagcaacaccacttggattgaagcctgtctctactacttaactattaggttggtgcaaaattatggttttgcagttaaaagtaatggcctctgctcttcatcttcagtcggggataataatacattcctcagaggctcagctgtgaggtttaaatgagataactagaagtgtgtctggctagcactgtaaatgctcgatagtgctggttacttttattataggtcagctctcgtaggatatttacttctctttcagtgcatgtgttctggtttttattatagatttatctcattattgcttaatacctgtcaccccaactagactatatgatgcatgaggatgttgacctatttgtctcattcactactgtaaacctcatcaactagcacatagcaggtactcaagaaac

SEQ ID NO: 468974 - DNA, 591 bp, Homo sapiens
ctgctggtttatgtgtccctggacccaaggggtggccacagggcagcagtttgctggggatgtgaaggagcttgcatgtgcaggatggcatatccacacaaatgcagttccccgcagccatttgagaatgttaaagaggatgtcagagattcccagggcttcatgcaaggtagcagagggctaaaggaaggggcaggggacatgaagatgtccaaagttgataagagggatgcccgacaagagacacaagaaggaagagcagcagctcacaatccccttggtcgagttgggacagcccgggagtttgaaatggacattcagaaccataggcttaaactagaccgaaatgagtttcaattgcctgatgtaaacctctatccattgtcactgtatctccacaacccatctgacaccagtggactgctaattgcattactttgcttgtcctctggccacagaggtggacatgtagttaagccttggccaaacatgactccccatctccttgtttacaacaattagtgtattgcgcagactaagatcaaagcaggccaatcagagtgccatcaagtgaattaatctatggttgct

SEQ ID NO: 468975 - DNA, 752 bp, Homo sapiens
gatttgtgcgaagcgctggtttaaagtagactggattcacactgcaaggtttgcatcctggtcctgatgcttattagctgtgtggaggcagatcatttaactgctccatgcctcagcttctttctttatcaaatggcaataattttaggacttaccccaccggttcagaaaccaggccccttgccccacatctgtgtcctctcctcatgccggtatattgtgggctatggggatggtgtcgccattgtggggttgaaccacttggcctacacagctgtacacagcacatctgccctctatgtgttcagggcatcaggatcctgctgccttcatgcaggctatggagggagagggaggcttgccgtctacactcacagaatcttaatatctttggattttgcttcaggtcagaagctgattcagtataggctccaggagctggcatttgaatacgtaccccaaaggcttctcctgaagaacattcactctgagaaacaccgccgtataatgtagattaaggtgtatacccaagataaatgaaaacatatgtccacaaaaaacccactttgtacacaaatgtttatcgcaacattattcacaatagtaaaacaacccaaatgcacaactgaagaatggataatgaaatgaggtatcttcatgcaatggaatatttttcagcaataaagagaaatgaaatacgatacatactacaaaatggatgaaacttgaaaacttgaggttaagtgaaagaa

SEQ ID NO: 468976 - DNA, 735 bp, Homo sapiens
ataagggggcggcttgtttctcattggacaatcttttttaaagtgtccttggtttgcgggtcaaattggtcccagtggcttaggatgcatttcaagggtgggcctgttgatgcctgagtgtttcccatctgaaagaaaaaaacgcccatggttttggtttgtttggtttctccccctgactaagaacccgcaacagtccctggaccctgctgatcggaatagttgcactcaccgatgaagcagcagaaacacctcttgcccaagaacccgcaacggtccctggaccctgctgatcggaatagacagaatagcaagcgaaaggggtccaatggtgctcaccacttggcgatagtcaatagtccctttgtggttgccaaaatgtgtctggaattggttccttctggtgggttcttggtctcgctgacttcaagaatgaagccgcggaacctcacagttcgtggtctcactgacttcaggaatgaagccgcagaccctcttgctagacacagagccctgattggtgcgttttcacagagtgctgactggtgcgtttacaaacctttatctagacagaaaagttctccaagtccccactcgacccaggaagtccagctggcttcacctctcatccccccttcagagaaccaattgttagacattcatcagcatattactgtcttaatcactattgataactaatttgtccctgaaacaagacaagtattttagtacaga

SEQ ID NO: 468977 - DNA, 576 bp, Homo sapiens
aggcacatagagggtaagtacgcatgaccttgcctatgaattgctgcaaatgttttcacagcccgtctttcaaaacaaaagactataatttcatcaaagctgtttgctttgcccttggtcggcttctcagaataatcacctctacagtctgcaacgtgtcttggaaatgtgggctttcccggggttgtaaagcgttacagctactgctagaaggaggcttttcagggcatgccattctgcacatggtttctgagacttttaaatcggagagggagctcaaagaccacgaaatcatacctgttaactttacaggtgaggaaaggaaggctcagaggcactgtggggagccgctgaaagattttaaacagggatgggccaacggggctctctgtaagtctctcctgttcaattcaatgattaaatctatgggtgatacaaagcaagagttgaagagactgctagagcggaaaattggtggagaggagacaaaccacaactcacgtaacagctcagtgtttgtggacaagttctaatatggctttaaatatctgagaatgttaagacaacagttttatg

SEQ ID NO: 468978 - DNA, 957 bp, Homo sapiens
gcagttgctagtgggagtcacaaactatacttatggtcaaaaagaattcacaaagtgctgatgtattatggaaacaggatgtggcgtccccaagccctggttgcagatgaggagatactttttatcgatgagcaaagaaagtggtttcttgagatgaagtctgtctctggtgaagatgctatgaacattactgaaatgacaacaaaaaatttagaatattacataaacttagttgataaagtaacagcagggtttgataggattgactcccattttgaaagttatactgtgggaccatcagccaaatgggaggtccagtgctcagaaggacctaacaattccactggaggaaatgctcaaagttggggagaactatcattgggcccctgctggtaccttagctccaagttcagccaattccttcagggctctgagtcttctctgaggcctgatgttaggtgccaaattattgtaagtgaaagagccaaactctgtaaattatttgaagagatttattctgagccaaatgagtgaccaatggcccatgacacagccctcaggagatcctgagaacatgtgcccaaagtggttgggctacaacttggttttatacatttcagggagacataagacatcaatcaatacatgtaagatgtacattgtttcagccacaaaggcgggacaactgaaagcaggtatggggggtgagaggacttccaggtcataggcagattcaaagattttctgattggcaattgattattgtctaaagacctggtattgatagaaaggaatgtctgggttatgataaggagttgtggagaccaggttgtaaactcatttgcatttgcaaactgaaattagtgtttcaagttagaattccatctaccctggttgcagaagacttaagatgtttttatgccctcagccttttcttcatctgtaaatgacggacca

SEQ ID NO: 468979 - DNA, 508 bp, Homo sapiens
ggcctaaaggtttctcttacctagtgaactgtaacctaactggatgtgtgaacagactgtggaacagaaaccagagtctttggtggcagctcttgggccagaccctaatgctcctgatgggtgctgtagtatgcacgggcagcagagagctgtggagtttgacttcctgcctggaatcaggtcctttctaaggcctgagagtgaaaagggagctgcttggagagcccaggctgacccattcatggagggagccagggaagtggggcagaattggcatgccgtctcattcgttttgaaagaatattgtctatctgtctcccaagagaaatcttgtcagctgatcctggttagaggccatcccagacctaagggcaggaatatggtggccataaagaggatggagaaagttgctagactgaatcaactgtagactccagctccttatgaaaagtggaaagtacatgctgggttacaagctgaccctgaagatgatcagacaaggcaaaac

SEQ ID NO: 468980 - DNA, 731 bp, Homo sapiens
gaaaagtatggctggatattaggtacgggccgcagggtgcccataacttgcgctctttctgctgctcccagctcttggatacagccgatgacgccatgggtttcagagatctgaaaagcccggctagcctccaggtgctcaacgattacctggtggacaagagctacatcgaggtctatgaagcagtgtccggcccaccgcctgctgacttgtgtcatgccctatgttggtataatcagatcaagtcttatgaaaaggaaaaggccagcctgccaggagtgaagaaagctgtgggcaggtatggtcctgctaaggtggaagacactacaggaagtggagctacaaatagtaaagatgatgatgaaattgatctccttggatctgatgaggaggaaagtgaagaagcaaagagaagcattcaagcagatggcttagtctggggctcatctaaactagttccagtgggatacagatttaagaaacttcaaatacagtgtgtggttgaagatgataaatttggaacagatatgctggaggagcagatcgctgcttttcaggattatgtatagcccatggatgtggctgctttcaacaagatctaaattccattctggatcattgcacttaaataaaagcttgaaagattaaaaaaaatgtagagttagacaagctggaaatttgatctggttttagtcacttatgctgattgggtgactttgggcaaattcatc

SEQ ID NO: 468981 - DNA, 974 bp, Homo sapiens
tttctcatcagttacaaggtcctttcctatccttggaagccttaagtgagataatgcatgtaataattacatacatcttctttcctgagacatgttctcacagttcagttcctgctgttacggctttgtctgatgatgatgatgatgatgataacgatgatggttatgatgatagcaagcctttttgtgcaagcttagaaaaactccaggccgttttgtaccagttagaaaaaaactccctttccacacctctcctaaacacagtcaagactggactggaagttgctgtgggtgagtcagtgagtgagtggcaagtgaatgggaaggtcttggacatcactgcacactcctttatgtttgtatacccaagcacattgacgagtacctgggacatagtcaatgctcaatcaatgttaattgaacaaattgatatggattggtgtgcttgggactatagatttatctttgagactagttcctgaatgggagctagataagaaatgtgtgatatggaaatgaagtaagaaaaatgtgttgttttcccaattctgtttttcccatttgtctcttctgacattcttttcttccaaataagcaagattttattgcatttttctgattgcagaagcaatacattcgaagcatagtatttatatggactctggcatcaggcttgagttcaaattttgctatgtgtatcaattaataagcaaatagagagggctgtgtgcttgcacacagtgcttaacacctttatgtcttagttttctcatctgaaaagtggatggaagctattataatagtgcttacttctcaagattgttttcaagttagactgtgcatgtcagtgcacagtacagactttggttatggacttcttacaccatgcatgttagtgcacagtctaacttcaagtgcttggcacagtgattgctcaacaaatacttgcagctcttattgtgaagttcagtgcc

SEQ ID NO: 468982 - DNA, 574 bp, Homo sapiens
tttgaagagctcccctttttcccagggacccacagaactggcaagctgtggggaagcagggggatgcgcgtgtctgtatgtccagaactgtcatgtcttctcttgggtgccaccctcccaaatctcaaggtattcaccaacctggaagctcctccctcttcctataaggccaccaatcctgtcggcttagggctccactctgatgacctccttaaacctgaattacctcctaaaggccctgcctccaaatacagcccaagcttggaagtcccaagatgtccctgctactatatcctattggtcaaagcagtcacagggccagcccagagaaggggtggacatgttccacctcttgatgtgagaatggcatgcacatacagggtgaaggggaattgctgggggccatctttggaggatagcaaccatagaagcttcctggaagttgccataggccacccctgcttacctcccatcagccagaactaagtcatatggccatacttagctacaagggagactgggagatatagtttttaaactgagcaaccatatgcctacataaaaactgtgggtt

SEQ ID NO: 468983 - DNA, 661 bp, Homo sapiens
gagttaatgggtgcagcacaccaacatggcacatgtatacatatgtaacaaacctgcacaagaagacaggaagatgagggaaactttggaacttcttagagattggttaaatggttgtgaccaaaatactgatagaaatattgacaatgaagggcaggctgacaaagtctcagatgagaaagttactggtaactggagcaaaggtcacccttgttatgccttgacaaagagctcggctgtattatgtttgggtcctagggatctgtggaattttgaacttagaagtgatgacctaggatatctggcagaagaaatttctaaacagcaaagtgttcaagatgtgacctggctgcttctaacagcctataatcagtcatgggagaaaccatcaaacagctttccaaagatggatttttacactcccttttacactcccatcagcaatgtatgagagttccaatgtccctatatcatcaccaacaccatcaattgtaattgtcatattaaaacattttagttattctaatggttatattgatacttcattgtggttttttaattttaacattcaaaattgtttcatttattattttactgccatacatgattaaatttcagtttaaattattcacttcctgtaatttttaaagataaacctttt

SEQ ID NO: 468984 - DNA, 937 bp, Homo sapiens
cagcagtgggctgaagggctcctcaagcgccgccagagtgggcgctgaggacgaggaggtgccaagagcgagcgagggctgcgagggctgccagcacgctctcacctctcaatggttgaggccttgacacatccacctctgtcccctcctcccagccttttgggttccagcagcagccgctccccacgatgctctctgctggtcaactgagatcagaaacatgcaaaatgctcagaagtaagcgaagaatcagggcagttgagttgctgcaggcagcaaaacccactcttggcaggaaggggtgtggcagcctggccttgctgtgcaagcccccgcgtgtggcagcgaacactcaggagcaatacctgttggagaaagtctatgctgaggagatgtcagagccacaggacagtcctgaaaatcaggtgccactcagaggcaattgccatccactaccagaagagggcactgtagtgcagcggcccgggagggagcagctgcagccgatgaagactattcctgcatccgtggctgtggccctcttacccgctgtcctggtattacccttggacttgtttctggagctggtgggggcaggatagcctcgtggctagaaacttaggctctgcagctagaccacctgggtgtgtgacttggggcaaagcacttaaacttattgcctcagttcctcacctggaaaatgaggtgattataatagtacctacctcatagagtattcgtgagaagtaaatctataaagtgcttacagcattattatcagtccagtcttaaacatgtttgcctctctcctattcatgaaaacaaaaaagcaaaaaaacaaaaaaaacaacaaaaaaagaaaagctccagtgccatctcaccccttaccttccctccacagacaaaccttccaaggagtcacctgtccttgtctgct

SEQ ID NO: 468985 - DNA, 1239 bp, Homo sapiens
ggagccagcgcctgggcctggaaccgggccgcagtcccacagcttcgacaaccacctccctaccatggacccccacaaagtgaacgagctttgggcctttgtgaaaatgtgtaagcaggatccgagcattctgcacaccgaggaaatgcatttcctgagggagtgggtggagagcacggtgggtaaagtaccacctgctactcagaaagctaaatcagaagaaaataccaaggaagaaaaacctgatagtaagagggtggaggaagacttaaaggcagacgaacaatcaagtgagaaaagtgatctagaaattgataaagaagagataatggaggagatgatggatcaggcaaatgataagaaagtggctgctattgaaaccctaaatgatggtgaactccagaaagccactgacttattcacagatgccatcaagctgaatcctcgcttggccattttgtatgccaagagggccagtgtcttcgtcaaattacagaagccaaatgctgccattcgagactgtgacagagccattgaaataaatcctgattcagctcagccttacaagtggcgagggaaagcacacagacttctaggccactgggaagaagcagcccatgatcttgcccttgcctgtaaattggattatgatgaagatgttagtgcaatgctgaaagaagttcaacctagggcacagaaaattgaagaacatcggagaaagtatgagcgaaaacgtgaagagcgagagatcaaagaaagaatagaacgatatggctcttttctgggtggctttcctgggggaatgcctgctaattttcccagaggaatgcctggaatgggagggggcatgcctggaatggccggaatgcctggactcaatgaaattcttagtgatccagaggttcttgcagccatgcaggatccagaagttctggtggccttccaggatgtggctcagaacccagcaaatatgtcaaaataccagagcaacccaaaggttatgaatctcatcagtaaattgtcagtcaaatttggaggtcaagtgaattacaaactctaaatactttttaaatcttaaaaatatttaaaacaaatttaaaggatctgttaattcttatatttttctttactaattttggattttttttctttgaattattgggcagggaagatacttatgtatggaagattattgctctaatttgagtgaaataaaagttattcgtgtgaggcaaacat

SEQ ID NO: 468986 - DNA, 592 bp, Homo sapiens
aagaaactggcctcccacagtgaaatgatcaaggtttgtgtaagtgcactctatcatatatgcatggcgatgagtgtgccaaacgccccatttctcagaatgtatccccatcattaaacaacacgacagtatactcagccaggcaagctactgatgcagcgagaggcttgcaggaaccgagacttaaccccctgaccatcaaagtaacttcgagcaacttgcattctgcaatggttgaagaatgtagtgtgtggacgtctgagaggaggataagtggggcatcaaatcaagcccagatgtcagtctccccaactccagctgttggttgggacagaactcagaggaagagccctcagtgggggttcctaggagctgaacaaccctactgctggctacccgctgggcgtggctgcacttgtgtcagccccagtgtaagagcatctgcagaggcagctgaagcccagcaaggtcttttgtcccccactccctcaaagtcatcctaggacacaggtgtgcatccctcacagctgaccgactgaagatgaatcagcttccctgaaagacgtgacccacaggagtgtgtcagctgaaa

SEQ ID NO: 468987 - DNA, 1130 bp, Homo sapiens
gggtagtgtagcctcccagggtccctgacttggctccttgccttgcagccagttccctacctcggctttagttgacatggctatgcactgtgatactagtaccttttgggcaagggccacgtcatttcttccagagggatgggctcttctcattctatatctatataaccaaaagggacctttgaaaactccttccaaaaacagaacgatttcctggaacatgacttgctatcttccctctttaaagacagacactgttggcaaccagatagctaccacccttgctaaaaagaaaattgtaaagttctgcactctgatgtacatgcaaaatgccaagcactattattacatgacaggtcacaagtctgggccctatgggttgaatatggtggacagggccatgccatggtttggccagctgggctcaatccaaggcaaaggcaagttctggaagctgaagcctgagcctgaggatctagcttgccatcttctacgggcacagttcatggctcctgaaaacaattacaacagtaacatcaatgatcacggctcactgatcaccataacagatgtaatagtgaaaaagtttgcagtatttcaagaatttccaaaatgtggcatagagacacaaagtgagtccatcctgttggaaaaatgataccattagacttgctcgatgcaggtttgctacaaaccttcattttgtaaaaaacacagtatctgcgaaacaaagtaaaatgaagcacattaaaacaaggcatgtctgcaattgctatggcaaatgctatggtaactaatgatagcaataaaaaattattaatttcaaatacaaaataattcccatacctttcgaatagttaataaacgcagagatagcatgatactattatggatattttaaaaggagtaggctagctagataattttaaaaactaatagcctctttgagccaacaaatctttaaaaagtttgaataataatacatgacaggatgatagagaataatttagactagaacgctcatgcttgtagaattatttgtcacacctcttaaataaccgtaaagaacttacgatatttattttccatttaggccatgagtctttggagaaaatgttttatttggaagg

SEQ ID NO: 468988 - DNA, 446 bp, Homo sapiens
gatactaccttaacctaaaacttttagaatgttcaacttggacattgctgggaagagagcctcatcagtggggcagcccaatgcacttgagtttccttatccttttgacatgcgattgttgctggtccctggtgccctctgtgcccgtgggctgcacctagaagatgccattctcatcagcaaatggctagaagttcaaacttacatgagtcaacatttccaaggatttatagttgtaggcatttctattcctactgccgccaagttagggagtgagtttccggtttctggagttgttaaaacagccggcacatggctatttgttgaagataatggaaaagaagtcaagcatccggtgaacattggaggtcccttccgaataagtgtccaaaattctcaggggacgtcagatgctgtggtacctgtgctgtgctaggggcatatgt

SEQ ID NO: 468989 - DNA, 616 bp, Homo sapiens
tccatttcaatctggaaggagcctgatttcaacttgttataaaatggatctactagtccatgtctctctgatgcttaaacatctgtgtgcagcatttttaggaggcctctttcctctgcaaaataagaggcctctgctcttacattactttgggatatgtttggaattttacttattctccacaagatttaactgtagtacaagaatctgtaacaagcttgcttattttgtttcccagtttaaaggaaatgaaggagaattagaagagaaaaagaaatcaggaaaatgtcacgatgttatttatagcagtgggaagcctggactgcaggggccaaaagaagcagcagaaagacctgtgaagaggctcccacggtcttcacaaatgctagagataatggtgttagatgtgagaagagaaggagaagattaaaatagtctccctttcctgaacgttctgaagtctgggaggttcaagaatctcagcaaatcccagattttcttaaagggccagtcaatgtaaattaatgaatagtttttaaaaaatcttcaaagaaatataaagagtttttaaaagagagagcagaggcaagaatagcatattgatggtagacattgc

SEQ ID NO: 468990 - DNA, 1301 bp, Homo sapiens
ctgagtcatagagaggcaaaatggcaaggggagaaagagctgaaattgtggaaaaacagacacaattatccccagacactcttatcatgcaagtgactgacctgcaacaaaaggtgcatgcacagcttcgccaggtgtctactattaaagtgaggacattgattggaaaagaatgggaccctgcaacttggaatggggatgtgtgggatgaccctgatgaaggtgaggacactgagtttgtaaatgctgatgaatcttttttgccagaaggaacagcttccccatttccagtagtggcaacatcccctcccagacccatgctgccatcagccattccacctttgtctgaggagataagtgctggagacctccagcctttcaccacggtaactctgcattggggaaaaagaaatggtcggagatttcagggacttctggacactgactctgagccgatgttgacaccaggggacccaaaacatcattgtcatcctccagttaaaataggggcttatggaggtcagagagaacttgatcgcattttgcttccacaagatatcgtactggtccattacattgatgacattatgcttattggaaccagtgggcaagaagtagcaaacacactggacttattggaaccagcagatccaatggtgcctgacatgtcagtggaagatagaggtgctgtctggagcctttggcaggaccccataggtgaatcacagcagaggcctataggagtttggagcaaggccctgccatcttctgcagataactactctctttttgagagacagctcttggcctgttactgggctttggtggaaattgaacgtttgacaatgggtcatcaacctgcacccatggcctcatggggagttccctataatcagttgacagaggaagagaagactagagcctggttcacagatggttctgcacaatatgctgtcaccactggaatgtggacagctgcagcattacagcccctctccaggacattcctgaaggatagcagtgaagggaaatcttcccatcaacaggctaagaagggagttacagtgttggctgtggtgactgacctggactatcaagatgaaatcagtctactgttccacagtggaggtaaggaagagtatgcatggaatacaggagatccattagtgggaaactacaatagcccaatccaggcaggactacaaatggcccagactcttcaggaatgaaggtttgggtcactccaccaggaaagaagccacaacctgctgaggctttttgatgtaggtgtttagggctac

SEQ ID NO: 468991 - DNA, 636 bp, Homo sapiens
agaaacgggctgggctgacagtagatttaccctcacaagatgaatgaaatcccatgttattcacaaaacccagacatctgggcagtgtttgtctttaaatgtgaatgatctagaaccttcatctgctcctcaaattttaacatatatggaaatccctgggaatcctgtgaccaccacctactatgtgcccagtactgttgtcagtgccaagatacagaatcaaataaggcagatagcaggccactcccatgaaagtgatgttctaatgggaagagacagacaaaaagcacgtgaagaaggagatcatgtaacttcttactttgctctaaagcaaataaagcaggattgtgtgaaagcactgtgggtaagaggggaatcagcttcagattgtgtggtcatggagacactgaataatgggagagacaaggcaggcaaaggtgggaaagaatattccagagcagaggaggagattcggctgggcgggctgaaaagtgaggggcagaagcctggtcaaagaaattcacatgagctacgagaaggagcatgaatctcttccaggagtaatgagaagccacttgaaggtttaaagtagggaaggaatgtgatctgattttacttttagggcaatcactttgg

SEQ ID NO: 468992 - DNA, 553 bp, Homo sapiens
gcagcaattgcggtcctgagacttgttgaatgggttaaaccaaaatgctgatagggatatgggcaatgaagttccagctgtggtggtctcagatggaggtgaggaacttcttgggaactggagtaaaggtgactcttgctatgctttagcaaagagactggcagcattttgtccctgctctagagatctgtggaactttgaacttgagagaaattatctgaaattggaacttatgtttaaaagaaaagcagaccattcaagtttggaaaatttgcagcctgatgatgcaatagaaaagaaaaatccattttctggggagaaattcaagccttctgcagaaatttgcataaataacaaggagccacatgttaatcaccaagacaatggggaaaatgtttccagggtatgtcagagattttggcagcagctgctcccacaggcccagaggcctaggagtcaaaaatggtttcacgggccagctggctcctgtgtgcagtcttaggacttagtaccctgtgtccagctatggctaaaagtggccaaggtacagctc

SEQ ID NO: 468993 - DNA, 677 bp, Homo sapiens
aattgtcacagcagaaccacaagatgtgtgttagtgtgcctgttatacagatgaagaaactgaagtgtggagaagcgaaatccctcatgagtttatctagccaggagttgaacctaggtctgcccaaagctttgttagctggagatggtggccttggtgcaaatgccacagtgattctaaaggcacacagctgctggctgtcagtcaattgcacccttggccaatgctctctgaaaagaagagctgagcagtgcacctgcatgagaaccacgtggacgaagccaatgctttggactcagaaagacctgacttaccagccacgggttcacagtgacccctacaggggttgttacctgggaggtgtatttctcaataccgaggcgaatgcactagatgccatcacaggctcatctataggagccaacgggtatgtggtgggaattgaacaatgagaacacatggacacaggaagaggaacatcacactctggggactgttgtggggtggggggaggggggagggatagcattggaagatatacctaatgctagatgacgagttagtgggtgcagcgcaccagcatggcacatgtatacatatgtaactaacctgcacaatgtgcacatgtaccctaaaacttaaagtataataataaaaaaaaaaaaaaaaaaaaagaa

SEQ ID NO: 468994 - DNA, 2448 bp, Homo sapiens
ccgatcgaaggaggaagcctcttataaaaccataagatcaaatgagaactcactcactatcatgagaacagcatggggaaaattgcccccatgattcaattatctccacctggtccccgccttgacatgtggggattattacaattcaaggtgagatttggggaattagtggacagtcttcccttcttgacactcaagactgtgtatgactatgaaccacaatctgaagtcttagatgaagcaatgggacaaaccaacaagctcaaaatgggcatctattggcatggacagctactgatagatactctacaactgtgcttagatttaaaggatcttgatggaaaagagtgtgcggtattcttcatcacagctaccagcatgggatgtacccagcaacttgatgtgaccctcacagaaattgaaatgacactctcagaagtccattatttttcacttcaccagctcatgctaccacatctagactcaaatgaagctccaatcctcggtacacgagattcagcatcccgactggatgtggaggggccagatgacccaccttagaaaagagggaggtctctgtgggtgaactttggccagtgagaggacagcatgtaacatacaacctttattgtttcccattctttttgctttgcttcatttcttcttttctctcattgacttgggtttgtacttctccaataaagcctccacactttaatcattttattaggccctattttttttttaaagtactcaaggttaagatgctttccctcctgggtatgtgtatatgtgttacaatttttggttaattcaaaaatcagaacttaaatgatcatgatgatatatatgctacatatcccagcaaaaccagtaagcatgattttaaatttgtttcctaaaactttggtgtttttggagtttaagattgcatggattttttttgtgcatttatgtcctatgccagtaaagaaattttctcaaagtacaaaagtactcttaatgtggccaaaagtgttaggtaatataacagtttttcttcagtctttgacattcctgctgtagtcttgtgttctctcattccaattttaactggttgttccttagacctgatattcaatactatcctttaaattctttttgtatctttcctctgtgttatctatttcccaaatccaataccttccttcttcttggtttgctatgtcatgttgataaagcatatcctccagtagctttctgagataaggtgtatgggtaggcaatatttaaaaaaccttaaacatctgagaagctctttatttaaccttcatatttaagtgatagtttatttgaatatagaattttttgatcgaaataaattcttaccagaattttaaaggcactgtgcatttccctgcctcaccccagtatattgcatcgttactgagaaatttaatgccaatctaatcccaagttctttgtgtattaccagttattttctcacaggaatttttagtgcctttaaaaaaatctctaacattctgcatttcataatgttgtgtattggtgtgggtcttatttaacaacagaacatcaggtgccaatttttaactcaggtccataagttttaagaaaaaatttaaaattatctctttaattattttctgctatctattttcttgattatttatttcacccctaaatgtcttggttatgtttgtgcattcttccatgctctggggatatagcagtgaacacaattaacacaaagatgaaaaacatcatgccctcatgtacattctgatctcatgtacattctgatagtagagatagataaataagtgaaacaaaagtctgttaggtaatgataagtgctatggaaaaaaataagggcaacaaggaggttataatatggtgtgtatatgtgcatgtgtgtgtgtgtgtgtgtgtgtgtgtgttgtgggggaggaggaagggagggagagagagagagagagaaaaagcgagagagagagagcgagagagagagagcaatttaaaaaatggtggccagaagaggcttcactgagaaagtgaggtgaattgttgtgcagttctttaaggatgaactgaatggctggtatcattgcttgcaaaagagtcttgaacttgatggaaaataaagtttgaaaataaagttgaaaaataaagtttgtacttttactttttatcctttaattccatttttcatgaactgaaaagtccccttatatttgactgctaatttaactagatatagagctatcagtttaaaattattttttctgacattaaagctatatttttcattgtgactactggttttaactaagctttattaactgttcactttttaatttctttacttttactaacttttcggcgattctctacgagtccgccctgcagccatcgcccgctgtcgccctcgtccgtcctcttatccat

SEQ ID NO: 468995 - DNA, 1024 bp, Homo sapiens
agtctgaaatgatatgttgaagatgtgggaaagtttggaacttctgagaaacttgttgaatggttttaaccaaaatgctgataatgaggtggatgatgaaatccaggctgaggtggtctcagatggacatgaggaacttcatgggaactggagcaaaagtcatttttactatgctttagcaaagaacttggtaccctgtgtcccaggtgcttcacctccagccatggctagaaggggccaaggtacaacttgggctgttgcttcagaggctgcaagccccaagccttggcagcttccatgtggtgttggacctgcaggtgcacagaagttaataatcgagatgaaaattaaaatagaaactatcagagaaagaaatgcagcatttgaagtgattaaatgtaagctattatccagtagtgttcatgaaaatatgcaaagtttacctttagatattggctttagaagatctctcctgctgaactgtggactgtgatcagacacaggccccagtgagctgtctactgtgtgagcattttgtttgatgggaggaattgaagaagtatgctcagtttgaaaacgagtcttaaggtacaaggctttgagtcgtgacatctcaaacatatctccatggacaaaaatattctttgaaaattaattgaagacgctcagctccatgcttggatatatgcttccaaaacagctacagccttcagtgatgttctttcatgtagtcagaataaaactgtttttggcagggagaggatgctagaaatggcaggtcacaggaaggtaagcaaataaggaaggcctaaggacaggacacatgatttgggtctttgaagttgatacttttatgtcaaatttagctttgggatacaagtgaactgacataactaattgccttagttgccgaaaatgtggctttaaagcaggaaaatatcagttactgtttaagtcaaattatactatgaaagctttgcacttacaaaatgatttcacatgcattgtctccactgattctcct

SEQ ID NO: 468996 - DNA, 818 bp, Homo sapiens
tcacacatccagcataccctaagaagatgacactgcctcttagtgctcacaaaaggagtgcaagttatatgaacctcaactatcctttctatccaactggaactgtatctgtctgtttttcccccttctgctccgtcttagaagaaaagttcatcaatacttttgggaaaaagaagcaggagggaccctcatccaaatttgatttggatgtcaaaactgatgatgccacacatccacctcacataggcaggctgtcccaccgagtaatcggctctcagcagaaaggaggccctggagagggtggcctctctctgccagctggtcatcctgtcacctctgcagctcttagcagagagggtagctcctcggtgcatctggtcacctcatatcccgctatcagcagagacagtagctcatctctacagaatggtcatgccatcatctctctattctctgccctgctctggctgagcctggggtttttatggacctcagaggggaggaagtgcacagcaactggtccatgggcaaccatggatgggccagaaaaggcaccacaggtccccactctggtacgtgggtctggaagccctgccctcagcctttgggacctccctggtctgaaggtggagccttatggaggacccatctccttctgcccaggaatctgtctgcctcctgctgctgttcatggctgcctagactcagccccaacgttgttccaagattggagccagcaccaacagcagggaaaaactaggcagcaggacaggttctttggagcctgcaagggcagggggccttcctaggcccacaat

SEQ ID NO: 468997 - DNA, 500 bp, Homo sapiens
tcctgacattgccatggcatttgtgaactgtcatgacgctggagggatctttaggaggattaatgtacaattcaaaagttctctgagaaaaagaaggagagggcagtctcttcccttattttcaacacggagaattaagcctcttatttttaataggtatttgtcctttcagggacaatggacagggagctgggagaattctccatgttacaaatatatcttaaattgtacttggtattttaacttgaatgcagacagccaagccctcactcaagatggagttgctctggttcgagcacttctgaaaatttcacatttaaatgtttatcagtcgatgcttagcaaatatttttcaagcaccagctgcactcctggagctggggataaggtggtagaagagacaaagtggaggcctcctggaactcacattctaaagcagagctgtccaatgtaagccacgtctgcaagaaggaggtctgctttggaaaggggctgttatc

SEQ ID NO: 468998 - DNA, 1977 bp, Homo sapiens
ttctgagcttcatggaatacctgagaattctccaggctccagaatgagtttgaggaaaggaattgcctgtactgacctacccctattaaaaacagaaattggggtctgttataccaaagtccctaaggagacaagctccagaagctataatactcatgactggcatggctcatgtggaaaggacttaggagttccgaggagagagagtgtgagaggatggaagaagccacccggagacactgggtgtaaaagatatggttacatctcttccctgctacataaacccctgattttagttggtcagggagagggaattgagactgagctcccatctcctccactgcagcatctgaataaagccttctttcctgacaatacacatggtctcagtgattgcctttctgtgcaacagacgcagttaccacccaacactggcagcccctctgtgctgagtgtggccctggactccagtctctggctccagctcaggagtgagtctcactggccaatcagagcaccctatctccctgaacatggtgattggttcagggatggtcatgtgaccaaagctgagccaaaaagatttcatccaggaatgtttgctaaaactgtgggtggagactaaatatatcagaccccccaaaaaattctgaaacaaattattgttaactatagccaccctatttttatgcctgtatcaaagcatcacatgtacttccataaatatataagtattatgagtccataatacttaaattttttttaaatccctgatatagaaattttgagtattacatcagatgctcatcctgataatatttaaaggggtgggaagtttcatatatattttcaatcaagtcctttatcatacacctgtttaataaatattttgtcctagtcagtatcatttcaacattctttcaacagaatctttagaaaagaagaagttttaaaatttaatgaagtccaatctgtattttttatattttggtgtcatatgtaaaaaaaatctttgcctaacctaaagacattttcttatgtttccttctggaagttttatatttctacattgtaaacttaggtctaggatccattttgaatttttataaggtgtaaaataagggttaaggtacatttctttctatgaatgtttatttattctacaaccatttgttgaaaagaccattctttatactttgaattgcatttgaagctttgacaaaaatcaatttatcatacatgtgttgtaatttttttttatcatgaacagattgttttttcaatctgtttgggtaatcaaatgcttttttcttttttggtgtgataaattacaataattgatttttgagtactaaaacaaccctttactcttgggtatagccaacgtggtcatgatgtattaccatttttgtatattcctgaattctatggatcacaattttggtgagggttttttgcttctgtgttcatgagggacgatgaggtttgcataatttcccaaaatatggtttatcatgctgaatacttcacttgcacctgaaaaaaaaatgaatagctgttgttgagtgaaatgttagataaatatcaattgcatcaaggtggttgatagcattgctcaataattattaataattgtaaatcgttactaatttcctatctactttttctttcaataactgaaagaggagtattaaattgcaagtatagctgtggactttgcatttctccaattattgctcttttcagttctattactggtgctttatatgtttggaaagtcagtttttaggaacgtgctcatttaagatcgttacatcctcttggtgaatacactcctttcatccccaaggcttctgtttccattattttccagtcatcaatactcgataatgggcaggttttcttcaatcggctcacactccagttttcatcagcagaagccatttttctctggccatacacagttgtgtgaataat

SEQ ID NO: 468999 - DNA, 714 bp, Homo sapiens
acaaggactcctgtggctctccactactcttatttctgccacctggacctttgacaagatgtggccaactctctgggccttaatatctccagaagtcagtatccgagagaaggcaaatgccttccctgagtacagacctcccacccctgaagtcttaacccctagaagatccctggggctgcagggggaaaagcctgagggagcagaattgaaggggtcagcccagatggcactggtgatctggggaaagtgtcctgtgcatgataaggtgctgatcagcattccaggactctgcccaccagctgccagtagcaccccctgtccaagtgtgacaatcaacaataaatgtctccagacactgcccctggggaaggtggagagcaaaatcacctccagtgatttattgaacagagataagggtgatggagagtgtgtgcctctggaactagcgggaagctcagtattggcctgggtggcccaaggcagctccggaagacactgggaacctcatcagtgctccctagatacaaagggattagaggacaagccatctttcaaatgaaattgaacataagctcctttcaattatttgtccctctgtttaaaaagggatgcctagttgacctaccttggcggaggtaaccaccggaatagatcatgtctaacatgaaagaggtaggtgtgtgcacatgtgtatgtttatatatgtatatt

SEQ ID NO: 469000 - DNA, 791 bp, Homo sapiens
ctctcgcttaaagaatagctatgctcgaggcatgggtgtaagcagggatgagcagtttgaagtgggatttggagcacggacttggtttacggcagatctggattcaggagttactcctcagcccggctgcggggcgggaattgacgtcaccgacgtgctgggtgttggtggaggctgcacgtgtgatccactagggggcactgagtgtcctcgaaggtcaatggaaacgcctttaaaacacgtgggtgccaaggacatggatgaagctggaaaccatcattctcagcaaactaacaaaagcacggaaaaccaaacactgcatgttctcactcataagtgggagttgaacaatgagaacaaatggacacagggaggggaacatcacacgcaccggggcctatcagggagtgggagggatagcattaggagaaatacctaatgtagatgacgggttgatggatgcagcaaaccatcatggcacgtgtatacctatgtaacaaaccttaatgttcggcacttgtatcccagaacttaaagtataacaaaaaaaaatttaagtttctattatgtatagagtataggcaggacctgtgagtagcttctaaccaactatatatacgagtacaaataaatctgggtaaatctatatacatacagatttatgttttatgtcagctttactaaagtatagctcacaagcaattaaaaaaaaaaactttacttgtccatagcccttttgcatgtcaggcatctggttgtaccctaatgggtgaggagagaggctgtttcaa

SEQ ID NO: 469001 - DNA, 611 bp, Homo sapiens
cagaaaatggaacgagctaccagttatgtttgctcaaggccctggggctctacaatcagcaggtggcaaagtcagccaggttggtgcccttcccttcagggtggtgagtttcctcaggatctgggtaggtccagaggtgctgtctgggagccagggactagattcaaaaaccttggaagtctacctggtgttctattgcattgtagctaagatggcactcaaaccactagacgcagtccttccccctcttccttcgcctttccaaatgcagagaagcctcaccctggggccaccaccaccacaggcctacagagtactgccagactactgccaatgttcccttaaggatattgccgctggtttttcgggacccaaggattcttcagctactgccccagctggtatctcagtaggtcacgtgcccccaggtccactggccctgggcccagttcagcactaggacttgcctaggtgttgtaatccttgtggactagactgcctttcaagtttatttaggaacacagagcactttagcccacagtgggctggatttatttatttaatttatttatttatactttaaactctggggtacatgtgcagaatgtgca

SEQ ID NO: 469002 - DNA, 693 bp, Homo sapiens
aaatcatggaatctttcagcttcagttccctcatttgtaaaatgaggataaaaatagtgcggatctctctgagtttattctattttgagttcgctgaactcttggacgtgcagattaatgtttttaataaaatctgggacacctttgccattaattactcaaatattgtttcttcctttttctctgcctccttttcttctgggactgcaattgtgcttatgctggcagctaaaagtcaaacagttgcctggcaagtatctctagggaaagagctttccatactgggtgaactgagagtgaagccaaataccgacaaccttgcaagtgggttttttcagggaaccattagacaagacaccgaggttttgaacactgccattctcactggaaagcctgtttcagttcctgtcaaagtcgtgggggtccaggaggatggttctgtggtcgatgtgtctgagtctgtggaatgcaagtctgccgatgaagatgtcattaagcaatccaaataagaccttctcattttttgcaaactcactgtgcctaataatattatttactcaatatattttctttaaatgccttgcttctttcgggtagccagttagctcagtgggttagagtgtggtgctaataaatgcattactttttcaaacttaaaaactaatttagcttcattataagacaataaagtcc

SEQ ID NO: 469003 - DNA, 565 bp, Homo sapiens
ggctggaatatggttgatgggaaatggcaggggtgcagggtacaaagcaggtcagcagttgtctacctgccctgtgcaacatgtcaccaagggccacatgtggctgggtaaatggatccttctatgagatcttgcaagtggactttggaattgataatagcagtgacctggctggggcccagcagattacctggcaggtggagtacccgattgaggactccatgagtgagctggtcgtctccgagatcttcgtcagccagacaaccttcgtgggcatcgtccctcttgccatgcaagtcatggaaagatcagtggcaattaatgctggactgcccctgcatgaagccctgcgatttccagggattcccgatttccctgagtgtgagcaaataaaggctccttcctgcagcccgagccagcgctcagcgcagcccgtgacccctggcacctgacaacctgcttcagccaaaatcttaataggctttattatttttatttaagatgatgcatgctcattataacatttttaaacaatatatggaaaaatcagaatctcagcaccccc

SEQ ID NO: 469004 - DNA, 2682 bp, Homo sapiens
ggaataaggctgaattggaaaaattggtttttatcacatggccatcattaaccaaacttccttcaaagccgcagctcaccaagggtttcctccatggccatgatgttcactgcatctgcagacaatgctgcctgtgtgccattggcatattcaattcaaattacttctgcaagagctgagaaccctctacctaccttcactgtctcagatatggcttcctgtacaccagagaacccactgtggagtggaatattctgctatgatttgccgctggcccatgtgagcctaattgagcttggtccattagtcaagtatgggccaacccactggctcgatggatcgataggcgtttgtttgtttgattccacccagccgtgcaccctggcaagggcagaaaacagcatcaaaggtattactggaaaaggggaaaatttaatcaaggaggatcaatactgcttatgtggagtgaaagtggcccatgtcatggggatctgggtttctggggaaggaatttcccaggaatcttcttgtggccaaccctaacgagaaacacacatgaaaggggatatggggaaatgtagttcagaggagccaagtggttccctgcagagtggagacagaggatgcagggggtgaatctggaaggtagcttggggtcacaccagagggaacgtcgactacccagcatgttagtttttctccactggccctcacttccactcaccttcctctcttttcttccctgctgtgtgcttggggtgggggtggttcataccaatccatggcttcacctgggttctcttgctgctggcttctggctgggcgctgccagtgcactggcattgatgggagaccagagggcaggcaggaggagggggaggtagagtgagcccctccttctgcttctctgcatgcacatgagcacagaagagaggcagcaggaaggatgtaccctacctccccctcctccctgggaatggccgtgtccctcctctccgtcctccctggaaatggccgcatccctcctccccgtcctccctggaaatggatgcgtccctcctccccctcctccctggaaatggccatgtccctcctcctcctccctggaaatggccatgttcctcctccccctcctccctggaaatggccgcatccctcctccctcttctccctggaaatggatgcgtccctcctctccctcctccctgaaaatggatgcgtccctcctccccctcctccctggaaatggatgcgtccctcctctccttcctccctgaaaatggccgcatccctcctccccctcctccctggaaatggatgcatcccctcctctccttcctccctggaaatgaccgcgtccctcctccccctcctccctggaaatggatgcgtcccctcctctccctcctccctggaaatggccgtgtccctcttccccctcctccctggaaatggctgcatccctcctccccctcctccctggaaatggccacgcccctcctccccctcctcactggaaaaggatgcgtccctccgccccctcctccctggaaatgggcacctccctcctcccctaaaatggatgcatgcctcctccccctcctccctggaaatggccgtgtccctcctccccctcctccccaaaaatggatgcgtccctcctccccctcttccctggaaatggccatgtccctgctccccctcctccctggaaatggctgtgtccctcctccctctcctccctggaagaaatggatgcgtccctcctccccctcctccctgaaaatggccgcgtccctcctccccctcctccctgaaaatggccatgtccctcatccttggaaatggatgtgtccctcctccccttcctccctgaaaatggctgggtccctcctccccctcctccctggaaatggatgcgtcccctcctctccctcctccctggaaatggccgtgttcctcctccccctcttccccctcctccctggaaatggctgcatccctcctccccctcctccccctcctccctggaaatggccacgcccctcctccccctcctccctggaaaaggatgcgtccctctcccccctcctccctggaaatgggtgcgtccctcttccccctcttccctgaaaatggatgcgtccctcctccccctcctccctggaaatggctgtgtccctcctccctctcctccctggaagaaatggatgcgtccctcctccccctcctccctgaaaatggccgcgtccctcctccccctcctccctgaaaatggccgcatctctcctccccctcctccctgaaaatggccgtgtccctcttccccctactccctgaaaatggccgcgtccctcttccccctcctccctggcaatggccgcttccctcctccccctcctccctgaaaatggccgtgtccgtcctccccctcctccctgtaaatggctgcgtccctcctccccctcctccctgtaaatggctgcgtccctcctccccctcctccctggaaatggctgtgtccctcctccccctcttccctggaaatggccgtgtccctccaaggctgtagctcctgttggatggcccctcctccatggctccaggcctcaagggacttttgtgaccctatttcttccccttgacccttccaactcagggtgatagcagctttttgttgtt

SEQ ID NO: 469005 - DNA, 1085 bp, Homo sapiens
ctggtgtcttaaaaaagggagaaatttggacacagacatgcacacaggcagaacgtcgcatgaagaaggcagagggcgtgatgcatctacaaaccaaggaacttcgaagattgccagcaaccaccagaagcaaagggagacgcacaggacaggttctccctcacagctctcagaatggggagaccttgctaacaccttcatattggacttccaggctccagaacttcaagggaataaatttctgtggttaaagccactcaattggtggtactttgttacggcagccccaagaggccaatccacttgccttcatcttttttggtccacctccctggaacatagaactatggctgaactatttatagtcaagtggctggcatggttccagcccatcttctccaagtctcagaagcatctccccagaatacgcaagtcccttctgccacctgcaagtgtcctctctggatgccaggtgacttttgaccctcaagccaggtcatctctagagcacagtggctgcaccattttgcattcctaccagcgatgtaagagggtttccatttctccacatgctcatatggataaagaaaaacgtagcgtctccatatattgggatgttattcagccaagaaaaggaatgaagcagcaacacaggctacaacatggaagaaccttgaaaacatgacgctgagtgaaagaagccagacatcaagggccacatggtgtgtgattccatatatatgaaatgtccagaataagcaaatctatagagacggacagcagagtgccaggagcagggctaagggggagtggctgcttaatgaatatgggttttcctcttggggtgacgaaaacgttctggaggtgggtggtgatgactgcacagcattgtgaatgcacttaatgccgttgacttgcttgctttacaatggtcaattttgtgttctatttattttaccacaacaaaaaataaaacaacaaaaagggggagaagatttttctctgcaaaagtctcttgtaatgtgctttatggccactttaagggatattcaaaggctgtttctaatgtagtttttcaccttcca

SEQ ID NO: 469006 - DNA, 1139 bp, Homo sapiens
tggaagaagcatcgtgcacggagtcccatgaatcaattcagagctgatgaatgaggaagcccctgaggacgaggggacctgtgtcttagttttgggtcagaataaaagaaggaacaaaaatctcacagaagaaccctccgtgggagggaaaggagtggggtttggagtgaggggatctggtttcgaatcctggctctgccagaaccagctgtgtgaccttcagccggtcgtgcgctatcgggtgggagcgtctgatttgttcatctggatgttgagaacaacggtggcaggcctggccacacggctgcttggtgaaagaactctgtgggagagtgagaaaagctattatggtagcaaaattaaggcggcagcaggtgtgaagataacggcagtgagagtcagcagtgaggaccaatgggcagtccaggaggaaattgataatggcagcactcagacgtcggccaccctcacctgcatgggccatcgcccggacacgcagagcagaatccagccgagcttgaaccaggtcttcacgacggtcatctctgcatccagcgtcctgtgcttcagttcagcagatgtctatcaagtgccacccaccttctgagtcctgttttgggttctgggaaatcagctggaaacaaaaccatgaatgggccaagggaattccttgaatatatatatatatatatatatatatatatatgtatgtatgtgtatatatatatatgtatgtgtatatatatgtatgtgtatatatatgtatgtgtatatatatgtatgtgtatatatatgtatgtgtatatatatgtgtgtgtgtatatatatatatatatagagagagagagagagagagagagagagagagagagagaaagagagtgttagaatgtggcctgcaatgcccatggcttgctgcctagccaagggatggggcctgttgtttatgagcattacttttgctggttgggagcatttttagaatttcatttttgatatatcaacttgcttacttaacaagcagtgcattaaaaagcatgaaaactgacaagcactggctcatccgtccctttgatgggccggccttggtggaatcggcatctggtatctgttggtgtgatgcttggtgcacacatgtc

SEQ ID NO: 469007 - DNA, 956 bp, Homo sapiens
ttgggtttagccaaaggagctttttgcctgcccctgggattgcaatgtcagatcaatgttaagagatgtttttccagtggaaagaggtagaaataaggacacccattttgcactagttaggattgacattggtgatactttacacaaagtatttgaaattctgattgggttggaagtagaaaggcagctgggaggtaaaaagtcccctttcctgctacaaatgtgcagtggtcttgactgtgaccgaaggccacagggcctgatgggaatgaaggtgggctttaatccgataccttctgagaaaagggagatccatgtgaagacacaggaagatgatcatctgcaagccaaggagaggtctcggaagaaaccagccatgcaaacaccttcatcttggacttctggcctccagaactgtgagaaagtaaatttctgctgtttaaggcgcccccagtctacgacccactcagagaggctcgctgagagtggggccagcagcctgcgtttccccagtgctgctgctatgcaggtctgcaagctgctgtctgtgcactgcctctgaggcacagaacacctgtgcaggtgacctgcccactttgggctttcaaagtgttgggattaccggcatgaatcaccatgcctggctggtaaatatatcttgaagggtgattgtagaccctggcttcattctctttgttgatagttttgcatgcatttgtccatcctctactattacaagatatgcaatttcactttgcaatggatttgcattgcttttgcattgtatttatagttggcagtcagcagaatctgaccaatcaagatggcagagatgttgaagtggtgggcaggggtagatgctgctgtcatctaagggccatgtgtgggcagggactgacatctggaagagtccatttatcaacaagtggtttcttgttctgccaatttatccttcc

SEQ ID NO: 469008 - DNA, 1318 bp, Homo sapiens
tcaacttgtgttttgaacacagtatgtcaaattgcaaagtgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttagatatgtcacccatctggctcctgagggtatttgaattttgaaaccctgattcagtactgggataaaaaaggatgcaatgctaaaaagggagtttagattttcatctataaaggcaggcattgccaattcattatgcgtgtttgtgggagtcagaagtgaccagtgggtgcatcacagggagtgaaaccaccctccattatcgctggcattatggagtgaattagttacttcatgtaaagcacttacaagagtgcctggcacaccaattctcttttatgctataattaatatgtgttaattgatactgttaattcatacttttaaattatcatgtgtacttgtcccaggttctgcatttaccctttctatacattccctcactgtgtt

SEQ ID NO: 469009 - DNA, 508 bp, Homo sapiens
taattggaggttttgccgagattcggtaccaactctaggcagcagatgggaggctctttctttccttcttgctcagaagcctggtttgcaagaaggagcagatgttatgcacccattatctctctatttgcaattccagattcccaaacctctgagaaccacaatgtttttggtaaattttcagcagactcattgggtggtagaacctcacctgagctcatttataactttatttgttccacttaagaggaaggctcttgtctttgacttggaaccactggtgtgtggattcaaagatcctgccccaggctccgctgaaggtgctactgagattcagcgtatgcattggtcttgcctgtctaaatcagagaaattaggaactgagagttctggaaaagaggtgctggatctggatacatgcaatgtagaccaaagaagtggtagatttttctgactttgggggagagaaaccggaggtcctaactgttatgtgacatctctcaatttc

SEQ ID NO: 469010 - DNA, 1045 bp, Homo sapiens
aatataaaaattctagccaatgatagagggtcacggggtcacagacaacatacagagattctcctcactgccaccttacctacctgtgagctaccacatcctcagagcagagacctccttcttcctcaaggaagccaaccaggacctgctgcggaactccagcctgcaggcgagggtggagtccttctttacctacaaaaccaggcagcccccagtgctcaatgccagctatggacccttttctgtggagaaggttgtgcctctggacttgatgttgacttcaaactttttaggtccaaccaataagtttagttttgattggaaactaaaagcccacatcctgcgggacaaagtctacctgagccggcccaaagtgcaggttcttttccacatcatgggcagagactgggatgaccacggcgccggggagaagctgccatgcctgagggtctttgctttccgagaaaccagagaggtgcggggcagctgccggctgaagggggacctggggctgtgtgtggctgagctggagctcctgtccagctggttcagtgccccgacggtgggtgccgggaggaagaagtccatggaccagccggaggggacccctgtggagctctactacaccgtgcacccaggaaacgagcgaggggactgtgccgggggtgacttcaggaagggcaacgccatccgtccaggaaaggatgggctggaggaaaccacgtcccacctgcagaggatcggcaccgtcggcctttaccgggcccaggacagcgcccagctcagcgagctgcgtttggatggtaacgtggtcatctggctgccttccaggccagtcaagcagggagaggtggtcacggcctatgtcaccatctcgagcaattcctctgtggacctcttcatcttgagcgacgtcatgaactcttacatctttttatgagatttactgtacaagggattctcattgcatttgcattgtgaaccttggtggtcagtgagggacatgctgacatcatggtggggagggacaggtctcgctgtcagc

SEQ ID NO: 469011 - DNA, 1739 bp, Homo sapiens
gtctccacacacaaaaattgcctccgtctaagtgtgagggggtcctaccagcaacccctttgagccagcgagaaccaaatacttcgtgaggggctgttccaggggccatagcccagctctctgtgggagcactgtgatcaagaggtagccttcaccccaagttcagagtaggcagccggcttgggagatacaagccctgtccaccagcaactcatggagcagacagcacccacgtcactggtgtatgactctcacttgcggctgcggcaaatcagagccgcagatcaaatgatgctaaaatggatctttaacgtatcctgtataaagcagagtcatgattttatacatactgcagacaaagcccacgggctcaggtctcttatagcggccctcacatcagttgaaaacggaaacattttaggggcaaaaggaaatgtgatcatcatgtgccatgtatcaggctctgctctgtgcgaggactcggcgtttatgtctcgaatctttgcaatgatcctatcaggctctgtgcgaggactcggcgtttatgtcttaaatctttacaatgatcctatcaggctctgtgcgaggactcggcgattatgtctcaaatatttgcaatgatcctatcaggctctgtgcgaggactcggcgattatgtctcaaatatttgcaatgatcctatgcagcaggtctccttgcctccattccacagatgggaagagggaggctgagaccataaccaagtctccagtcacacaggatttcaacacagacccatgtaaattccaaagccgagctcttctcatcacgctgttgccatccgaatctgcaaaggggtatgacatcccataaagttctcgaatattttgagacaaagggacgaacaccaagacaggaggctggactttgacagacgtgaatgtgaagatcacaggtggccgtgaaggctttaggagcccggagaggaccacgtcctgcgtggcagaggcctttgcagggactctatttacatggcatttggcatgaggctcattatgtctcagtgtgcgcatctttgaagggagggttggtggatacttacttgaaagtagaaggtaaagtcccctcactaagccagcctttagtgccccactgtgggaggtggatttggagcggacagaatattcactcactgcatgaggcctgatgaagtggaacaaaaagtttctagaaatacatgtaaaaatcagaactgaacaagactgatccaaccctctgacttccagaagctttagtggagcctaggaatggagtccccaacacagtggcctcaccaaaggccataaaagagccatccgacccaccatcacgggcttgctttgctttgaatcctggaaactttgctgccagaccttgaacatgaaaacaaagatccctcccctaaatggggttcttaaaacctcttgacccttcttcatctgatagaaaccaaatggtacaaccctgcctgccgttgtcatcgaggctggggatggcacaactgctggaggagccacccctccagagcccctgccctgggagctcctacaacccacggtttcttctgcagggagggtgcgcccccagatcttttcccatcctgtggcccatgctcaccacctcccaaaccagtgacttatttgatccactttactctctaaattgtctcctttgtctgtcaagaaggagaaggtcagacttcagctcctctaatgattgac

SEQ ID NO: 469012 - DNA, 1062 bp, Homo sapiens
tttgatggttctctggatctccggtggccatctgacctctcaggaaacagggcatggaaatggcccttgtctcccaccctgttcatggcggctggtctagaccgtgctaactgctgtcagccggactttggagatgaaagaggtcagataataaaggacattatcagagctctggctttatacatggcaactttgcgtgaattagaaaaagctgatgcttctgcgcagaccaagaaggagacaataccccatcttccaggaagatctagccaccagccagggtgccccacttggcaaatggacatggggcatagttcatccccactagctaggagcttttatgaaggccacagtctgcatagcagcttgcagctcaggactaatttgtccccgctgctctgctttacagccggaagcaacgtccatttggtttgagtgtcagggaagccagatttgaagcaaggtagcgcagtggttatgactgccacctctgggaccaaacaaacatgcttgaatccagtctagctccgaaaaggtccagtcaatcttgggcactttacctacttaaactttctgggtcttcgtttctcccttcctaaagtagcgaagatgataagaaggtcctcctgggcttagtgaaagggttaattaatcgctccggttcctgacacatagtcatcactctggaaatgtttgctgttattacaatgatgaccatccttgatttagcaaaggagggtgggcatgaaggtgtaaggttctatgggggcatttcagtgtcctgagaaggtgtgagtggatggtggttatttgctgattttacttattggaatactggagagcacaatttcaggaacgcctacatcaaagcactaattggcacttttacagtgtctttctccgcacgtgagccttgctggtggaaggagctgtcatagtaatgcgtattcctccatgcccagtgagtagggtgacggtcaattcacagttcactaggcacaaaagatgacggggctctcctctgctcgggacagcaagaaggttgaggtgatacggtttgtc

SEQ ID NO: 469013 - DNA, 586 bp, Homo sapiens
gaatctcccaccccggaccccccagacccagagctgccccgcggatgaggagggggcccccagcacagtcaccctgtggaactggcatccaggagaggtgctccgctctgtgcgctccttcctcccggctgtgtgctccctgtccacagctccccatccacagcttcggcactgtggggctggtgctccaggagggaaggcccggttctttgcatcccctttccgcaaccgctagggtctctgtgcgggccctagaggaacgctcactcatcgcgcagctcaccagggaccccagcttggcagaaaccaggggctctctgcgggttctctcaaatgagtcctttgcggtgggggagcgcggatggggaggtgggtgcgtccctcgcgacgggaactacctcaccagcggtcctgtccggggctccttcacctcagtgtcctcttctctacaatgggaatcagtgttggccacggaatgaattaaatacaaccaaccagccaaaccttgggattgtcagtgctttaggggttttgggtttctgcctcttagtagttattgcaacttcttggaaatcattctattaaa

SEQ ID NO: 469014 - DNA, 965 bp, Homo sapiens
ctgcccccatcattggcacctggctgtctgatggttgcacaatgggagctgtgcctccaggtgttgcaccatctggactgatgactccgccttctaaatctagcttccgagaggttgtgggaaggagagagtctcagagggtccatggtgaaggggaaaggaagaagaatttaccccggtccccacctcccactcatcaaaggttcaccccttgtgtgttacccctggaacttcccaatgtgcatatagtcacaggtgagcaagtgacctacatggagccaaaagtcaatggctctggagctttgaatgctgagttgtatgtgatgggccagctggagccactgcctgactgcagagagagcctgagatacctggaaattgacatcctttctcggggggctcttgagcccttgatgggccttgctgaaagcccagatcccttgccttgagttgagttcaaatgtgaaatttaacttttcttccacatgtgaccatgagccaagggatgcgggtggcctctagaaaagactatatgaaaataaatgtgttgttttaagtcactaaatttgtgataatttgttgtagcatcaatatgacactaatacactggcttaagaaaataagaataatgtttattcaggaagcctgtgtcatgtgtgcaagtatttgtgcatgtaaatgtaaatgtatgcatgcatttgtctctgtgtgcatttgtgttgcaagacaacctgagaatatattttcatcatcttcctcagtgatctgttcccatacaaaagtttctccttgtctgaaaactctccctaaattgtaacccaaatctctcttgctgcagtttaagcatagccagtcaggcctgtgcatgatttcgtcagagtgcagcttgacacaggcagaatgagccagttcttgatttgggaatttcaacagcaacgtcttgtgaactcagaacagaaagagtt

SEQ ID NO: 469015 - DNA, 1538 bp, Homo sapiens
aggcgtccaaagtccagcggaaagaacaaatcatcaaggtttcaggagaatatcgttagcttacgttagaatttgcaacacacaagtgcctacagggccagccagttcagagtgatctttaggcaggaggccaggcagagttgattctgaaagccctctcctcctcttgatcatgtgatgaaagctgttctgacccttcatgtcctgcatattcagctgcgggtcctcacctctgcgaaggcttccttgatgtggcttgtagaccagtcacttcagtgtctatcactgtgccctgggaacaaatgtgagactgaaggctgcactgtcggcttccctacttttgaggttttgggacatggactggcttccttgctcctcagcttgcagacagtctactgtgagacctcaccttgtgatcatggaacgcccagcacattttctctcacatctcgttggtcagatgcaggtcacatgcctacccctaaaccaaacactggtggggcaagggacaccatgattggcttagagtattctggattaacccctgatctagacatagatgagaccagcagcgtttcccaaacacacattgtggagctcagattcactcaccagaaggcacctgttcactgggggaattcaaatggtccctgtgagtgcttgaaagtcggatcgttccgttcttcaagaccagatacaccttggatgaacacacctagacacaaacccatttactctgcaccacatcttcagaagcaacttaaaaaagagtttcaacaggagtatttgaatgtatcttttgatagatgtgcagaaacaggggtaattgcttctgaaatggaaagttttgcaaacaactatatcactattaacagtgaagagcattaccatttttttatttcgactttttgatagggtgaaatgtcctttggaatgtacagtggaagatcagcagcagcatctctgctgcttgaacaatatgttgcatattgcttcatatttttgcatgttacattgttgcatgttgtttcatagtgttgcacgttgtttcatagtgctgcatattgttttcatattgctgcatgttgtttcatatcgttgcatgctatattgttttgtttcatattgttgcatgttatactgttgcatactgttttatattgttgcatgttatttcatattgtcacatgttatattgttgcacattgtttcatattgtttcatattgttgcatgttgtttcatattgttgcatattgtgtcatattgttgcatgttctattgttttgtttcatattgttgcatgttgtttcatagtgttacatgttgtttcgtattattgcatattgttttcatattgtcttatattgttgcatgttgttttatattgtttcatactgttgcatgttatactgttgcatactgttttatattgttgcatgttatttcatattgtcacatgttatattgttgcacattgttttatactgttgcatgttgtttcatattgttgcatattgtttcttcagcagaacagct

SEQ ID NO: 469016 - DNA, 1097 bp, Homo sapiens
gggatgctgaatgaggggtctgagaagcaaagttcatggtggtgaagagggttgctggaggtgatgacagtggtattggtggtgatgttggagatatgtagttatggtagaaatggtggcgatgatagaggtagtaaaaattatgttggaggtgatggaaatgatgatggtggaggtaataaaggtgatgatggtggaggtaatggcagaagtgttggaggtgataacgatggagataatgaagaggtggtggaggtgatgatggtgaaggtgatagaggtgatgatggtggaggtagcagtggagttgttattggcgatggtagaagtgatgaaagtggtgttggagttggtggaggtgatggaggtgatgatggtggaggtgatggagctgatgatgatggaggtatcagtggtattggtggtgatggtagaggtgatagaggtgatgttggagattgtggaagtgatgaaagtgatgatgatggagatgatggaggtaatggaggtgatgatgatgaaggtagcagtggagttggtgataagtgatggaagtgattgtggtggaggtgatggagatgatgatggtggtagcagtggtattgctagtgatggtagaggtaatggaggtgatactggagatggcagaagtgatggaggtggtgatggagattatggaggtgatgatgttggagatagcaatgctcttgttagtgatggcagaggtgaaggaagtggtggtggaggtgatggaggtgatgataatcgaggtagcagtggtattgttggtggtgatagaggtgatggagatgatggaattggtgaaggtgatggagatgatgatggaggtagcaatagagttgttattagtgatggcagaggtaatgcaggtgagggaattgggggagatgatggagatgatgatggtggaggtagcagtggagttggtgatggtagaggtggtggttgtaggggtgttagcagtgatggtaatggtgggatggtggtggggtgtcactaatggtggaggagtgggcctgagcaactggggcatctgtgagaaatgtgcgcttcaaaggaagatgagtttgggggatg

SEQ ID NO: 469017 - DNA, 1094 bp, Homo sapiens
cctgcacttgtgcacgtgtaccctagaacttaaagtataatgaaaaaaaaagagaaggtggctgtgtggctggcatgctattgctgctatgagggttggactcctaagtttggcagaaccggacagcaaggtctgtgactgccttatccacaggcagatcccgctcgccctgccctggcatcaccaccactgggcagctttgcctctcactagatatgaaaaaagtggaaaagcaaaacagaaactaaaggtgaagaagggggtgaacatcctgagtgctcagacccgtgagccccggcagtggggcgtcaagcaggaggtgggcagcggcggaaagcacgtgacggccaccgtggcctgccagcgcctggggcccagcccacgcaacagaggagctattgaacccaccacgtggaaatctggaggcattgatatccatgcaggaccctctgcctctgcagcagggcggggtggggcgctcgctctgcagcgctgcggggtcagctttggagccgggtgagctcatctctgctctgatagggcttgtgcatcctccacacctgaactgactttctgggggccttgccctgcctacattatcagaagatgctcggttacaaagtactcattttttcatgaaggggaagattgagttttcagtgagaaggaatttaaggaaaggtggtgacagtcagtggcaataatggagaagcacctgctatgtgagattcactgtagacatcctggatgattttttaaaataattgttttctggttataaaagcaattcagactcattttagaatatgaggaaagcacaattatagcggggggaatcatgtgccaatatccttcctactcaagggtaacccactgatagcatgttggttcatttccttccagggtgttatacctgtgtaaggctaatgtatgctaaatatatttagtttacaaatttgggatcatcaaatacgtacagattttaaggacactacaattttcacttgtattggaaacattttctcttgacattaaatattcctcaaaaacattcttaatagctttataatattcatcagacggatttaacgtaa

SEQ ID NO: 469018 - DNA, 707 bp, Homo sapiens
cctgacccccatgacttatcttccatgtctatcattgaggctaccactctgcctccctccactacctctcagcaagctgaactcattgccttaacttgggtcctcactcttgcaaagggactacacatcaatatttatactgactctaaatacaccttccatatcctgcactaccatgctgttatatgggcagaaagaggtttcctcactatacaagtgtcctccatcattaatgcctctttaataaaaactcttctcaaggctgctttacttccaaagaaaggtggagtcattcactgcaagggccaccaaaaggcatcagatcccattgctctaggcaatgcttatgttaataaggtagctaaagaagtagctagcattccaacttctgtccctcatggccagtttttctccttctcatcggtcactcccacctactcccccactgaaacttccacctatcaatctcttcccacacaaggcaaatatcttagaccaaggaaaatatctccttccagcctcacaggcccattctattctgtcatgatttcataacctcttccatgttggttacaagctgctagcccgtctcttagaacctctcattttctttccatcatggaaatctgtcctcaaggaaatcacttctcagtgttccatccgctagtctactgtccctcaggtattgttcaggccccctcccttcc

SEQ ID NO: 469019 - DNA, 807 bp, Homo sapiens
ccgggagggggatcttcatgatcctgcagatttggaaatcagtcaggaactgtggtagacataccagtgctccctcaccctcctgccccagccctgaacccaacataatcccaagaatctgtgaatatgtaagtttcaatggcaaaacagacttggcagaagactcagaagaagacaggaaaatgtgggaaagtttggaacttcctagagacttgttgagtggctttgaccaaaatgctaatagtgatatggacagtgaagtccaggctgaggtgatctcagatggagatgaagaacttgttggaaactggagtaaaggtcactcttgctatacaaagagactggtggcattttgctcctgccctagagatctgtggaactttgaacttgagagagatgatttaggaccccggaatggtagatccatggacagcttgcaccatgctcctggaaacgccacagaacctcaacactggctcgtgaaagcagccaggagggagactgtatcctgcaaagccaaagaggtggagctgcccaagactgtgggaacccacctcttggatcagcatgaactggatgacaaaattggagatactggttactttaccaaggttttgactggaatggcacattttcagatatgaccagactggcttgaaaaattatggttaaatttgtagagcaaagaaaaagccccttagaaagactgtccttatatcttctcttcatggttccttcacaaggttcttgacctgataagtcctacaagctaaaactagataacttagtataaactttggaaaagaa

SEQ ID NO: 469020 - DNA, 2052 bp, Homo sapiens
cctcgtaacaattttttttctctctggataggattgccactgtgttttccttctaacagacaggaccctcagctgcaggtctgttggagtttgctagatgtccactccagaccctgttttcctgggtatcagcagcagcagctgcagaacagcggatattggtgaaccacaaatgctgctggccgatcgttcctctggaagttttgtctcagaggagtacccggctgtatatcaagctgcatgctgggagaaccgctactctcttcaaagctgtcagagagggacatttaagtctgcagacgttactgctgtctttttgtttgtctgcgccctgcccccagaggtggagcctacagagatcacccatcttctgcgttgctcacgctgggagctggcactgaggtttcccaagcccctggggggtccagaagtgctgcctgggagtcagggaccacagtcaaaaaccttagaagtctacctggtgttctattgtgctgcagttgagctggcactcaaaccacaagatcctttctactcttctctcctctttccaaaggcagaagaacctcacttcatacccaccaccaaccctggccacaaggagtactgccagaccacttctgatgttcccttaagacccaaggtcccttaagtcagcttgccatgaatgccgcctaacctgggactcacctttcaaggcagtgggctcccctcttgcccaggaggctgctgtgacaccattccttccctgggtttttaatgtctacacagtggagttgtgttaattgaatctttcttgtcatttgtgtaaatgatacataaaggagagaaagaactgtcttcttcccatacataagagcattccctaagtagtaatttatttattttatttaatcgttatgtatttcttggcttcatagtctcaaataccaatgttttaatatctgtttcacctataaatgaaatctaagtcttatgtgacaataatgaaatacagtatgtgccattacattcaccagtcaaaataaataacaatgtacaactttgatattttagactaaaattaatacagataagagttgaaactaaattacccaaaagagcaataaaattctgatgccataggatcttaaattatatgcatagaatataatcaaaagaagactgaacaatgtatatacctaatggacctaatgaatctgtatttattctggattttttgcaatatgctattattttcatatatataaattaagtccatatataattctgatttttattataaattcacagattatgtcttggcatagttaatatttcatatttgtaattgacaagttaaaatgatgacgtgatgatgatcgtgatggctatatcaataagaataacacctctcatttattaagtgatcactgtgacctagacctttagttttacacttaagttttctgttatttatttaagtcaagctttgcatgtctcaaaaatactctgcattaaaagtacctatatgatgtttagtttaataccagtgtctagatccctctaatcaaatattttgctccattgtatgggaactgactatagttatttattaaaatgttttctccttaagaagtagttttaatatatacaaaatgtaacaaacttttactttaaactgtgctgcttccaaatatgattttattggagatatcatttttggcaatatttgtggttttaatgtagtgaatgtgataatatacagaaaacctggtcctctgtagttatattatctagagttgttttgtttgaattttatatacaatattaataaaaccacagttggaatatgaaaaaagtaatattaacatgcttaaaaatataaagatgttgagatttaatttgtgcatgcattaaaaattagaaatgtgagacgtaaaccacaaaaaaaacagagggtagtcaaaatataagctatcaaaaataaagagttacgaaacatttagaagaaatacaattatttgtacattttatattaaagattcatatttttatattaaagattcatat

SEQ ID NO: 469021 - DNA, 636 bp, Homo sapiens
cctggatgcccaggcagaagttggctgcagggttggagccctcatggagaacttctacgagggcaagggtccagtgggtccccggactcatcctgtggtcatttccccagtgccacaatgcataattggcatagacatacttagcagctggcaggacccccactttggctgcctgactggtagggtgagggctattattatggtgggaaaggccaaatggaagccattagagcctcctctacctagaaaaataataaatcaaaaacaatatggcatccctggagagattgcagagattaatactaccatcaaggacttgaaagatgcaggggtggtgattcctaccacatccctgttcaactctcccatttggcctgtgcagaagaaagatgcatcttggagaatgacaatggattatcataagcttaaccaagtcgtgaccgcaattgcagctgctgtaccagatgtagtttcattacctgccaaagccagcaatatacctttactgtcctaactcaggggtatatcaactctccggttttgcatcataatcttatttggagagaacttgattgctgttcgcttccacaatatatcacactggtccattacattgatgatattatgctgattcaa

SEQ ID NO: 469022 - DNA, 751 bp, Homo sapiens
ccataaaaatgggcaacgagtagccctcgggctgctctgcctatggatagccagtctggcccctgcagaaaggatcatgggaaatgatcatagcctaccacaagctcaaccaagtattagtcctgacgctgtggccatgctggatttgatacctttgctagacaaaatcaatatgactacaggtttgatggctttaaaaagtactaaaattggggctgcatctttgctgtttgcaaaactcagccattctaccctgtgggctttggagagtccaaaccaactgagggtggaagggatcccccagcacagcacagctgttctaccaaaacatggccagactgcttctttaaccttcactggtgatacttccaggtactggaaaacccaaggtgactgggaccaggctgccagcaaaccacagcagccctacagaaaagtgatcaagctgttaaaacaaaaacaaaaaccatccaaaggtcagcaacctcaaagattgaaaatagataatcccataaagatgagaaagaatcagcacaagaatgctgaaaactcaaaaaggcaaaatgccctctttcctccaaatgactgcatcacctctccagcaagggtttggaaccaggccaaggctgtgatggctgaaatgacagaagtagaattcagaatatggataggaacaaacttcactgaattaaaggaggatattgtaacccaatggaaggaagctaaaaatcatgataaaacatcataggag

SEQ ID NO: 469023 - DNA, 1236 bp, Homo sapiens
gtttaaaccacctcagagagaggcggatccattggtacgatgctctcaaggcagttgccaggctatccacaggaataccaaaggaatggaggagaaagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagtcaggcctctctgctgcatgtctgctggagtttgttggaggtccactccagaccctgttttcctgggtatcaccagtgaaggctacagaacagcaaagattgctgcctgttccttcctctggaagctttgtcccagaggggcacctgccagatgccagccagagctctcctctatgaggtgtctgttgacccctgctgggaggatcatttctttacccttgacctttgagagtttgattgtaaaacgccttgagggagtcttctttgggttaaatctgttggtgttctataaccttcttgtacttgactgttgatgtacttctcttggtttgggaagttctttgatattatctctttgaataagtttcctatccctatctctttctctaactccactttaaggccaataactgttag

SEQ ID NO: 469024 - DNA, 646 bp, Homo sapiens
acatagtctttacaattgacaaataggaaaaagaaagaagaaaaaaaaccgatgcataagcctgggagtgaccacgaggtggcagcacaggagacactcagccttgaattcaacttgtactcccctgactggaggagtaagccagagaaagctttggttgcagagaaagatgagcacccatattcaagttccctggaaggagagtcaagggaattgttggaggcctacaggttcatgggtcccgagctacatctgctttccttctgtacatggttcatccccatggatgtccacagcaaaattgagggtgagatgcagagatttcctatatcccacctgtcccacacatgcacaaccttccccattatcaacatcccccaccagagtgaatcattcattacaattgacgagtccacattaacacatcattgtcacacaaagtccatactttacattagagttcactcttggtattttttaattgacaagaaatattcccaaggagtgaacagtatgataacccacagtggtgggaaaagatatactgtttagggaaagcaatatttttattactctcctagtacacattatagttactaaagttcaacaaattctttgggggtggggagatacaccaaatatagaa

SEQ ID NO: 469025 - DNA, 771 bp, Homo sapiens
aggaaaacacaggccttaggctaatggctggatatactttattgactcttcgaatgggggaaaaatatatttttaccttttactatggtccagagaacacagagacaactgaggcggagaccctatttccaggaaccaatacattacctgtggtaactgaatttgggaaatggcagcgttgggatgtgagtcccagcagtcgggatcctgaatctgcctatttcactactgccctatactgtttaaatcctattttatgtagggtggtcaaggaagacttccctgatatggaaacatctgagcaaaggcctgaaggaagcaagggaaagaggcatgtagggaatagcattccaggcagaaggaaggtcaagctgatgtcagtgggaattgaacaatgagatcacatggacacaggaaggggaatatcacactctggggactgttgtggggtcgggggaggggggagggatagcactgggagatatacctaatgctagatgacgagttagtgggtgcagcgcagcagcatggcacatgtatacatatgtaactaacctgcacaatgtgcacatgtaccctaaaacttaaagtataataaaaaaaaaagaaaaaaaatgctaattcaagagttattaaagctttacctagcactcatgtatgggaagtggttttaaatattatagagtatgaacagtttttgagatatgtaatatttggatttgaatttttgcttacgtctttttaattaaaactttacagtgtaacaggtca

SEQ ID NO: 469026 - DNA, 853 bp, Homo sapiens
cagaggcctgcccagacctgcttgcctctcttctgcaagtctgctacagtttgctgggggtccactccagaccctgttctcctgggtatcaccagtggaggccacagatcagcaaagattgctgcctgctccttcctcctgaagcatcctcttagagaggcactgacctgatgccagcaggaattctcctgtatgaagtgtctgttgacccctgttcggaggtctcacccagtcaggaggcaccggatcaggtacctgcttaaggaagcagtctggctgcccctaagcggtgtaggtgcgctgggcggtggggaatccctctcatccggattgcctggactcttcagagccagtaggcaggaaagattaagtcccgttcccccaggtgctctgacccagggagatgagagttctgtctgtaaacctctggctgcatttgctggaattcctgcaggaaggccctgcccggtgaggaggtatggatccagcttctacctaaagaagcagtctggccacaatctgccacagccactgtgctgcactgtggggaattccaccctgtccaaacctcacggtctctctatcaactggcagggaaacaccgcagactagagcctcagcatttattgctataaactttccacttagaactgcctttgattcatctcataaattttggtacgttgtgcttccatttttgtttgtcttaagatattttaaattttctcttttaatttctcatttgactcattggctattcaagaacttgtttaattaccatgtatttgaatatattctaaaattttttatttgtgattaggtgattttctctagtggtatgctttgatttctt

SEQ ID NO: 469027 - DNA, 2085 bp, Homo sapiens
ccattggtctgtatctctgttttggtaccagtatcatgctgttttggttactgcagccttgtagtatagtttgaagtcaggacctcactgttgcaaccatgattcaagccagcaaatcaatgcccaatgatcggcttgcaatatgcataaacacaggcaaatgggcactgggcagaaagcacaaacacttccataattgtgctagtaggcaggaggagcagaagtgtggcctccactcttcacttccactttctgactttcattcaggggtacatgtgcgagtttgttacatgggtaaattgcacatcactgaggtgtggtatacaaatgatatcatcacccaagtaaaaagcaaaagctttcccataagctcccccacacccacaccaagccgacttcctttgacacctcattgggcagaactgggtcccatgacctttattaaattcaaccttagaagtttacctgtcaatgtatctaaaaaagggcagcaggattttaatgtttggtctgtgttatgagctgaaatttgtttccccaaaattcacatgtggaagttctaatgactagtaattcagaatgtgactatatttagagatagggtcttcaaacagatttccctgtgtctttttgtagtcaatttctccttctacccacattcctcgacaatgccagtctgacttctgtggcttaggctttgcctttttcataatgtcacgtaagtggactcagactctgtagccttttgtgactggcttctttcacttagtataatatatttaagatttttccatgttgttatgtttatcagtaatttattccctctttattgatctttgtctggattctctcccctgttccactgacctttctactcattatccaaaatcactctaaatcaattattttttggaaagtctaaagataagaaaaatgtattttaaaatatttacattcattttaattatatttgaaaatcttcatgtctttatgaaggtgcaagtctggtatcatatttctttttgcctaaataattttcttgtatatctcttatagtacagatctccttgtaataaattctctcagcttttgttgcctaaaaaagtatttgtttatatttctgaaagttacacactggatatagaattctaggttggcaagtttttgttttgtttctgtgagactattttaaagatgttgctcactgtcttcttgcctgcattgtttctgatggaacatctgccatccttttcttcagtgcttaatgtatcttttcactctggctgtttttgaaattttctctttatcattgattttcaacagtttgatcgtaatgtgctttggtgcagctttcttgacattttttgtgctttgtatttattgagcttcctgtatctatgggattatatttcccatcaaatgtggaaaaaattttagctattacttttgcaattttttttctgctttcctttcatgaagactccagttacatgcatagtagggtatttgaagttatctcacagctcacttttactttgttaattttctaaaattctctgtctctcttttgtaggagattctataacttctacttaaatagtccttttttcggcaacgtctaatttgtcattaattatatccaatgtatttctcatctcagacattgatgttttcaactgtggaaatttgaggactgtcttgttgtcttccatgcctctacatgctttttgaacatgtggaattcaattataaccattttagtgttcttacctgttaataataacatctgtattagttatggagcagttttaattgatttaattttttctccatgttgagggtcatatttccctgcttcttcagatgcctggaaattttttacaattctatttgatttcacaaagccttcccgttttaggacagttttaaatttacagaaaaacggtgaagataggacagagagtcaccacatactccacactaaatttaccctactgttagcatcttacattagtgttgtatatttgtgataattaatgaactaatactgatatattattactaactaaattccataatgtattc

SEQ ID NO: 469028 - DNA, 575 bp, Homo sapiens
tcaccccttaaacttctcagttatgtgagcctataagtgttcttttttacttaagccaaaggacatgcggtggcctggctcccacctggccaccagccagcagagaacaaatcccagccctgctcatgaccacggcatgacccatgagccactgactgcccggcagaaatcgactttcatgaaaccatgtcagataatggaatgggggccagataaaggctatggtgttggggaaacctcatccttgttgcaagctttcttcaagaacaggagactcagtgccactgaacttaggatttggggatacagtcgtgtgtctctgagaatcttctgttgcaaggaacagcttagccacacagcagtgctccatggcggctgccgtcaagaatctaaacacggcttggaattctctgaggatgttattcataaaggcacagttaatcaaactcagacctctcttcagaatctcactgtacaagccaaacttattgccaatagaaggaaggtgccagaccagagaagcccattttaaaaagtaaaaaaaaaaaaaaaaaaaaaaaaaaaaaaaaaaaaga

SEQ ID NO: 469029 - DNA, 688 bp, Homo sapiens
ttctcagtctgtaggtcacaacactctgatgggggggtgtcaggcaaagtacttcatcagggcagtggcagtgggatacatgcttgcttgcacatgccagcagccacagcagtgtgatgaagtgcatgcacattggcttgagatggccactggacacgctttttctcctacccttggatattggaactccaggctcttcagcctttggactctgagatttgtaccaacagcttcacatggctcttgggcatttgacctcaaactgagagttataccattggcttccctggtctccggctttacaacttggactgagccacactactggcttctccggttctccagcttgcagaaagttatatgggacttctcagcctccataatcataataaacaggattcccaggagtgacttggttctgaatgacttggaagtcaaaaggaagagtccgtttctccagtaacaaaagtatgcctgacaagaggctctaagctgtcctggatgccaatctttgtgccgactactttacagtgattgattgctcatacttcacggcaaccctgtggaatagataacatcatcatcccccttttactgaggtgtggggaagttacctctattgcccatgatcatagtttagctggcgctgctttataaaagaatgaatgaataaattaatgaatgaata

SEQ ID NO: 469030 - DNA, 630 bp, Homo sapiens
accatcagatcttgtgagaattattcactaccatgagaacagtatgggggaaactgaccccatgattcaattatctccacctggccctgcccttgacaagtggggtttattacagttcaaggtgaggtttgggcggggacacagccaaaccatatcagtcatccaacaaaatttttatctgccttggttttgggtcctcagtatatctggtaatcatgcattctaccacttcattaaagccactgatgaaaacactgaaaagaaaaagattgaggacagagctctgatgcaagtcatgacattaattaaacaattagcatgcttcaggaatgccaatgggcacaggcagaagctgcagctggcaacaggctacactctttctggaccagacttgcagagtatgtcagacatagactgacatagcttctcattctcctccaaactatacaatgggaatcaaaactttattaagaggttggtagaatagaataaatgtttttggaaaatgttacatctatgcttttcagtttcttcattttaacactagggctggaatatagagtaggaaatctatccccagaccccagttaagtaggtagttttcctaccattttcttcagaaaaccattc

SEQ ID NO: 469031 - DNA, 1181 bp, Homo sapiens
ataaaaccagaatcctctcacctggcagaaatctttctctccagatgctgcaaagccagcacagatcatcttctctgtgatccctcctggatgggcagaataaaagaagaggggctgaagcggatgctgcttgatatcatttacatgacctattttcaaaaataacaactggcattaatgtttatgcaacaaaaatatgcttacctgcactgatgcttccccatccggtcacagcacagatctccgaggaaaatagaggctctgcgctgtgtgggagacatactggcctcaccaccgagttgtactccagaggagagcttagttgtattagggcaatgtcagagtcataacttagtgtgttaaagtcttcatgcactattatgtgtttggcccttctcacctgtatcggtggcaagtaagcaaattacaacgtaagaaagtcaaagaatccagcaacttccttgttgatggtccaaaataatcctaaatttctgcacttacatacataaacaatgcagaagactttctattaaatttaaaagagcaatattggtttacaatttgcagggggctatgaaccaccttctggataaaggtggtgctggagaaataaagctttgaaaacctggacacggatgaagctggaaaccaacattctcagcaaactatcgcaagggcaaaaaaccagacaccgcatgttctcactcgtaggtgggaattgaataatgagaacacctagacacaggaaggggaagatcacacaccggggactgttgtgggttctgcctacttctgatacacctcaaaatgatgttaagaagtttgaatcaatatccattaatttctcgtatcaagatctccagctgaaaaagtgtctgaggaaagagtccctctactggaaccaatacactgtcacttctacttggagactaattcttccatttaattcttccatttctttaaacactgtttcttcaggaaaagtaaagttactcaaattatttttcaatataccttatttaaaggtgaagattcttaatgcatgtaggcattttctccacagtcataaccatgctcatttcaattccttgcataatgggtttgacttactcatgtgtttcaatatgcctttattaacggagctaactcaagtgaagcacttggcaagtacctggtagatg

SEQ ID NO: 469032 - DNA, 1301 bp, Homo sapiens
caaagcacacatctgaatttgcagtctcctgcctgcagtctcatgcatggctgaatagaaacagctccagtctacagctcccagcatgagcgacacagaagaaggttgatttctgcatttccaactgaggtaccaggttcatgtcactggggattgtcagacagtgggtgcagtgcaccgagcgtgagccgaagcagggagaggcattgcctcacccaggaagtgcaaggggtcagggaattccctttcctagccaagagaaggggggacaaatggcacctggaaaatcgggtcactcccaccctaatactgtgcttttctgatggtcttagcaaacggcacaccaggagattatatcccacacatggctaggagggtcctccacccacgaagccttgctcattgctagcacagcagtctgagatcaaactgcaatgcagcagcgaggctggggaaggggcacccccattgctgaggcttgagtaggtaaacaaagtggccgggaaactcgaactgggtggagcccaccgcagctcaaggaggcctccctgcctctgtagactccacctctgggggcagggcatagccaaacagaaggcagcagaaacctctgcagacttaactgtccctgtctgacagcttggaagagagtagtggttctcccagcatggagcttgagatctgagaacggacagactgcctcctcaagtgggtccctgacccccgagtagcctaactgggaggcagcccccagtaggggcagactgacacctctcacagctgggtacccctctgagatgaaacttccagaggaacgatcaggcagcaacatttgctgttcaccaatattcactgttctgcagcctccactgctgatacccaggcaaagaggggctggggtggacctccagcaaactccaacagacctgcagctgggggtcctgactgttagaaggaaaactaacaaacagaaaggacatccacaccaaaatctcatctgtacgtcaccatcatcaaagaccaaagcaaaggaacaaagctggacggagcatgacgttgacaagttgagaaaagaaggctacagacgatcaaacttctctgagctaaaggaggaagttcgaacccaacgcaaagaagacttgatggagctgaaaaccatggcacgagaactacatgacgaatgcacaaccttcagtagccaattcgatcgactggaagaaagggtatcagtgatggaagatcaaatgaatgaaatgaagtgagaagacaagttcagagaaaaaagaataaaaagaaactaa

SEQ ID NO: 469033 - DNA, 539 bp, Homo sapiens
actccttctaaccagtcagtaggaaggttgtggatggcggagcgctctgaacacagacacactcgggaagtagatggaaccgccatggagtcagtactgctcgtttataagccactgcctttagaaacaggaacagtgaaagggcagcccaggacggctggctatttcacaaggcacctcggaacagccacgcctttccttcagaagaagaaaaagaacggtgctaaccaggtgcggccacagttcaacccactcaggccatttagctttgccagtccccacagtcacaggacgagattaagactggaatgtatatcaattaatccaggacagtatggcaaatgcaagagagaccaaggaagagacggagccgccaaggattcctggagaagacacttgagttgagatttgaaggaagagaaacttccctctgccccttccatgggagatgttaagcaggggagtggcatggctacactttgcgtttttcaagtttgcatttggaaaattgttttgcccacttcttgagcccctcttgc

SEQ ID NO: 469034 - DNA, 800 bp, Homo sapiens
gtgacgaactggaagcacagacgtttagttgtttcctgagggtcactcagcaagcaaactgtggtgctcacgttgcaacccaaggctggggactccaagggtaatacgtgtatctgtttctgccacaagcagggaatgcggagccttcgacagccctgtgggaatgtccctgtggaggaactgaggcctccagccaacagccatgaggatattgaccaagtggaagggattcgaagaagagcaggacacatgaatgggggcctgcaggaagtctcacctggacatttggagggcggtgctgacctcctccgagacgtcgtcacctacagcgccaccgcgctggtcctaagaagacacatcaagaaggcccttgctgatgcaggcccctcgaccttggacttctcagcctccagagctgcaagaaataaatctctgttcttcataaattacccagtctcagagataaaatgtgattcttattacatcagagcaagaatccatactatcagagcaagaatccatactatcaacacaatctcacggttgctgaccttgatcacctgtgaagtcacgtgcacagccacaagccattgactgtgaccaggggcgtggcttcatctcattggccgggtttgggtcacatggcaccagggagacagtatagaggataggtgtagccctgagaccgaggtggggatgggggtatggggggtgggggggctggggggatggagggtatggtgggactttgatgcttatttctgccctcatcattcttaggtttcccaccaaaggtactc

SEQ ID NO: 469035 - DNA, 501 bp, Homo sapiens
gggtacccttaatgaagtctactctttctggatgtccagccagcggcttagggtggcagagattcctggaagaccgcccctccctgcaccccaggaacgcctccctttgccgggcagcccctgccctggagtgctggagatacaggggcaaggagaccaacgagggaacagtgactctcacagaggagtgggttgacctcatttcctccaacaacagggtgccatataagagcagcagcagcgtgcattcagctcctcctacgtgccaggctatgagacaactattaatatccccactttacgggagagaaaacaaagctcagagaggcttgaaatccttttttgattttcaagagactgtaattaaaatgacaatacctctgacagtggtcatattaaacttgcatcagctacaagcttaagcaagggaacaggggtgctgctttaggaaagggctactggaatgtcctcacaacatggtggctggcctccctctctttc

SEQ ID NO: 469036 - DNA, 757 bp, Homo sapiens
gtggcttaatgtggctgccttcatctgatattaaccaaagaaacagagacatcacactcctccaagagcctccagattatagagactttaaggcatccgtcttgagagatcagagtcttataagggctggagatactgtgtgctggggcttacctgagactgttcctgaaaccttcagcttagctcattcacatttgactccagttgggccagtgctctctcggcttgtgtggctggctcagcttggggccacaggtctctacaatggtgtgtctgccctgccttcaggacccatatcccaaaatgtggaaaacaccatcggcagcttcagaaccaaatgtaactctcctctcaagtgtgaaataatcccattcaggtggtgagtgacttggaatcgaggtggccaaggtgtcatggagtagccatttagaccatagcagcttgggggaacaaggagctcatccaaccccatttgcttgggtctgtcattccaatgaggcttctgctgtagggaaagccttgctgttctttcccacagacctcagaggcatgtcagttaccacctcccaaggtcagcattcataccctgctcctgcctgagctggagccgctgacataatcagcaggcaaacccttctggaatgttagatgaagtcacctttaccttcctgtgacaggacaccctttgccaaaaagcacaaaacattccactctgtgtaaagctcatgctgttctgaccccttcttctgtgccagcc

SEQ ID NO: 469037 - DNA, 621 bp, Homo sapiens
ggaaaagaaactaaaggaaaaagatgggactaggagaaagtcatgggagaggcaagagaggaagaactttaggacacaggaatgagccagccatgcacttcgatattccagcaggtctcatgcttctcaaggttgttgaggacactgacgatgcacaatgttttcttgagcagtgctccgggccgtcattcctgtgcaggatcatatttcatcttcatagtcgacttccaacattagagacccaatctgtgatgtctaataataatgttggaaatgtgacaactattaataacttcatcatccaggatgatataaagccaaaagggaaggatgaaacaatatgggaataccaaagacagaaaataccgaatgtccggcctaaagcaggatttctcaatatctgcactattgacattttagctgggcagtttttggccgtgggggcctgtcctgcatgtggtaggacatttggcagcatccctgctctccccgcactagatgccggtagcagaccctcccccaaatgtggcatgacaaacagaaatgtctccagacattttcaagaatctcctggggacaaagtcaacccctgttaagaaccatgggcatacaggaaggtat

SEQ ID NO: 469038 - DNA, 577 bp, Homo sapiens
gacacatagtgagtactcaatgcatgttagctgtgttactatcatgattattctagttgtcctcaaagagccgtcccttgtgtctcagacgtcccagttccaactctccttaccatctgctggtagtactttcttcccttatggaatctctgcaaccgtcgaatctttgaaaacccaagtgaatttcgatctttatgccaaatgccttcacttaaatttcaggctgtacccagaattcacagtgagaaatagttgcaatgctcataaagaagcacataaaaggatgttcactgccaccctgcttgcagcagcagaaaactggagacagcctgaatacccaccagtaggagactggttaaataaatcatggcacgcccatgcaatggaagcaggctcagcagtcttaagcaatgaggatgatctacagaagggtctacaggacatattgataagtgaaaaaaattgcagaacaattgcatttatgtaaaaacaaaattaagcatcacattgaatgttgtatgtatcagtgcacagatgcacagagaaatgtctggaaggatgcccagaaaactagtaa

SEQ ID NO: 469039 - DNA, 461 bp, Homo sapiens
ccctcatctgccaggggttggctgctcttcatttatagtcaacggttgccacatggaaatgcaagcccagggggctagattttctgattttgcaaggagagctggatattttaatgtgaaatttcccacttccaagggaggcttggctgacagactccgatgggagtctttgattacttccaactacccattagttaattgctcagaggcaataaagacaaccaaggaaacaggagaagacccagtgattctttccaaagtcttccgaacttgtgtcaacaaccttgtagctaaatccattcttccgtatcacaccaaaaatattaaccggatgcacttttacttattcctaagaaatttcttcatgctaggcttgtgtctggccttgtacctggacctcgggtaaagatattaaaatcaaaccaaggcagagaaattaaaatcacatggaaagtgttttt

SEQ ID NO: 469040 - DNA, 880 bp, Homo sapiens
tgattgacatcctataagaagccctcagttaggtcccagttacatgcagcttaggagagggaggtatgattattatctccactttacagctgaagaaacagatctgaagccaatccctgagcctcctgggccatacactgtcccactatttcaaaagaaactcagtgacgagagggcagagggagaatatgtccagcatctcagcctcattgttttccacttggcagccccctccagttcagccgcctctgtgaacaatggtctttgttcttcacactttccctatcaaagcctcacagcagggatggccttcagaggcgatgggcgatgtgataattcctgtgccagggctgaggaggggggcaggaaaggaggggtcaggtccaactttgacccagttagttactctggggtctgcggtcctgccctgattcttcggttacctggaaatatgactctggcatttctatgagattccccagataaaaatctgggcaataatcgtctttgcccctttaatgagctattaagtggctttgcttaaataatagagcaattattttttagaatgctggcctctggggccctccccggtcttggagctttcacatccctacttgctttaccagggtgacaaatggagacatctttctgcttcttcctcctccccagggatgagaggcaggatccttcctccgttttatgccacctttcttggtactttagattcttaggatattcatgctgaacaaatattcatttttattatcaatttttttaggacagggatatccaacctttaggatttagtgttaatcactaattgtcaactaactgtcaatcactaatgaatcaactaagattgtccactttggatatg

SEQ ID NO: 469041 - DNA, 2000 bp, Homo sapiens
cttcccaccttaatggaagaagacagtcggagctgctattggtggcctaatgtaaaaagtggccacggagccattcggcatgtcattcttactctggagatactcagtggtggacggccacgtttctgccagcatgggactttctgctagtctgtgcaatgggtgggcaaaagactccaactacatctttccggaaagaggacttaagctcgctaccacggattggctcagtgaagagaggctgtggtcacctctgcatggtttcctggtacaaacacaaatttcctttcctctggctgcattcctaaaattaattaaatcttggctcaagaaggcttcttcatgccagcaagatgagaagactgaatgcagagaagctcaaggtcaaaagcaaggatgtcagctccatgaggttggggaccttgcctgttgtattcacttctatctcctagaacagcggctggcacagagtctttccaactcaaatggttgcaaggagaaggaagaggaggtagagaagaggaacgctgtttctagtgcttaatgtgtcccagaccctattgtagaggcttcagacatctataatggcatcttcaagagacctgtgtgcaccttgtctgagttgaagtacacaccctgaagaggagccagttatgaaggaccaaatgcacatattaaaattaaacatcacacgattctcaaagtattggttattaatgcccagtggtctcacttgcgctgggatccacattatttctgtgcacatttggaagacacattatcatggcaaactgccaggctgagatgaactgtgggttcaaccaatcaccaaagggttcattcatttatccctgagacaatttcctcagagaggaaaaggcacttgcctaaggtcacactgctggtaagtggcaaagccgaggtgtaaactcaggcaacctgtctctaagcacctcacataggcggtgcttcagtctgtttgtgtgcactcagacactttcaatgaaattttggcatgaaaaggtacagcaattgcgaggtgagctaaaggcggttattttccctctgctgaaacacgaagattcattgctgattctatgagttggtctttgctgctcttgaaccttcctccaggagttgaaagagacatggaactaattctcccctggagcctcccgagggagtacggccctgccgacaccttgacttcagcccagtgctaccgatttcaaacttcctacgccctgaactaggagagaatacattcctgttgttttaagccaccaagttgttcgtaatttgttacagcagccattaagtgaacaaatatagatcattaaaaaaatccgatgcataaacagtaccgtgccaggtgctgtgcaaatgggactgaatgctcaacgggacttttcagaggcattccctgcatccagtggggctcttccgtaatggaaagtccaatgaccaggaaaggcttcacttcctggctccactttccttctgctgaaacacaaagattcatcgctgattctatgagttggcctttgctgctcttggtgtgctccctgtaagcacaatcccaaggcccgatggagccttctccctgcatcctgtttaagcccagcaacttccctcgccaattagaggcttccccttcagccggtctggctttccccacacctgccgagggaagcacgtgtcggccattagcgtctcttcatgccaccgcttcatgtcacttcattgttccccagttggcaacagctctgcagaaatgaccccatttggaaatgtttgtgggagtctgagcaaaagatctacacagccctcttctggggaaacacgagggttatcagaactaccttttctcaaatacccatttcatgccagagctccatctcctcactgctcaagatgtggcccgtgcacccccacataagcatccgctgggggctgaggaccacacctctcattccctgcccagacctgccaattctgac

SEQ ID NO: 469042 - DNA, 584 bp, Homo sapiens
tataaatgaaagatctggcatttctaggtgacttaatgttcgatgagtatttgttatttggtgggcactggtaatctaacccgaacaagcctcattgcctcctttaatcggatgaccccagacactgagctttccttgggattttcttgccagcgccttcagactcgttgcagccgttgcagccgacgccagccgtctctctcgccccggccctcagaggcaggcgcgcaagctaaaaggcactttgcgagagggggaaccgtccattgcaatttgtgctgcgaaattccatctcgtgaaattgatagcaaaaggacggatcttcaaggcagcttcatgagaaacttgaaggagtcagtccacaataatttctggagcatctactttgtactacctgctgttctaggcactgtggtttcactggtaacaaggacagaactactgtccccaaggagttatgttctaattggtggatgggaggacacagattaggaacacagaaacaaatgaggtaacttctgtcactggaggtcagaaagggaggtgtctctgtggaggtaacatttagttcaaatttgaataac

SEQ ID NO: 469043 - DNA, 670 bp, Homo sapiens
gtaggcgatacgacatgagccattggaagggtgacaactctagttttgatgggcatagggtcacacattccttgctgtctggccctggccttggcaaaacacggtctgtgaatcagaggtttaaaagctcttttcctgagctgaagattctgatttcgtggctgtgcacacaggaaataaaaccccgttcttctaagtggactgggagaagtatgaaattacgactaagttgggtagctggagaaggccttaatgagaaactggcacctgggcctagaactgaaggaggtgagggagtcagcaaaaagaacatccaggcagagggaaccactgtgcaaaggccccggggtgagtgtgtgcgggtgcatttgaggcacctcatggaggccacagtggctagaagggagtggccggggatggggagagtggtaggagttggtgtgagaaagatagcagggagcagatttctgagggcttgtacgaccctgtgagctagggtgaggactgtgactttcattaaaagtacgatgagaagctgtcagaaagttttgaaagcataagcatcatgtgaattgatctgtgattttaaaactgatctctagctgttgtgtttatcataggctgtgatgattaatattaggtgtcaacttgattggattgaaggatgcct

SEQ ID NO: 469044 - DNA, 751 bp, Homo sapiens
ctctctggcttcttttccctatgttttccctccccgagtgatgccttggggtctttgcactggccacttctactccctggaaccacctccccagcaatgcccatccccacaaatgggtgtgacaggcagaataaccaccctccaaagatgtccacaactcaatcctactttatctttctccataactctcatttccacggagcatgctaccttttgggctccaccaaaagcatatctgcagacaagaatttgggtgcaaacagttgattttggaagcagtcccagaaaacatgaaacagtagccacttggggcagatggtgtgaaatcctcggagacttaggaccttgcagacaatgtccagcatgggaattggagcctctatttaccaactcccatcccgccttggcagaaggttgctcctggggcatgaactctcagcactcaccacctgtcctgtggacagagccagcacagttcagcagccagagtgaccctcaggcagacacacaggaagccttggtgtgtgcaaaagcagtgtgcagctgacctccagtaccgactatggggaggcaccgacagcatcaactaccatctccattttagatacgcgttttctttgttgaaataaacaggtcatattttagtttcctatttctgctgcaacaagtgaccacaagtttaacggcttaagcaacgcaaatgtattatcttacagctctggagagcagaaatttgacacagatgtcaagg

SEQ ID NO: 469045 - DNA, 612 bp, Homo sapiens
cagctcccttttcattttccctcacacaagcatttccctctgtacaatccttctgaaatctgaaagatggagaagaagttgcccaggccaagggatgcaagggatggtggaggtggtggagcatgtggtagggagagaacattccaggcaaagagagaaaatcctgcacagcgtctgtggaaggagaaagtacgaagctttcaagaagggggagcagtgataccagccttccaaagacccccaaagctgctagttgggactgaggggcccccagccctggctgcctgtacccctatccttgggctgcagatgaaggcagcaatgaccccggcaaaggatgaggggtcaaacagaacaggggatgaggaagtatcggagaaggagtcagcccaaagcattttcactgggcttctaagaaatccatgtgtccaaggtgtcttggtgccactgcacttggccccgaatgtctattaacaaaaaatcaccaaataacagatgctggggaggatgcatagaaaaggggatgctttatacacccatcgggggaatgtaaattagtacaaattctatggaggatagtatggagatttcttaaagcactaaaaatcaaac

SEQ ID NO: 469046 - DNA, 549 bp, Homo sapiens
gctggctgccatgtgcagaagagcaaaactggacccctacatttcaccatataaaccaacgcaagctctggcattcttgaggtgcagaaagccttggatggcccacttcagacttattattcaggaaaatccaaccccatggctgaaggcactcatggtgaggtgtctgtctgcagctgaacacttcctaaccgttaggaccattcccaacctgctctttccctatttaaagacagaaggaagggcagacactcagggtgaatttcctaatgttcttctcattgatcttggagtaaaacctccaaggaactggaggcctgagtcttggccgtctcaccttccattggctaccatactcctggcaggacccagtgggagtaaacatgggagacaagaaccaacactaagtgagcacctaccaagtgtatgccaggttccaagtgaggaaggctggtcgtcgggctgagctgggcttgacccttgtctttgctccttaagtgctgtgtgttcctgggttgctgtgaatgccattaattcatttctttttat

SEQ ID NO: 469047 - DNA, 725 bp, Homo sapiens
atagagcctccaccaacagggctgacatccagaccttattggacaggcatggccatggttcagcagatgccagagaggtgctgtgatgctgtactggtggaacttgctggaaatccacccccagggtgctgggaaaagctgttactgggaggtgtcttactggaggcactctgctacaaaactgctggaaggtgggtgggtgaaggggattgctgggggaggctgctggatgcaacctgctgccatgcgctgccggagccagggctggggaagcctcctgagctacaggaacggggcattacgggagccctaaagaaacctagtgagctgccatcagctgcagaaagcaaaaccctttcatcccgcaatgtctctccaacgccatctattggcaaacttaatattgtaccatctggatctagaaaggcttaccaatcatcatgtctcctttttggtttttggtggtgtgaaatgcagcaacttgtctttcaccttggaggagaaattttgacattcttcatagcattgagcccccggcacttcactgaggagtatctggtttggggcaaaccatatcacttctgagtctcagtttcttcatctataaaatgaagatgttttagtcaatattttattcatttgcaaatacgtctttgctaggcatggggaattcagtgatgaacaagaaacatactgactgtttccttaacatacaaacttagtgt

SEQ ID NO: 469048 - DNA, 658 bp, Homo sapiens
agccattttgaggacagctgtctaactgctgaggccagaaacctcccgcagaagatccgatgacttttagaatggagaatctgagaatgacaaaacatggggatgaggggagaagagagagagatattcaagatgacacagacttcagggttgatgagcaggaggagaagaagagtttgaaggaagaggttcagggctatgtctggagtgaccctgagcttccaggtcgaggcatcttgtgggaagatggagatactgaatctacagctacagacgtgggagtcatgggggaagggctgattgtctctggaaactatagaagggccatgctgaattttaacacaataatggcagccggatgtcctgtctgctttaccacctgcctgcctatccacactgtcctagcagaagttaagctgacttggacagatgtttctcgaagtgtgggccaccagttcctggatccaagtcgcctggggagggagggaattaaatgcagatctgtgggccctgccccccaccaactggatcaggatctggggtagcctgggaatctgaacactaaccagctcccggagatcaaggattgagactttgccaagacagatgcagaataagcaatgggtgaggaattaaaggtgtcagcaagacagtagcc

SEQ ID NO: 469049 - DNA, 647 bp, Homo sapiens
caaagttctccagatggccgtgtgtgctctgattcagcatccaatatatggtactgtttcttccatagccaggattcacgggtccaggaatcaaggggtggaagtggaagtggcaccactcaccatcaaccctaatgatccactagcaaaatttttacttcctgttactgcgacattatgttctgctggcctagaggtcttagttccagagggaggaacactgccaccaggagacaacaatggttccattaaacttggagtcaatgggaaagtacagcagcccaatccaggcaggactacgaatgactcagaccattcaggaatgaaggaagtagatgactggagagatggcagcatggaaaggacttggcctgatgttgctggctttgaagatgaaggaagtaggactatgagctaagggatataagcagcctctaagaagattaaaggggtaaggaaatgaattctctcaccaaggcccccaggaaggaacatagtgctatctacccttgagtttagcttggtgaggtccatgtcagacttctgtcctaaagaactgtatgataatacatttgtgttgcttatattgctaaacttgtgctaatttagcaacttaaacaacacaaatgttttgcttgggataatac

SEQ ID NO: 469050 - DNA, 563 bp, Homo sapiens
ctcacccctttgacaggtcctgtttagaaaccagccacagcatttgggcactccacatgggattcccagctttccccctcttccgactcagcaactgtgtcttttccccatccacatttggtgttttctcatcacagatctgttcaaattatgttggtgtagtcaaaattttggtttctctctgcaaattcattgccataccaggaaatgagcttgacaaagtggtcattgacggcaatgccagccccagcttcaaaggtggaagggcgggtattgcttttaaattccaaagggacaacctggtgctcagtatagcccaggatgcccttgaggggtccttgggtgcctgcctcaccacctttttgatgtctgaagaaacctgtctagcaggtttctccagacaagaggtcagttccacaactgacacagtggtgctgggaacacagaagaccatgccagtgagcttcccattaagcttaggaatgaccttgccctctcattgcccatttacttggcagcaccagtagatgcaggaatggtgttctggaaagccccatggctgt

SEQ ID NO: 469051 - DNA, 690 bp, Homo sapiens
agccaattttctcacaaccctgatagtgtgcattagagggcctacggaaaaccagggccaaacctctcaattactctaaactgtccatgataaacagccagatgagaatcttgtagcctttatggaaaggctgagagaggcactaacagaacacccctccttatcccctgattcagtcgagggacagctcatcctaaaggacaagtttattagacaggcagctgccaatattaaaaggaaactacacaagcaagctataggaccagatagcaccttagagaacttcctgaaagtggccactttggtcttttgtaataggaaccaggaggaggcccaaaagaaagagacaatggtcagaaggacagagactctagcagcagctttgcaggcttgcaaagtccaggatcccggaggtgcatctgctagttgctatcagtgtggcaggccagagcatgttaagaaagaatgcccatacagcaagacaaagccacctcaaccctctccagcctgtggcagagacaacaggagatggaactgcccccagaggtggaggtcactgggttcagaaccagtcttactgatgatccagcagaactggatcccggggctcaaactccagctccagcggctcaaactgccattacagcacaggagctctgagtgattctggaaattaaaagaaggaaagta

SEQ ID NO: 469052 - DNA, 1542 bp, Homo sapiens
ctgaatttcagtttctcccaatttagaatatcttattatgtccagatgctggaatcctgtctatccagatgatccctggttccatggccaagtttctgctaggacttacttcctggcagctggcagagcagacagtcactgtggcttcaatctgatcaagttttttaaaggacttcagtaccacccaattgtctctgggcctctggataatgatttattattatgggaatacttctcattgcttgcactaggagctttcacaaatagcttccttagttccagatacagttggaagatcaattggaggagcaaatgctctagaagcaaaaacttccccaaatcttactattcacattcacgcttacctcctttcctcaaatctcagaaaaagcagtggcatttctcttttcaatacaagttctccacttgtgcttttaatcccatttctttcagccacctccagggccttattcgagttaatttttgatctctattttcttttgttttcattttcccttctattgaaatatatgacatatagtaaagcatacaattcaattatggatgactgacaccttttgtaaaagatagggacattttgtatatatttggagaactgacacatttttaagtctctagctttgatacatttctaaattgagcttgtcttcatttaatatgccactcttaaaacagtattcaagtattgagtgttgaaatagactagcattttctctcagctctaaaatttgcatttcattcataagaagaaagtggacagtctatcaaataaagtgtcctgaaaatgacctcaagatatatactcatcaaaagaacagcctgccacctcaacaagaaaataacggaccctctgcaaaaggccagcttgtaggagaatacttgggtatttgggaaacaacttcaggtaaaaggaaagaaattacttaatgtaatgtaaaatgacactcccacattatgtaaattcacccttagcttattttttaaaaagaattctgtacaactttactcagaaaatattttatgttaaactttactcagaaaatattttatgttaaacttttctatttattccaaaatcaactttaactcttctccaaagttctttggaagttcatttttatatatcttaattgtgatgttcttcttcaatctttatagcatctatatagcaagggtttttaagatcacatttttttttaacttgaggctagtacatgttactcagatatttacacttatattaaagagctgggttaattaataagataattatcaaaacctagggctaaataagattttgcatggtaatctttcaccttctcataagaccaaatttaaactctacagataattattatattttctacttctaatactacagcctctgattatgatccagctcaggcctaattttaccaggtcaaacatatatgatgtatgccttcagaaatattttgcatgcttgcttcatcatcacagagctaaagctaaaatcaaggaaatttttactgttctacaatt

SEQ ID NO: 469053 - DNA, 1343 bp, Homo sapiens
caatttagaatcttattttagttaagatggacccagcagtactccacgatcagatgaaaatggtagatttagaatttggtccaagaggaccagagggcatgaataagctacatgagcaggtggcccagaactctgtatcacttactaaggtctatgtcaacatctctgttccagatccacctctgaacctacaggagtcccatgtgatcagaaggaggaaaatgaaagaacttgatttggggatggaagcatcctacatcataggtcactggaaaagcctatggaaagaaaagctgaagcatcactttagagcaaatactgtgaatgagtccaaaaaccaaccattaaaatcaaatattaccgcaattactgtcactttcaatggtctattggaggaaattttgctacctgtccccacaactactgcccctcataagaggcacattattgtcaaaacatacagcctgacatgaaactaaaactatggctgctgccaaggcagtttgacctccttgtgcccagggaccaacggactaaaaggagaattaccatctttgcaagagaaattaagtgtgaacagcagaaaggcatgcagaaatgtgtataaaacccagactttatgtattcctcacatacatctttatataatacattatatgcatctttttataatttgtatccattaacaaactactatagctatagttggtttaaggaattgaacaatgagaacacatggacacagaaaggggaacatcacacaccggggactgttgtggggtggggggaggtgggagggatagcattaggagatatacctaatgctaaatgacgagttaatgggtgcagcacaccaacatggcacatgtatacatatgtaacaaacctgcacgttgtgcacatgtaccctaaaacttaaagtataataataaaataaataaatagttttgtcttttaaggttttactagagttataattgatttacatattgatttataacattagactgttttgaaagatattttaaccagtaattgttttactagtttgttcaaatagcatataacattctatttattctgctccttcctatacggcttattaaaagttttgtttgttttcttatgtgtttatattttactttttatatttacttattttacttttaatcattgactatacaaaatttatttttatagaaattgttctcatcaccattgactaaataatatgttttcttcaaaatgtattatgccatgtttattatatactaaattttcatgtgtattgagttcatttctaaaatatgtattctggttttaagacatgtgtactcattcat

SEQ ID NO: 469054 - DNA, 549 bp, Homo sapiens
cctcttttttctcctcctcttcagtctactcaatgtgaagacaatgaggatgaatacctttatggtgatccacttccacatgataaaactcccatccccctgggacagagcacctggggagaggggttgttgtgggctaagcttcagcagacttaaacattcctgcctgccagctctgaagagagaagtggatctcccagcacagtggttgagctctgctatgggacagactgcctgctcaagtgggtccctgacccctgtgcctcctgactgggagacacatcccagccagggtcgacagacacctcctacaggagagctctggctggcatctggcgggtgcccctctgggacaaagctttcagaggaagaagaaggcagcgatctttgctgttctgcagcccctgctggtgatacccaggcaaaaagggtctgcaatggatgtccagcaaactccaacagacctgcacaagagaagcctgactgttagaaggaaaactaacaaacagaaagcaataatatcaacatcaacaaaaaggacgcccatgc

SEQ ID NO: 469055 - DNA, 743 bp, Homo sapiens
cggcgtttctcctgcctctggtggccctgatgctgctgttgcctcttctaaaccccatcgttcctcatggcctatacgagtcctcagtcccacaagagccctctctctgtccttcaacagcctctgaaacatttcccatcctacagcacctgttcttgctatgctacatgtaagggacttatccacagctcccatattttacaacataagaagagtggtaggcaacagaaggaaaagtgggtgccgaagcccaaagcaggggccagccctgagtgctttcgagtggaaaaaggtccagtgcaactggagataagtcccggggggcctccagcactcatgatgcctagtcttccttcatctttcttaatgttcctcacattctttggtgaacttcatcgtctttctctttggtggtgtccactggacacgtctgatccccaagggaataggggtagttgtgttcatgctgtgtttgtagcacttggactactgtccatcccgcggcagaagctcagtaaccatgctggtgctggggaatgaatcagatggggccaattcagatacctggcctgaaagtctgtaactgagcagactttgggcaggcaccaaatggcaaaatgctgcatctgttaggaccttttcaaattcaaaccaaactggtttatgcagaaatcagaatgtattggtccactgtttaagactggattcgcttggttatgcgaacagtcagactgtgtccaatt

SEQ ID NO: 469056 - DNA, 796 bp, Homo sapiens
acagcatcagcagctggcccacagatcagggctggaaggaagaggcagggaagtccaaaatctgcagcacgagtctagctggcagtgttccctggagtttagccggcagcgttctgtagtgtctagccaacagtgttccatagtgtgtagccggcagtgttctgtagtgtgtagccggcagtgttccgtagcgtctagccagcagtgttccgtagtgtctagccagcagtgttccgtagtgtctagccagcagtgttccgtagtggtcgtcttctgtggaactacaaagaatcagtgttgcagcccttgcatccagtcacctgtcccctaaactcccacaggaagactgaaggtagccctctggaaagggtaaatgagagatgttctggcatcggggcacctgtcccagctgaaagactggaacaggagtccccaacccctaggctatggaccagtattggtccgtggctggttaggaaccgggccacacagcagaaggcaagtgatgggcaagcgagcgaagcttcatctgtatttacagctgctccccatggctcgcattactacccaagctctacctcctgtcagatcagtggcagcattagattctcatggaagcactaaccctactgtgaactgcacatgcgagggatctaggttgcacgctccttgtgagaatctaatgcctgatgatctgttactgtctccatcacccccagatgggaccatctcattgcaggaaaacaagctcagggctcccactccttctacattatggtgaattgtataattattt

SEQ ID NO: 469057 - DNA, 765 bp, Homo sapiens
gttttgttttggaggatttttttttccataagttattgggaaaagttcttaaggatgatgtccacctgaagtatggggctgcctgcaggacacaacaaagcagaatgttatgcagcaggattaggaacagcaagcagacttcccaccgtgaggtctgaagaagcaaaggtaaaggatgctctgacccagagagattgctctgtgaagtgcaccactggaggggagctctggcctttagacaaaggacacagccagcccacggtaaccctgcagagaataattgcttattcaattacggtcctttgccttgatcaagggtattaccataagaaattaactgacgtatattctgctttatcggtgcatccctttacaaatagaacacaagaaaccatcacaggcaggggcatccaagggcaggctctggatgcaaattttcagccaggggtttccagaaaaaagacccatccctctgtaggtgcccccaagcccatactctctcaatgatgcctccacttgacatttctccctctctcctgaatcatcgatttatccctttttattgtcaagaaaatatgttttagtatcctgttatgggctgaaaatgggtctcccctccaaattcattatgttaaaatactacccttcaggacttcagaacgtgactgtatttggacatagggactttaatgaggtaattaaacttaaatgaggtcatactggcatgccctaatccaatatgcttggtgtcctcgtaagcagaga

SEQ ID NO: 469058 - DNA, 907 bp, Homo sapiens
ccttgcatccaaaatgctaccccagcccagcagtgagcctacacaaggaggagttatgtgtcgcgacacaggctcaacaagccaccttcgtcatcagggcaaggcaggaaaaagccgccattgcacagtgggagacgtccaggaaaaggagagcattcccgctgcaaacccactcagcatccccggccagagtccccaggtgggtgatcagatccctggccagagcccccagctgggtgatcagatggaaggtgggtgtggctacaagtttcatgtggagcctgtcccactatcccattgtgaaaagagcaaagaatccctgcctgctcccctcaatactctcaagtcaactcttaaaattaaacttattcattctcagtgggacagcagagcatttgtgcctgcagttccttctccctggaattccctttgcctctacccattcttcattggggttcacatcccaagcatgtagctactcttgctcgcttttggtgtccattcgtatgacactcctttactttaagtttatgtgagtccttatgtgttagttatctaattccttgaatatttctcccttcacttcttgtatcattgtttggatttccttgcattgggctttgcctttctctggtccctcccttattagcttaataactaacctcctgaactctttttcagatatgtctatgtcttttgctgcattggcactgtatattcttactagtatagttccatgcttaaatcctggtggtgtaaaagcatcagtgctggagtcagacatccattttagtcatgtgacttccagtaagttattttctttccaccagccttaattttctcatctgcaaaatagccacgatggccatttctcttgatggtagagcattgatacaatgaccttttc

SEQ ID NO: 469059 - DNA, 987 bp, Homo sapiens
gctagcatctgctagtgtgcactgtatgcatgagagtcagagaaattattccagaagaaagacgaaaggggtgaaagctctatttaactgctcccattgcttgatccagacacttctgacagtctgtttttacagacatggcaaaacaacacttggaagtcatttgagaaaatattcctggtatcacagagcgaaggactctcgccatgttgcccagactcatctcaaactactggacccagacaatcctcacactttggcctcccaaaatgctgagattacagcttacctaaagttaacatctgatgacatgatcgcaactccatatcctgagttgatttcaacctatgatgttggaattttccacatggagataaacactgggaagcagctaatcattctctctggatttataaggaacaaatggataagtgaaacttgaaaacaatggccaaagtactaagaactaatgtttcttcaacaaaacaaatacttttactttaagaacagaagataaaaggccaaagttgtaatataagacaaattacggaaatatacacttatacatataaaaccactcctctttttaaaaaatcatgctttttaagaagaatcttctcatatcagtgagaaagaaagttatcttaacaaacaaaaagtattttgaaaaaaagcgttcacatgtataagaaagaaaatgaacaaataaataggaaaaaagatctctggttcaaccatatcaaagcttcttcatgtttgttattttactctaaaggacacctccctgatcttgaactgataatacagttaaaagaattaacagaaagagagagggatagaaatggtcacgtacagaatgaaaaataaaggaaatttttttcttattattttcctaatttgtcttaattcaaatgagcagaatagagtgctccaaatcagaactgtgactcactagaactaatatattttgtcaacatatttataatt

SEQ ID NO: 469060 - DNA, 686 bp, Homo sapiens
tttgctactctctgaaatttatttggaacccccaaatccatccttgcagtaccttcagtcgttcacagacatgtgcagagaagtgaaaagtttgagtcactcaaaccaagaaacagtctatggtctatgtctttctccaaagatgattttgaaggcttcaatatttaaaagggaaaagtgggatggagaggaaagaggagggtgtggtgatccatatgttgcaaggaaaaggagcagggcgaccaagacagctagagtggacggggcagaataccagataggagagaactgtacacagagagaaaaaagactcagcaacagcaaatccacagatcttcagagggccccccgtgagtatacagcagagtacttggcaggacatgaatgtgaggatactgccccaggctggggacagaaccacctgaaagatgtctatcctggttccacgctgtttacctgtcaaagagaatgaatagagcatccttagcgcttgctatttgcccagaaaaatatgttttcagtgatttaagagggtttttttccccccatatcttttggatattaatcttttgttatacagtctccagagtttttctggcagtttgtcacttgtgttttgttgaatagattatcaattttgatattgtcaaatattttcctttgtggctcttggattgctctttgaa

SEQ ID NO: 469061 - DNA, 1581 bp, Homo sapiens
gcttaagtctctctagaattcttaaatttgtgaacatcccaagaagtggaaccaaaaatgaggggattttcttttctatttcagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttatactcaagtgttttttaattattattata

SEQ ID NO: 469062 - DNA, 3270 bp, Homo sapiens
gagaagtggagggggctgatggggctttttgtctctacctgtccttgactccgcggctgcctgtctccactctgcctcggccgtgtcaacacacgctgcaccaagttggggactgaggcagcggtcaggacaactgtcatcaaacgtcggcctcacgcctctccgcgccggcctcctggatatttttgtcccgaatcgccctgatcagtgcccagcgcgccgccgcgggtgcttgtgtagactctgatggccgcccggccccggccctctcgtcctctcacctgcgccttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggactttatgtcccaattggaaaaatgaggcgcactcgccaagagtgttcaacagcaatctggaaaatggcacaggccacactctgtggctagtggccaacttaatagagtccatcaataaaaatagaaaacacagagcacaaagtttccaagagttctacctctttttgattcccatttaaaataagtcagctctccatttcaccccaacccatttttatagtttagcacacagtccaggaagtcttaaagttatcccacttttctgaaacaggaaaccagaaaggcccgagaggactccactgtgtccacaggctggaaagtcaatctctctcttggagtgccaagggaactcagagctcctgcagttcccatagttggcattgtgttcctctgccagaattcacagctagctattgtggctgtttcggttctctggagcttcaatgaataggtttatccttcttccatgcagcagttcacgtgcccctcttgtctactccagggtggaattcctgtaaatattcctgccacatcagggcttccagagacaccaacttatatgtaaacaacacagtccagatgtgaacgcatcagtcagtagagagaggccatttctcactattttgaattgcactatttttattgttgttgagttttaggagttatctgtatattctgaatattgatcccttatcagatatgtgatttgcaaataatttctcccattctgtgggctgcctttttactctgttcatattgtcttttgatgaacaaacttttaaattttttctgaaatccaatttggttattttatcttttgttttctttgcctttggtgtcatacccaaggaatgactgccaactctaatgtcataaagtgtttcccctatgttttctaacaggagttttatagttttaggtcttacatttccgtttttagttaatttttgtatatggtatttggtaagagttcaacttccgttttttcatgtggatatacagttgccccagcaccttttgttgaaaagactgcctttcttccattgaatggtcttggtactcttgtcaaaaatcatttaatcatatatgtgggggtttatttctgggatttttgtcctattttattggtctatatacctttctttatgccagtaccatgctgttttgattactgtagcttttcagtaacttaaaaatcaggaagtgtgcctccatcagtttttctttccccccaaattgtttaggctatttggggtttcttgagttccatataaattttagaatgagtttctcttgctcgttgtgattgtaatagggattgcaatgaatcagtagaccaccttgggcagtactgacatcttaacaatattaagtatttcagtccatgaatatggaatgtgtttccattatttctgtccttaatttctttcagcagtgtttcatagttttcactgtacaggtctttcacctcattggttaagttaattcctaagtattttattctttttgatgttatcataaataggatttttaaaaataatttctcagattgttcactgttaatgtatagaaatgcaactgatttttgtgtgttgagtttgtcccctgatactttgctgcatttatttattagaactaacagttttttgtggaatctttagggcattctacatatgagatcatctgtgaacagacataattttacttctttctttccagtttgaatgtcatttatttcttttttatgcctaattgctctagctaaaatttccaatattatgttgagtagaaggggcaaaagtggacatcctggtcttgtttttgattatagagaaaaagcttctagtctttcaccatagagtatgatatttgggatgtgattttccatatatgatttttatatcagtttcattctattgctagtttttttaatgtttttgtcatcaaaggatgtagaattttgtgaaatgctttttatgcatccattgggatggccatggaattttttcccttcattatgttaatgtgtatattaccttgatcaattttcatatgttgaaccatccttgcattccaggaataagtcctatttggttatggtgtgtaatccttttaatatgctcctgagatttgcttgctagttttatgttttatccatgctgccaatctctgtgttttgatgggaaagtttaatccatttatatttaaagtaattactgttgagggacttatttccatcattttgctatttgttttctataagccttaagcttttttgtccatcattttctgcattactgtcttcttttatgtttagctgattttttatagggaaacatttaaatttctttctcatttccttttatatgtattctatagttattttatttctggttaccagagggattacatttcacatcttaaaattataacattctaatttggatttataacagcttaacttcaataacatacaaaaactcagctcctttacagctccttatctacccactttggttgttgatgtcacaaaattccttctttatacattgtggtgcccaaaaccacaaactaataattctgtttttttaatttttaatttttgtgggtatatagtatgtgtatatatatttatggggtatatgagatattttgatataggcatacaatgtgtaataatcatat

SEQ ID NO: 469063 - DNA, 1624 bp, Homo sapiens
cctggcctgttaggtggcacatccccaaccactgccaccccagatggcttcagcactgtgtcaagtggttatggaacatgtgaaacctggcatagatgggttgccctgaactttgggtgggctcgagccagcatctgaacagaaataactgcagaccccttggtcaggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaagtttccagagagtattcggctatgagccatctgcagctggggagggtgcaggccctggcgaggggttcccagggaagccctgccttccacacccacgcggccttccccaccgcaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagtccggtttggaaaggactcctcaatcaatgatggaagcatggcactggctcagttacgttcctattgaaaacactcactgctgtgagctgccatctttgaccgtcctgtggcccccaaacccctgcccaactccagatgcccagcacaaacagcaggcctaatgcgcctccaccctggactctggcagcttggagtgcacggatacgcctttctgaacaccaacaatggctacatcctctcccatcccgacctccggcccctggtaggtacagatcttctttgccttgggatccttactgtatgggatttgggggtaattcacaaaaacgattaaaacaacaaacacacattgggctccatttaggaacccagtgggtaatatgagaaaaaaaatgtattcgagtcatggtccctgttttcaagttgtttagattctatcagaagagacaaggcaaaaacatgtgaaatgactgatgagtgggccagagagcacgtaacgaagtgtgcagttttgaggctaaagagcccgcagggccattattcacatctgcttggagtctctcagaactctgggggcctgcgaagttgggtgaa

SEQ ID NO: 469064 - DNA, 862 bp, Homo sapiens
cctgggccttccaagcttgtagagacaaatgattggattcagaatcagagagctggttaccaccagcagcaggaggcgatgtggcaggtgagaagtgtgcagggagcacctccaatgaatgtttgtgactggaatggccgttatgagtctgtttctcatgataaccgacttggagaagtcaggctggggaggtggactggcccttgggtgctccagaggccatcgtgtcacagatacaacttgggaccgagtttctgccacctacaatcagaaacacccccaaaacatgtctccccatggaaggttccgggaactcttggccactccattctgtgtgaccaaaattctccaaagggaaaagtgcttcctgtggatgaatgacatctgtatgaaaagccagccagccggccgatttctgtcctttgaagacgcttgtcagcgagtgctgcgattttctttacagcagttttaggttcacaacaaaatcgagagttgccgtatcctctctgccccaatatgtgcatagcctcccccattatcagcatctcccaccagaatcgtacatttgttacaaatcaatgtacattgacacatcattacccagagtctgtagtttacattaggattcattcttggtgtggtatgttctatgggcttggacaagtgtataatgacatatatctgccatcatagtatcatacctaggatttttgctgccctaaaaatcatccgtgctctactacttcatccctccctgctccctccaacctctggacaccagtgaccctcttactgtctccatagttttgccttttccagaattccatatagttggaatcatacagtatgtagccttttcaga

SEQ ID NO: 469065 - DNA, 1321 bp, Homo sapiens
gaaggctaagggagtgtggcgggcggctccgggagccaacatgcctcggtatgcgcagctggtcatgggccccgcgggcagcgggaagagcacctactgtgccaccatggtccagcactgtgaagccctcaaccggtctgtccaagttgtaaacctggatccagcagcagaacacttcaactactccgtgatggctgtatgggacattccttattcctttggcccagacagctttgttgagcctggtatcaatgcgcacatctggagttcccatctccttcatggcaaatttctgaatctctttgagtgcctgaggggcacgcttcttgaagcccactccatagatgtgcttgtgaatgttgatggtgtattctcgggttaccacttcgttgatggcagaatggccctttttcttctcgccacccttctttgcaggagccattctgctgggtccaagttggaaaacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaagcttctagagagtatggtatgtgcctgtggagaaaaagtgaaggacccgattccagtgccttccccactggacactggggtttcaaagatgaatctgacaattccagtcctcgaggatttcactgtctcataggcagggctgacagaaattcagtaaatttacacaaatttactgaagttccgtggatgccagacactggggatagaacagggatgcacagtg

SEQ ID NO: 469066 - DNA, 1976 bp, Homo sapiens
gtcatggtctccattttgcagattcgggaaaaggtggttcagttattatccgtcctctaattgggactccgagccagggctatttctcgcgctggcgcggttccaagaagcatcccagccatcactctttcacctgctccttagagaagggaagatgagcgagtcgagctcgaagtccagccagcccttggcctccaagcaggaaaaggagggcactgagaagcggggccggggcaggccgcgcaagcagcctccgatgagtcctgggacagcgcttgtagggagtcagaaggagcccagcgaagtgccaacacctaagagacctcggggccaaccaaagggaagcaaaaacaagggtgccgccaagacccggaaaaccaccataactccaggaaggaaaccaaggggcagacccaaaaaactggagaaagtcctcggaggaggagcagtgaaccgtgcgtgccgcctgctcctcactggaggagcagctgccttctgggactggacagctttgctccgctcccaccgccctcgccccttccgcaggcccaccatcaccaccgcctctggccgccacccccatcttccacctgtgcccacaccaccacactacgcagcacaccagccactgcagggctcccatgggctgagtggggagcagttttcccctggcctcagttcccagctccccccgcccacccacgcatacacacatgccctcctggacaaggctagcatctcacttagccgcaccctgcacctgctgcgtccccactcctccctgcactaggttggacagcccccttcggctacaggaaggcaggaggggtgagtcccctactccctcttcactgtggccgcagcccccttgccctccgcctgggatcgagtacatattgtggtgatggagatgcagtcacttattgtccagcctctggctgatgtccacaaactcattaccaatctgtttggtactagtccacgttgatgtacactctggtgtacacactttctctcagccagcctggcccgtgggccacgtttagaggatatgaggcggtattgtgcatattgatatgttgctgcacttggcttcactgttcaggatttatttaggttgataacgtagttctagcttatttcatagctgagcatcatctgaatatgcctgaatgtactcacccattttcctgctggtggtttcatttttctccaaaaactctgctgtggctcttccccatgtgtgagattctctaggagtggacctgcttggggcgggggcaggggtaagggtgttgagaacacctctaggctgagtgatttcggtcattccctagagttcatcctcgcaagctgctccatccttggcatcagaagacccacttctcgagacgttacctcgtgattttaatttgccagtggagttgagcatcttttcacatgagctatttgttttctctcgtttacaccatttaaccatgtttcttttgggggtatagttgcattttccaagtattttgatccgtttgcaatttattgggtgtaagggatacagctttatttttctcaagatgaccccccacataataatccaactattacctactaagctgaaacaccacccttctcaagtgatgcactgaattaccatagctttaagaggtttggtgtgcttccttggtttttgtctgcctgatgtttgttaggattggcctaaggccaccattggtattctcatatatcagtatgaattatatgtcactcccattcagctgtcaattttccctgaatcattaaacatttctaactaggaacaaaatagttcctgtctaggaacattgacccagtatgacccctgatcgctttttgttcattccaaggcattttttccttctcgtgcccgattgtactgactagcacctctagaacagtgtttggtagtgggcaagagtggacttggaatgcaactctaaagc

SEQ ID NO: 469067 - DNA, 1640 bp, Homo sapiens
gtggccgaatgggaacagctccagtctacagctcccagcgtgagcaacgcagaagactagtgatttctgcatttccaatggaggtactgggttcatctcactggggcttgctggacagtgggtgcaggacagtgggtgcagcacactaagtgtgagacaaagcagggcaaggcatcgcctcacctgggaagtgcaaggggtcagggaattccctttcctagccaaacaaatctgtgacagatggcacgtggaaaatcaggtcactcccactctaatactgtgcttttccaatggtcttagcaaacggcacaccaagagattatatcctgtgcctggcttggagggtcccacgcccacggagcctcgctcattcctagcacagcagtctgagatggaattgcaaggtggcagcgtgactgggggaggggcgcccaccattaccctggggaggggtgccactcattacctactgaggcttcagtaggtaaacaaagtggccaggaagctcaatctgggtggagcccactgcagcacaaggaggcctgcctgcctctgtaggctccacctctgggggcagggcataggtgaacaaaaggcagcagaaacctttgcagacttaaatgtccctgtctgacagctttgaagaaagtagtggttctcctagcacggactttgagatctgagaatggacagactgcctcctcaagtaggtccctgacccctgagtagcctaactgggaggcacccccaagtaggggcagactgacatttcacatgactgggtacccctctgagacgaaacttccagaggaacaatcaggcagcaatatttgctgttcagcaatattcgctgttctgcagcctccactgctgatacccaggcaaacagggtctggagtgaacctccagcaaactccaacagacatgcagctgagggtcctgactgttagaaggaaaactaacagacagaaaggacatccacaccaaaatcccatctgtacatcaacatcatcaaagaccaaaggtagataaaaccacaaagatggggaaaaaacagagcagaaaatatgaaaattctaaaaataagagtgcctctccccctccaaaggaacaactacatgatgaatgcacaagcttcagtagccaagtcaatcaactggaagaaagggtatcagtgattgaagatcaaatgaatgaaatgaagcaagaagagaagtttagagaaaaaagagtaaaaagaaatgaacaaagcctccaagaaatatgggactatgtgaaaagaccaaatctgtgtctgattggtgtacatgaaaatgatggggagaatggaaccaagttggaaaacactttgcaggatgttattcaggaagacgtcctgaacctagcaaggcaggccaacattcaaattcaggaaatacagagaacgccacaaagatactcggcgagaagagcaactctaagatacataattgtcagactggccaaagttgaaatgaaggaaaaaatgttaaaggcagccagagagaaagaatttcatatccagccaaactaagcttcataagtgaaggagaaataaaatactttacaaacaagcaaatgctgagagattttgtcaccaccaggcctgccctacaagagct

SEQ ID NO: 469068 - DNA, 833 bp, Homo sapiens
acttagcaaaattccaaagaaagttaaattctcaacataggccatgactgatgatacaagaagaagttacaaaactgggctcattgctatgaaaggaaatcctactaatggacaaagctgcagtcagtgtgccttgtcatatatgttgtgtggaaaagagaagtgggcagcagcatatggcttggtcagttggcaaacagctgattgcaaaaaatttgaaggatcagagaacctccagaggaaaaggtatgtggatatacttagaggaatgggcatgaagtgtaaatatatttgcattattaatgccctccaaagagcattcaacacaggaaagacaattcaacaaccaaacagaatcagtcaaccagctggtatcagccagagtctgtcactggtcagcccagtattgaattatgggtgtataaatgtagtagcaatagtagaagaagactatgaaggccccaacaggatgcctcccactcaccaagaggctgcctgcatcaatgatagatcaacatggctttataacagactggcccactcacctcaacacaagatatctgcaagacacccaccccgaccattggcctgtgttgagaatgcatcacaacctaatcactcttttttgcacaatccttcttccttctcttccaccgcaggtgttaatcctgagagtactctccagtcaacttcctgcttacaaatttctatctcagagttttgctgtctgggagacctggcctaaaatatatataattataccataatagaaaccaattgcagatgacactgcatttcagctcatcacttaattctgctaagttgtgttttaa

SEQ ID NO: 469069 - DNA, 949 bp, Homo sapiens
tgcctgctggcagatgatagcctggtggatggcaggcagtttacaatacctagcccactgcctgggcaccagtgccttactgggaaggattgacttgtgatgggattttagggatggtgacaggcagccagagggaactccacattggtcaacctatttcatccttatcagaagcttaaatggtaaaaccaccttgtcttcagaaacgaagaaatgctgggtcagctgaaattcgagccctcactgtcagagaagctaagcagaaacatcttagaggtagggacaggggacaaatttcagacaaagatcatggtcagggcaagcctgccaagaaggctgcacatgaagcctcagatcagaaacctgatggagtggatgtatccaggcacattctactacaactttgaaaacagacccatcctctcaggttggaacaccacctggctgtgctacaaaatgaaaacaaagaaggacccctcaaagccccctttggacgcaaggatctttggaggccaggtctattccaagcctgaacaccacccagagatgagattcgtagattggttctgcaactcgaggctgcatcgtgaccaggactacctggtcatctggtacatctcctggagtccctgctcagagtatgcagggaacgtggcagagttcctggccaaggatggcaaggtcaccctgaccatcttcgttgcccacctctactacttctgggaagcagattaccaagaggagcttcacagatggtgtcagaaaaaacagtccacatgccagcatgaagatcatgaactatgatgaatttcaacactgttgggacaaatttgtgtacaaccaaagaatgctatttgatccttggaagcaactgaatacaaattatgcattactgcacagcatgctgggggagattctcagacacattcacttacaattttaccaatga

SEQ ID NO: 469070 - DNA, 734 bp, Homo sapiens
actacttacccccagccgctgcacacaaatacacccaagggatgtttagcaatgtctggagccatttttggttgttacaacttggggaggggcatttagtggataatgctgaacgtgtcatcatttgggaggggcagtctgagagggttgcagaagatgcgatgactgaaaatcttcctccagccagcccctgctcagcagtccccaggagcccgcaatggtccccgattgctggctgctcttggctggtttccaggacagccgtgccctgctctgagctgctctatggagtggcctatgtggcaggaactgaagataatcttcaatgccagccagcaaaaaacggaggtcctcagtgccctgctctgagctgctctatggagtggcctatgtggcaggaactgaagataatcttcaatgccagccagcaaaaaacggaggtcctcagtccaacatcccacaaggaaatgaattctgccaacaaccgtgtgaatgagactgcagtcttggtcagaaatgcgattgcagctttcagaagagactctggaatagaggacccaacaaacggatgcctggactcctgacccaaacccacagtaatggtaagatattaaatgcgtgctgttctaagctgctaaatttgtagtcatctgttatccatcaataggtaactaatacaatcgtcatactcaaaataaatgggtcatttattctaatatgtattgagagatccc

SEQ ID NO: 469071 - DNA, 1713 bp, Homo sapiens
ccttgagctagatacagaagcagctagatacagagtgttgattggtgcactcacaaaccttgagctaaacacagggtgctgattggtgtatttacaatccctgagctagatataaagactctccaagtccccaccagactcaggagcccagctggcttcacctagtggatcccgcaccggggctgcaggtggagctgcctgccagtcctgcgccgtgggctcgcattcctcagcccttgggtggtcgatgggactgggcgccgtggagcaggggtgatgctcgtcagggaggctcgggccgcacaggagcccatggagtgggtgggaggctcaggcatggcgggctgcaggtcccgagccctgccccgtgggaaggcagctaaggcccggcgagaaatcgagcacagcgctggtgggccagcactgctgggggactcagtacaccctccgcagccactggcccgcgtgctaagtcccccattgcccggggccagcagggctggccggctgctccgagtgcggggcctgctaagcccacgcccacccggaactccaggtggcccgcaagcgccgcacgcagcccctgttcccgctcacgcctctccctccacacctcactgcaagctgaaggagtgggctccagccttggccagcccagaaaagggctcccacagtgcagtaggggggctgaagggctcctcaaatgccaccaaagtgggagcccaggcagaggagatgccgagagcaagcgagggctctgaggactgccagcatgctgtcacctctcatgatgacaacaatgtgcaatgttacccttaaccttccagtgaggggcattttgagttgctttatattgactacagcaaagcctcattcattcaggctctattaaactgaaattagtgatcacttggagagttaatctttacttctcaaatcatttcttaccaagtttggtaatgcagttgtgattataaagatgatcgaaacacttaaaaagatttcaaatcaacttacatggcttttaaaaacacccatttatatgtaaataattatcgactctttacaaataattttgtaatttcctaaaaactctaatagacaacgctgctgatctacttccaggctgaaaggaaacaacaacaataagagcgacagcaaacatttattgagagctgtaaaatgtgtttcacccaattgtaatgtaaagaatcgaaaattttaaaaaatttccaaaaaaattacatgattgtagttggtaaaaatgcacccatttcaggaaggcccctgtgcctgtgtataaatgatgtgtcttgaacgctgctgggaagctctattgctgagattgagaagaccttagaaacggaaggacactcttcatcagaggacattaattcatttgacaagcatctagaaaatgaactacttggggaaaggaaatactatttgcttaacagaaggctatattttagcttcattggggcgtatcacttagatttctttcgatccctcaatgttcactaaatatagtttaaaaactgagatgtgaaatacagacacaaaatggaaattttaagccaagcctacttttccccacaaaggcatttttgtgataccccaccatattaatctacagaatatttgtaaccaatatttgtgaactaattggatgttttgtgattttaatcacaataggtttacctgtttatatgt

SEQ ID NO: 469072 - DNA, 2109 bp, Homo sapiens
gtgacccactggctggccgggcggtcagctctggtaggtgatagtggcattccagacagcattcttccagtaagatgtggcctgtggcagaaaactcagcttacgcagtgagggaatgcaatgaaccgtgcatctgtgaagtccatgagcagcgtcagcttcaagtatggatgcatccagaggctaccggtgtcctccgcatcaccatcattatcagtaccatcatcaccattgccatcatcaccatcaccatcaccatcaccatcatcaccatcatcaccatcaccatcaccatcatcaccatcagcatcaccatcaccatcatcaccatcagcatcaccatcaccatcaccatcatcaccatcaccatcatcaccatcatcaccatcacagtcaccatcatcatcatcaccatcaccatcatcaccatcatcataagcatcatcaccatcatcaccatcagcatcaccatcatcaccatcatcatcactatcatcaccatcaccatcatcaccatcaccaccatcaccatcaccatcatcaccatcatcatcaccaccaccatcaccatcatcaccatcacagtcaccatcatcaccatcatcaccatcaccatcatcatcaccatcagcatcaccatcatcaccatcatcaccaccatcaccatcaccaccatcaccatcacagtcaccatcaccatcaccatcatcaccaccatcaccatcatcaccatcacagtcactatcatcaccatcatcaccatcaccatcatcatcatcaccatcagcatcaccatcatcaccatcatcatcatcatcatcaccaccatcatcaccaccaccaccatcagcatcaccatcaccatcatcaccatcatcaccgtcaccatcatcatcaccgtcaccatcaccatcagcatcaccatcatcatcagcaccatcaccaccgtcaccatcatcaccatcatcaccatcaccatcaccaccgtcaccatcatcatcaccatcatcaccaccatcaccatcatcatcaccatcataatcatctccatcgccatcatcaccagtgtcaccattatcctgtgctctgggacacctgtgaccggggacacctgtgacctgggacgcctgtgcctggagacacctgtgcctgggacacctgtgcctggggacatctgtgaccagggacacctgtgcctggggacgcctgtgacctgggacacctgtgactggggacacctgtgcctggagacacctgtgactgggacacctgtgcctgggttacctatgatcaggaacaccctgtgcctggggtcacctattaccaggaacactgtgaccagtgacatccgttctggggacacctggactcagtcgtgaacaaccccaggccagccgtgcagggaggtcgggcttcctccatggcacggtggaaggagaaagctgggtgaggaccaggcctcaaggactgaggccgggattggagctttgccagagcccggagcagctccaggtccaggctcctccctaagagctgaaggccttgagcaactggcaattcattctcacctcggggtaatgggattacaaaaacaaaatccttccatgtaggggctgtcatcgtagtaaatgaaataaaaagacaagcaacccagtcaaatgtggacaaaggacttgaataagcatttcccaaagtagatatacgaatccccatgagcacatggagagagactcagacatcatgagccataaaagcaacgcaaacccaaaccagagggacagtctgctccacatccacttagatggctatgtttcttttttcttttttttaaaggaaaatgttggggatgtagagaaattggaattctcacacattgttggcaggaatgtgaaatggtgcagtcactgtgttaaaacgcctggcggctcctcagaacgttaaacgtaaagtcaccatttgacccagcagttccactcctaggcgtatgcccaagagtgcacaggaacgtttattccagcactgttcataataagcgaatagcagaagcaacccacatgaccatcaactgatgagtgggtttctagcggtggattcacacagcagactatt

SEQ ID NO: 469073 - DNA, 1277 bp, Homo sapiens
atttcacagtcacaggaggagaggaagcttttaatccacacgtctacagcccgataggcggcagtgtgtgaacaactcagttctgtgattctgctctggcctgcagctccatggctggcttggccctgcctctgcttgccattattgtttcccatcgtgtggggtggctgccctctgctggaaagggccacagtgttacaaccttctttgtacctgagtttggagtagaagttgctgaagaccagactactgtgaatcctgctgctcctctgagtctagccacccagtggagctgccacacttgggctggtcctggggcatgtctgcaaggaaatggctgggccgtggagctcccaaacgtccctgtcttttgtgttatgctaccagggcagcagatacttgggcatgtgagggggagacaaaagagtgttccttttccctcttccatccttgcatacccgagtcctggaaaccttggcaggcatgaccatgagtgtcaaagcgacttgcacccgtgaagcagggaggacctagaaaataggaattatctgctctgacctattcctctatcccctcaactgtcagtagccttagagttcccttgacctcatttatgccatggatattaatgtggcttttatctgtgaaacgggaagcttgggttttctatttcttcctgatacactcttggtaggttgtatgtgttcagacatttattcatttcctctaggttttccagttttttgatggttttctgtatttgtatcatttgagtcatttttctcatttgtgtgttctttgtaccagtgggttttatagttttgtgtgttttcatgatgcacattaaatatatcatcttattatccgttgacctgtaaagtgtctgctgaagaattcattgttcattttatggcagttctgctacaagtaactacaaggctttctcttgctgtttttagaattctttatttgtctttgacctttcacagtttgaccatactgtgctatggagaagaccttaaattgtatctatctggagatctttgagctttcttatctgtatgtctaaatctcttgctagaatttttttctagtgattattttgttaaattgctttctattactttgatatttctcttcactttctgggacaccacaaatgcaaatatttgtttgctttatggtgacccaaatgtcaaataggcttttctcattatttttgattcatttttctatatttttgtctgactggttttttagacctttctttctttgct

SEQ ID NO: 469074 - DNA, 3088 bp, Homo sapiens
gactaatgaagtatcaggggttggatcctggaccagaagagaaacattggtggaaaaattgatgaaatgcacataaaagtctgggtaataaaagccatctgtgacaaacctacagccaacattatactgaaagggaaaaagttgaaagcattccccctgagaatgggaacaacaaaaggatgcccacttttaccacttctattcaacgcagtactggaagtcctagccagagaaatcagacaagagaaagaaatcaagggcatccaaatcagtaaagaggaagtcaaactgtcactgtccatcgttgatcctcatctctcaccctacacaaaaatgaacccaagatggatcaaagctttgagtctaagacctgaaaccataaaaattctaaaagataccatcggaaaaacacttctagacatgggcttaggcaaagactttattaccaagaacccaaaatcaaatgaaacaaaaacaaagataaatagatgggagttaagtgaactaaaaatcttctgcaaagcaaaaggaaaatcagtaaacagacaacccacagagtgggagaaaatatttgcatactatgcatctgacaaaggactaatatccagaatctacaatgaactcagactaaccagtggcatcatactcttcctaacaagctcatatttctccttgaaggctcagataagtgacatctctctataccacccatcccatacagctttcattttgggtatccatatcagagtatagatgctccttgacttatgttgcggttatgtcctgataaactcattgcaagttgaaaatatataagatgaaaatgcatcgaatacacctaacctagcaaacatcataatttagcctaccctaccttaaatgtgttcagaacacttatattggcctacatttgggcaaaatcatataacatcaagcctattttctaataaagtgttgaatatctcctgtaatttattgaatagttcactgaaagtgaaaaacagaatggttgtataagtattggaagtctagtttctcctgaatgtgtattgcttttgaaccaccataaagtaaaaaaaaaaaaaatcatttaattcagggactgtctgtagttcattaagaaggttaatgtatctaaatacagtctatccaggcttatcttcatgggacttggttatctttgtttttcatatgaagaggtataattggccagtttcctgtaaagctgaaaaagcccagtatctcttgaaataaaatactttgcttttgtacagtgtaagttgattaaattgttgccttttttccctatgtatctttcttataaacttgctttgttaaaaatgttaattttttcacattttccttgtatttttcattttgagtttcttttacaaggcttctctttattgacagtatatttacttaactctttttgttgatcagcacaagtcattttgggaagctgcccattatagagggcagctaagcacactcttcaaattaatacaaaaatctgtggccaagtgaatatttgatgtaaatgtgaaattcttcatgcttgccaatgaaaatctgtctttttaatcaaactacttttcttcttggttaatagaatcataatagtaaactcctttcattttttttctcagtctcctcgatttgaatgttgttaccttattattctttatctcatgattttcttttgtttcttaaatgtcagaatatacctgtaattccagttccctggtgtggctggcagcctctaacagaactctcaatgatttctgtttcctggagttcccctccttttgagtgtgggttgaatttagtgactcacttctaatgaatagaatgtggcagaaacatatgaattattaaagaataataataatgtgaatattaagaaataggaccctgttaatagtatggaaactctgatgtgctcctctcaatcatactttccgctctcacttgccagagatttattgcatgttaatgtaatctcagaacaacacattactgaaattgggctactttaaactttatattaaaattgtaatgcatacatttctattttatcttttatcttgctcaattctatagattttaaagtcattcatgtgacagcaacaaaaaagcaatccaggcactgttatcttggtggtatttgtgtcatagcataactagcctatcctgactctggaataacatattaacatttattatgacttatggtgggatatggattttattatattatttaatatacttttccatatgtttggacaatttcaatatttaaaattaaattaaaaatagtattttaaaatgttttcatagctacatatatttggtctattttaaagcataggaaattttaggcttgggttaaacaacttgtttctgagccaaatggcaaagtgaatccctaagtatttaattcaaaattcttatgattatagcccattaaacagacctttattttctttacttgaattcaaattctttgtgtcccttaacacagaagtttactaattagtggcctttcctggtttctggtctcagaatcctggccctggatcaaatactgagagagacactattaacctgctataatccctgcaataaaacatgtgggaaaggatcagggatcactgctctgaactacatttcatattatattcatctgatagttgattttcaaggccatcagaaagcttagaagtcagcacgctacagaccttcggcagtattatctgtgcatttcacagcctcattcactctagactggtttttatgttattctctaagctttgagaatttccatggtaagtaggtgctagaaatgctagaaatgtggactgacagaaattcctcacagaaagctttcccaaagtccaatcagaaataagcttatcagaaacaatcagaaattcttgtgtcttttctgaactagtaggtagagttttagaggtcatttctttttttgacccatttgctaagaatcatcttttgtagagcacaggctttatgtagtactttatgttttttgtgaaataggaaaacaccagtgtctagatcccagatc

SEQ ID NO: 469075 - DNA, 597 bp, Homo sapiens
gctggcttcaagaaccagacctccaggaaggcattagagcagttcgctgagaggatccccaatggaactatcaggcagattccacagggcagcttacaaagctgttaattatgacaagcttaaagaaactacccaaggtaaagacgaaaacccagcccagttcatggcccgcttagcagcaacccttagacgctttaccgccctagacccagaagggccagaaggcggtcttattcttaatatgcattttatcacccaatccactcctgacattgggaaaaaacttcaaaagttagaatctcgccctcaaaccccacaacaggaattaacctcgccttcaaggtgtacaataatggagaggaggatgtgccctgtctgtgcgggcccccactggaggtcagactgtctgactcacatcgccgccactcctaaagcccctggagcccaaacccaacgttccttggctgactccttcccagatctccttggctttgtggctgaagactgacgctgcccgatcgccttggaagccccctggaccatcacggacaccgagcttcaggtaactcttacagtggagggtaagtctgtcccctg

SEQ ID NO: 469076 - DNA, 1506 bp, Homo sapiens
gttgcttccctatttaaatggccttatggggtcagagcctccacacagagtccctactggggcaccaccaggtgcagctgtgagaagaggaccaccatccttcagacctcagaacagtagatctatcgacagcttgcaccctatgcctgaagaagctgcagacactcaacaccagcccatgaaaacagcagggagggaggctgtcccctgcaaagccacaagagtggagctgcccaagagcatgagcacccaacttttccatcagtgtgacatgaatgctggattcaaaaaagacatggattcaataaagatcattttgaagcttcaagatttgactgctctgctggatttcagactggcatggggcctactgtacctacgttgttctggccaatttctcccatatggaaagacagtatttacccaatacctgtacccccattgtatctagagttttttgcagaatattaaatgagtgcatttagttgtaataatatttattaactagtaggtgacaaatgtttatctgaaattaagaaaaagaatcctcttcctgctttttaaaggcaagggaatgtttattctggactctaaggtatggaactgtggaatgtttctgttggtagaaaaagattagtctggattcactgaaatatagttgttgaaattaggacacataaaagaatctagaaatagtcattctgtaccactataaagaaaatgtctgttgaggatgtcagggtgttagccttgaaaaagcttgttaaaatccagatgaatgtggaggtgacataatagccctagattgcctaatccagttttgcctacaaaaagaaataaacttgtatcttatttagcctccttgaatttgctctgtatgttacaaaagtgatcagatatccttattaattaaaaggagaaaattagagaaaaaaataactggttgattctagaaaatgtcaatgtttggtctttgtatctatttttaaaacagtaattttttatattatattttattgtgtattttaatatatttatgttgaatttttaatttataaatttccttggatatttttaccattttactcttccaaaggagctttaaaatcattttgttcagttttcattgtattaaattgggatttatatagagttgaccttagtttttaaatattatcttcctacattgaagttatatattttgttaggaaaaatatacaacttcctattatatattaatatattaatgtattgctgtatatatattagtaatgtataaatgtattattactacattaatacttaatgtattgctgtatatatattagtaatgtataaaatttcttattgtttagttgtgaaagttatatctaagctattttctaaatgttttctggagtatacatgtgtacactcatatttgtttaacatttatccaacacaaatagtttttaaattgttttaaacaatctgagaaaataatttgtttgtaaatatggatatttc

SEQ ID NO: 469077 - DNA, 1787 bp, Homo sapiens
cgctgattcaagtttaatgagaccctgagaagagaatccagtcaaggtgctttagacttcagactttcagaagttcagaccttcagaactgtgagattataaacaggtgttgcgggaagtcagggaccccaaatggagggaccggctgaagccatggcagaagaatgtagattattgggacctttcggcaaaagctgttctaaccccatctcagcatttacaattccatacctggtggtcagaggaggccctttctctgatgcttatgcccaattaaactttgatgcccttaccacagaacaagtaacaaaggtgtgcatgagagcttgggataaattatgtgctccaggccaaactcctgtttcttttaccacagttaaacaaggtcaccctgaattataccctgattttttggctaaattacaagatgctgttaaaaaatctgtctctgatgagtgcgctcaaggcattctccttcctatgttagcttttgaaaatgcaaaccatgaatgtaaaatggccatgcgttctgtccaacgacaaaatttacctgatcatgaggtgttgcctgcatatattaaagcttgtgaaggcattggatcagatgcccacaaaactattctgtgggcatgggccatgaaggacaccaaccacactggtcccattaattcttctcttggagcctgctatgattgtgaacaacttgaccaaatagccatattaattggacaggctcagtgcagaatacttcaaatttctggatttgatccaaacttaattgtaattcctttaaatcggctcgaagttcaagctgcctttcaacattctgtaccatggcaaattcacttggctgattttattggtgttattgacaatcattatccaaaaaacaaattgtttgattttataaaaatgatgtcttgggtggttcctctattaaccaaagatcaacccattcctgaggctgttacagtgttcaatgatggctccagtaatggcaatgccagttacgtaggtcctacagacaaacttatttctacctcttatacttctgctcaaaatgtggagttaattgctgtgattactgctatacaggatttccccaaacctttaaatattgtctcagcttctgcttatgttgtacatgccactaaaaatatagaaactgctactatcaaacatattgataattctgaattggcttctttattttcaaggttacaacaggcggttcaccaacatagacaccctttctatattacacatactaggtttcataccactttaccaggacccatgtctgccagtaaccataaagtcgactctttggtctattttgcaacccaagaagctcaggagttccataatctcgctcacgtcaatgccgctggattaaaagataagtttgctcttacctggaaacaggctaagtttattgttcacagctgccctcagtgccaggtcttcgtacttccaaatcaggaatctggcattaatcctagaggcctaactcctaatgctttatggcaaatggatgtgactcatgttagctcctttggcagactgtcatatgtgcatgtctctgtagataccttctcaggttttatctgggctacttgccaaagaggggaaggcacagcccatgttaaaaaaaaatctatattcttgctttgcagttatgaggcttccatatcaaataaagatagacaatgcccctagaattgttagtaaggtttttgattcatttatgcaacagtgggaaatttcccatattactggaatccctt

SEQ ID NO: 469078 - DNA, 618 bp, Homo sapiens
ccagccacatagtcagttctgatgatggaacctgggtacctcgttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcagtccaggactgaagataaatcagtgaacaaaacagacacaattcctgctgttatacagtccacattctcatgagagaaagacaataaacaaatacatatatagtatgtcagaagatgataagtgctaagatcacagagaattaattctcctcactttctt

SEQ ID NO: 469079 - DNA, 1944 bp, Homo sapiens
tttcaattttattgttttaacagcagcatgattaatgagtgcctgtcagttcaatgaactggtgtcaccccatctcaggaaatcattagcaaataacttgataaataacttccccaacttgatggccagtggaaggctcaagagtcccagcacaggatctagagtggacctatggctacagccatggtgccctgtgaggaaactggtttccggtgcagagcaggtacctgggcagatgcaaagagctgagccggcaagtttgcctcaccaggaggaagctgatgcccctgaggccctgttcttggagaacccggtccctgaaatgtccattgtgaatgtgataatggtaatagctataataatgatggtggtggtgatgatgatgatggtgagggtgatgatggtgatgagtgatgatgatggtgataatgatggtggtggtgatgatggtgatggtgatgatggtgatggtgatgatgatggtaatggtgatgatgatggtgatggtgatgatggtgatggtgatggtggtggtgatggtgatgatgatggtgatgatggtgatagtagtagtgattatggtggtgatgatggtgctaatgatgatgctggtgatgatggtggtggtgatgatagttttggtaatgatgctggtgatgatggtggtggtggtgatgatagctttggtaatgatgatggtggtggtgatgtcggtgatgattatcatgatagtgaagatgatgatagtggtggtgatgatggtgatgatggtggtggtgatggtaatgatggtggtgatggtgatcatggtggtgatggtgatcatggtgatggtgatgatggtgacggtggtgatgatgctgatggtggtgatgttggtgatgactatcatgataggatgatgatagtggtgatgatggtaatggtggtggtgacaatggtgatgatggtggtggtgatggtaatggtggtgacaatggtgatggtggtgatgatggtgatggtgatggtgatgatggtggtggtggtagcgatgatgatggtagtgatggtgatgatggtgatgatgctgatggtggatgatgatagtggtggtgatggtaatggtggtggtgacaatggtgatgatggtggtggtgatggtaatggtggtgacaatggtgatgatggtggtggtgatggtaatggtggtgacaatggtgatgatgatggtggtgatggtgatgatggtgatgatggtggtgatggtggtgatgatggtgatggtgatggtgatgatggtggtggtggtggcgatgatgatggtagtgatggtgatgatggtaatggtggtggtggtggtgatgttggtgatggtgatcatgatagtgaggatgatgacggtggtggtgataatggtgattatgatggtggtgatgttggtgatggtgatgatgacggtgatggtgatgacgtggttgaggaggatgacagataagaatgaggagaatccaatagatacatctaaaataagtaattatctgtgtgaccctgctaatcacagctggatttagataaatttgtccatattcatcaagaactcactaagaaccaggtgctgtgctaggaattttttcaacagagaggcccccacatgtgcacaataactcaggtataaaagtattctctgtggccttgatggtagcagcaaaatagcagaactgtccaaatgcccatcagtaggcaagtggtggggactgggaggctcttctgcattcatagctgccgcattccatcagatcccaaaggcaacaccagaagctcctctgacatttcttcccctgcatctccccctgtgtccagtgaggctgggccatgggcagggaccagagggtctgcctaagaatagggtgggccccactgtctgctttctctgaaaaaagctacaggagccacaaagtctgg

SEQ ID NO: 469080 - DNA, 911 bp, Homo sapiens
atttaattaatcctgaaaagacgagtgaatgagcgaacctaagtgtgggtgcacagagtgtcaccatattctggaactcaagttgtgtttgggtctgtttttctctgcttttctgattgacttttccttgctctcggctgtgccaggcagagctaatgtccatgcatttcacaaacacgggaaaattcagaagctgttcttgctaggagatgtgcccggagaggaagatgccagccaggaaacaaagccaagtgttaaagcctcctatttgtctaactgcataagtaatgcacattcattactcataaaggcaggaaggggagggggtcaggaaataatgacaggcaaagaaaataaaccctataaatttgtattatcagggacaaatcactgtgaacaattaggattgaattgaatttttaccatcttttacagtctcacttctaaaaaggcacacatagaatgtaataggcgtaaccttgtttatacctagatgggaccactttataaacaatattttgtcatctaccaatttcactagattgcagacaccattgcttctaattaacgcagatctgtgagacccgctgatttctgcagagcactcgtctgcctccatcctaaagttgagacagttccctgtgttcagttcttaggttttcccagtgtttttgctatcttgcactgggatgtaagcagtgtccctggatggctcatgaaccctcagcacagtccctggcagtggagtgggcactgtgcctgatgacactatgaccatcctccccaggtggcccctgtttccatcacagggctgagaggggctctggaaagttccctggacccccttctctgcccacgagcttctctgccacatctggttagatctaagagggaaatgggacaggagccct

SEQ ID NO: 469081 - DNA, 2612 bp, Homo sapiens
ggggaaagctgactctggtgtggcctttccctggtggctggtgtccaggagcaaggacacaggggatgctgggtcacaggggagaggacacagagaaagccagggacacaggggacaggatgcgggggatgccgggacacaggggagaggatgcaggggacacaggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggatgcgggggacacaggggatgcccggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggacgcgggggatgccgggacacaggggagaggatgcgggggacacaggggatgcccggacacaggggagaggacgcgggggatgccgggacacaggggagaggacgcgggggatgccgggacacaggggagaggatgcgggggatgccgggacacaggggagaggacgcgggggatgccgggacacaggggagaggacgcgggggatgccgggacacaggggagaggacgcgggggatgccgggacacaggggagaggacgcgggggatgctgggacacaggggagaggacgcgggggatgccgggacacaggggagaggatgcgggggacacagggcagaggatgcgggggacacagggcagacgatgccgggacacaggggaggtgatgcaggggacacatgcgggggatgccgggacacagggcagaggatgcgggggatgccgggacacagggcagaggatgcgggggatgccgggacacaggggagaggacgcaggggacgcaggggatgcccggacacagaggagaggacgcgggggatgctgggacatgggggaggggacccaggggatgttggggggtactacagggtagagttgggccagaaaacgtcttccataaagacccagatgggaaataccttaatcttcaagggccatgggggctctcccacagctactgaaacctgctattgtgtgaaagccgccaggcagcgcagagaccaatgagccgtgacaggctcccaccggccttccccacagaggacgaaactgggcaatgagagcccacagatacctcctgctcccttcctcctcttcctcctacttccctcctcctcctcttcctcttcttccttcagttccttctcctcctctcttcctcctcctcccccccttcctccccaactcctcctcctcattctcttcctcctcctttttgcccttctcctcctcctcctcctgtccctggtggacgaggaacctgagggtctgagacacaggaagctgctcgatcctccagccaggatgaggctgagggagagcccaggccaactggctctcagagtttggactttcaaccacgaattttccacaactgtgcggaaatcaagtggcatcagccccaacgtgggagcgatagggcgtggtggggactgtggcgcagagagggtgcagtcccaaggggagcagcggcttcacccacagatgctgcagcaaggagagccccgtgccagctgcccaggctgttggatccgttcagggatccggcttgcactcagccaggaggagctgccccgcacagctgtccaccagtctaggacccaggccacaccaccctgcacctggttacctgcagctcatcgtgctctgagctcaacccaccagacacaaccccttctcacggtcatacgggcccccgggctcccctgtgggaaaggccagtggaaatggcagcatggacggaggcatccgtggccctgtgatgcatggctgtgtcaatggctgatctgagaattcacccggtcctcagtgccccatccctgccgccccatcctgctgctcttctccttctctctcacaaacttctgcccctctgggctcctcactgaggaccaccaggactgttcctaacacc

SEQ ID NO: 469082 - DNA, 891 bp, Homo sapiens
gtgacagcatttcaattagaatattaatgacaattaataagaagcacgacagtcttttccctcagcagtcaatgactgagtcagcattttgaggcagcgccgcctctcaggctccaggacacaggacgccttgagactacatttcccacaggccacagcccagcctcccgtcttctaacagtcttcctagaaaggtgcgcatgttccgaccattagcacacggctggtgcgctcggtgcaggctatcggagcccgggacagggccgatccagccaggcttcagggtgcgggaaacggaagccgccgcattgccatggcaacagtacagggactgaatctctggtttatttcaatttcatatctacccggtagaggcccaccaaatacgatccagcccctgctctcaaggagaagtaaggaggacagcattcctggaaccaggagctcgagagaccacccttttcgggaatctagtgtacgtttgtatacgacttggaccaggatgtctaagagcagctatgtggaacaaaggcagggcagcaggccctgtaatgaccctggttggtgtgtactcaaaactggggaaaggagacctcatattgtgggctcgtgcaaagacctaactattagtaatgcttggatgaggggcttaatttatgtagcacacttgtgtttgggtaagaaaaagaacttgggtaggaatttgataacactaaaagccaacacttctcccttgctgtcatttgggggttggggtacaggtatagattttatgtatgtttatgttatgtggggtatttagagatccttagtattcttcaatggaaagggccagggagaccagatcttcatattttcaggctacttgctgagagattttcctgctcctct

SEQ ID NO: 469083 - DNA, 1489 bp, Homo sapiens
ggctctggaaacgatttttttggtctatgcggttttttgtttgtttgttttttaagaatgagggaggtgtatacatgtcttgtacctgctgtaataaattaccacaaacttggtgtcttacaaacaaaagaaatttttttccctcacagttctggaagctaggagttcaaaaccaaggtaaccacagggttgtgttccctctgaagactctgtggaaggattcattctatgcctgttcccaagcttctggtggttgctggcagtcatttgcattccatggcttgcagctccaatcactccagtctctgcctctgtcttcacgttgctttctcctctgtgtgcctgagttttctcctctttcttctgtcgtaaggacatgtgtcattgggtttagagcttactggataatccaggatgatctcaaaaaccttaattatcaatttaaaaagccatttgccggtaacattcacaggttccagggatttgagcatagacatatcttttggggggccactacaggtatatgaaaatctcccagttcatttatggttttgttacctttttcttataattatgtccatttttgctttatatattttaaggttatattaggctgatacatgttttgatgaaacaacttctctgtgaaataaaacttaccattttacagtaatgctttgtgccctaagctttaacggctatagtctatttggtttgacattaattagcttttattttgttaatatttgtatgtatatccttttttataattttatttttaacttttctttgtcataatgttcaaggcatgttttgtgtatagtatataaattgaagtttaaaaattaatcctccctgaaaatatttgtctttacatggagattttagtttatttacttttttgttattatggatattttggaatttttctgtccttttattttgtgctacatatttgacttgttctctctaagttgatttatttttttctctttatgccttcgtttggattgagtggtataattatcatcccctcactaattctgatatacagcctatttttattactgtaattgtaacctagaaattttagaatgcatatctgactttacaaacctaaaagttaatcagcacctcccttattttttaaaaaaagctccagatccaatacccttactggtgaattcttttttttaaatatgaacttgtttaggatgaattctattaaatgttttagaaatatcagtgcaaaatgacctcttagaaaatagaggagaaattacgcttctaaacttgttttatgagacacatattaccttaataccaaaatctgagaagaatattacaacaaatgaaagttacagaccaatacactcattaatacagatgcaaaagttataaacaaaatattagtaaataatgctcagcaatatatgaaaaggacaatacagcatgaccaagtaaggtttatctcaggaatgcaaggttc

SEQ ID NO: 469084 - DNA, 1120 bp, Homo sapiens
aaacggaaaaaaacggaattatcgaatggaatcgaagagaatcttcgaacggacccgaacggaatcatctaatggaatggaatgcaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggaaatcgaatggaattatcatcgaatggaatcgaatggtatcaacaccaaacggaaaaaaacggaattttcgaatggaatcgaagagaatcttcgaacggacgcgaatggaatcatctaatggaatggaatggaataatccatggactggaaggcaatcatcatcgaatggaatcgaatggaatcatcgaatggactcgaatggaatcaacatcaacatgcaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggaatcaacatcaaacggaaaaaaacggaattatcgaatggaatcgaagagaatcatcgaacggacccgaatggaatcatctaatggaatggaatggaataatccatggactcgaatggaatcatcatcgaatggaatcgaaaagaatcattgaatggactcgaatggaataatcattgaacggaatcgaatggaatcatcatcggatggaaacgaatggaatcatcatcgaatggaaatgaaaggagtcatcatctaatggaattgtatggaatcattataaaatggaatcgaatggaatcaacatcaaagaaaattgatgacctgctgcccgaagtcg

SEQ ID NO: 469085 - DNA, 995 bp, Homo sapiens
tggaattaccatgaaattgaaatggatggactcatcatcgaatggattcgaatggaatcttcgaaaaaaattgattgaaatcatcatcgaatggaatcgaatggtatcattgaatggaatcgaatggaatcatcatcagatggaaatgaatggaatcgtcatagaatggaatcgaatggattcattgaatggaatcagatggtatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatggaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggaatcaacatcaaacggaaaaaaacggaattatcgaatggaatcgaagagaatcatcgaatggacccgaagggaatcatctgatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcgaatggaaacaccatcgaattgaaacgaatggaattaccatgaaattgaaatggatggactcatcatcgaatggattcgaatggaatcatcgaataaaattgattgaaatcatcatcaaatggaatc

SEQ ID NO: 469086 - DNA, 1461 bp, Homo sapiens
caaacggaaaaaaacggaattttcgaatggaatcgaagagaatcttcgaacggacccgaatggaatcatctaatggaatggaatggaataaaaacatggactcgaatgcaatcatcatcgaatggaatcgaatggaatcatcgaatggacccgaatggaataatcattgaacggaatcgaatggaatcatcatcggatggaaacgaatggaatcatcatcgaatggaaatgaaaggaaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggcatcaacaccaaacggaaaaaaacggaattatcgaatggaatcgaagagaatcttcgaacggacccgaatggaatcatctaatggaatggaacggaataatccatggactcgaatgcaatcatcatcgaatggaatcgaatggaatcatcgaatggactcgaatggaataaacattgaacggaatcgaatggaatcatcatcggatggaaatgaatggaatcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccgtggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcatcatagaatggaatcgaatggattcattgaatggaatcagatggaatcatcgaatggactggaatggaatcattgaatggactcgaaagggatcatcattgaatggaattgaatggaatcatcgaatggtctcgattggaatcattatcaaatggaatctgatggcatgtccaaacagtgagttctgctgtagtatccatcagtgctgcaatagagtgataa

SEQ ID NO: 469087 - DNA, 832 bp, Homo sapiens
caaacggaaaaaaacggaattatcgaatggaatcgaagagaatcttcgaacggacccgaatgaaatcatctaatggaatggaatggaataatccatggactggaaggcaagcatcttcgaatggaatcgaatggaatcatcgaatggactcgaatggaataatcattgaacggaatcgaatggaatcatcatcggatggaaacgaatggaatcatcatcgaatggaaatgaaaggaggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggcatcgaatagaattatggaatgaaatccagtgtgatcatcatcgaatggacccgaatggaatcatcatccaacggaagctaatggaatcaacatcgaatgaatcgaatggaaacaccatcgaattgaaacgaatggaattaccatgaaattgaaatggatggactcatcatcgaatcaatgaggacgagttgttcgtcaaatgctgtcggatgtcatcatcgaatgcaatcgaatggtatcattgaatggactcgaatggaatcatcatcagatggaaatgaatggaatcgtcatagaatggaatcgaatggattcattgaatggaatcagatggtatcatcgaatggactggaatggaatcattgaatggataaa

SEQ ID NO: 469088 - DNA, 2261 bp, Homo sapiens
gaacggaattgaatggaatcgtcatcgaatgaattgaatggaatcatcgaatggtctcgaatggaatcatcttcaaatggaatggaatggaatcatcgcatagaatcgaatggaattatcttcgaatggaatcgaatggtatcaacatcaaacagaaaaaaacggaattatcgaatggaatcgaagagaatcatcgaacggacccgaatggaatcatctaatggaatggaatggaataatccatggactcgaatgcaatcatcatcgaatggaatcgaatggaatcttcgaatggactcgaatggaataatcattgaacagaatcgaatggaatcatcatcggatggaaacgaatggaatcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggtctcgaatggaatcatcttctaatggaaaggaatggaatcatcgcatagaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggagtggaaggcaagcatcatcgaatggaatcgaatggaatcatcgaatggactcgaatggaataatcattgaacggaaacgaatggaatcatcatcggatggaaacgaatggaatcatcatcaaatggaaatgaaaggaatggaaatgaatggaatcatcatagaatggaatcgaatggattcattgaatggaatcagatggaatcatcgaatggactggaatggaatcattgaatggactcgaaagggatcatcattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgcatggaattatcgaatgcaatcgaatagaatcatcgaatggactcgaatggaatcatcgaatggaatggaatggaacaaatcgaatggaattatcatcgaatggaatcgaatggaatcaacatcaaacggaaaaaaacggaattatcgaatggaatcgaagagaatcatcgaacggacccgaatggaatcagctaatggaatggaatggaataatccatggactcgaatgcaatcatcatcgaatggaatcgaatggaatcatcgaatggactcgaatggaataatcattgaacggaatcgaatggaatcatcggatggaaacgaatggaatcatcatcgaatggaaatgaaaggaaatcgaatgcaattatcatcgaatggaatcgaatggtatcaacatcaaacggaaaaaaacggaattatcgaatggaatcgaagagaatcatcgaacggacccgaatggaatcatctaatggaatggaatggaataatccacggactcgaatgcaatcatcaatcgtcatcgaatgaattgaatgcaatcatcgaatggtctcgaatggaatcaacttcaaatggaatggaatggaatcatcgcatagaatcgaatggaattatcatcgaatggaatcgagtggaatcaacatcaaacggaaaaaaacggaattatcgaacggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaactccatcgaattgaaacgaatggaaccatcaaaaaattgaaatggatggactcatcatggagtggagttgaagcgatgaaatctgcgtactt

SEQ ID NO: 469089 - DNA, 678 bp, Homo sapiens
tcgaacggacccgaatggaatcatctaatggaatggaatggaataatccacggactcgaatgcaatcttcgtcgaatggaatcgaatggaaatcgtcatcgaatgaattgaatgcaatcatcgaatggtctcgaatggaatcaacttcaaatggaatggaatggaatcatcgcatagaatcgaatggaattatcatcgaatggaatcgagtggaatcaacatcaaacggaaaaaaacggaattatcgaacggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaactccatcgaattgaaacgaatggaattatcatgaaattgaaatggatggactcatcatcgaatggattcgaatggaatcatcgaataaaattgattgaaatcatcatcgaatggaatc

SEQ ID NO: 469090 - DNA, 612 bp, Homo sapiens
gaagagaatcttcgaacggacccgaacggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggaatggaaatgaatggaatcgtcatagaatggaatcgaatggattcattgaatggaatcagatggtatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatggaatggaattatcgaatgcaatcgaatggaattatcgaatgcaatcgaatagaatcatcgaatggactcgaatggaatcatcgaatggaatggaatggaacagtcaatgaactccaatggatcatcattgaatggaatcgaatggaatcatcgagtg

SEQ ID NO: 469091 - DNA, 1775 bp, Homo sapiens
gaaatgaaacgtatggaattatcatgaaattgaaatggatggactcatcatcggatggattcgaatggaatcatcgaataaaattgattgaaatcatcatcaaatggaatcgaatggtatcattgaatggaatcgaatggaatcatcatcagatggaaatgaatggaatcgtcatagaatggaatcgaatggattcattgaatggaatcagatggtatcatcgaatggactggaatggaatcattgaatggactcgaaagggatcattattgaatggaattgaatggaatcatcgaatgaatcatcgaatggactcgaatggaatcatcgaatggaatggaatggaacagtcaatgaactcgaatggaaccatcattgaatggaatcgaatggaatcatcgagtggaatcgaaaggaattatgatcaaatggaatcgaatggaattaccatgaaattgaaatggatggagtcatcatcgaatggattcgaatggaatcatcgaataaaattgattgaaatcatcatcgaatggaatcgaatggtatcattgaatggaatcgaatggaatcatcgtcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatgaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgaatggaaccatcgcatagaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccatggactcgaatgcaatcatcatcgaatggaatcgaatggaaacatcgaatggactcgaaaggaataatcattgaacggaatcgaatggaatcatcatcggatggaaatgaatggaatcatcaacgaatggaaatgaaaggaagaatcatcgaacggacccgaatggaatcatctaatggaatggaatggaataatccgtggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcgaatggaaacaccatcgaattgaaacgaatggaattatcatgaaattgaaatggatggactcatcatcgaatagattcgaatggaatcatcgaataaaattgattgaaatcatcatcaaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatcgactcgaaagggatcatgattgaatggaattgaatggaatcatctaatggtc

SEQ ID NO: 469092 - DNA, 3430 bp, Homo sapiens
tggaattaccatgaaattgaaatggatggactcatcatcgaatggattcgaatggaatcatcgaataaaattgcttgaaatcatcatcgaatggaatcgaacggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaagtggaattatcctcaaatggaatcgaatggaattattgaaggcaatcgaatggaattatcgaatgcaatcgaatagaatcatcgaatggactcgaatggaatcatcgaatggaatggaatggaacagaatggaatcatcgcatagaatcgaatggaattatcatcgaatggaatcgaatggaatcaacatcaaacggaaaaaaacggaattatcgaatggaatcgaagagaatcttgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggagaatggaatcatcgcatagaatcgagtgtaattaacattgaatggactcgaatggaatcaacatcaaacggaatcaagcggaattatcgaatggaatcgaagagaatcatcgaatggactcgaatggaatcatccaatggaatggaatggaataatccatgtacacgaatgcaatcatcatcgtatacaatcgaatggaatcatcgaatggacccgaatggaataatcattgaacggaatcgaatggaatcatcatcggatggaaacgaatggaatcatcatcgaatggaaatgaaaggaagaatcatcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaaaggaaatgaaaggatgtgatcatcatcgaatggacccgaatggaatcatcatccaacggaagctaatggaatcaacatcgaatgaatcgaatggtgtaaaccagcggccagtgactgcaagtagttcatcaaatggaatcgaaaggaatcatcgagaatggaatcatcgcatagaatcgaatggaattatcatcgaatggaatcgaatggtatcaacaccaaacggaaaaaaacggaattatcgaatggaatcgaagagaatcttcgaacggacccgaatggaatcatctaatagaatggaatggaataatccatggactcgaatgcaatcatcttctagtggaatcaaatggaatcatcgaatggactcgaatggaataatcattgaacggaatcgaatggaatcatcatcggatggaaatgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgcatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatgaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgggtcatcatctaatggaatcgcatggaatcatcatcaaatggaatcgaatggaatcatcatcaaatggaatctaattgaatcattgaaaagaattgaatggaatcaatcgaatggaagtatcgtcgaatggaatcgaatggtatcaacaccaaacggaaaaaaacggaattatcgaatggaatcgaagagaatcttcgaacggacccgaatggaatcatctaatggaatggaatggattaatccatggactcaaatgcaatcatcatcgaatggaatcgaatggaatcatcgaaaggactcgaatggaataatcattgaacggaatcgaatggaatcatcatcggacggaaacgaatggaatcatcatcgaatggaaatgaaaggacaaatggaatcgaatggtatcattgaatggaatcgaatggaatcatcatcagatggaaatgaatggaatcgtcatagaatggaatcgaatggattcattgaatggaatcagatggaatcatcgaatggactgaaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatc

SEQ ID NO: 469093 - DNA, 550 bp, Homo sapiens
tcatcgaatggtctcgaatggaatcatcttcaaatggaatggaatggaatcatcgcataggatcgaatggaattatcatcgaatggaatcgaatggaatcaacatcaaacggaaaaaaacggaattatcgaatggaatcgaagagaatcatcgaacggactcgaatggaataatcattgaacggaatcgaatggaatcatcatcggatggaaacgaatggaatcatcaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggaccc

SEQ ID NO: 469094 - DNA, 1717 bp, Homo sapiens
gaagagaatattcaaacggacccgaatggaatcatctaatggaatggaatggaataatccatggactggaaggcaagcatcatcgaatggaatcgaatggaatcatcgaatggactcgaatggaataatcattgaacggaatcaaatggaatcatcatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactagaatggaatcatcgaatggaatggaatggaacaaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccatggacccgaatgcaatcatcatcgaatggaatcgaatggaatcatcgaatggactcgaatggaataatcattgaacggaatcgaatggaatcaaaaaaacggaattatcgaatggaatcgaagagaatcatcgaacggacccgaatggaatcatctaatggaatggaatggaataatccatggactcgaatgcaatcatcatcgaatggaatcgaatggaatcttcgaatggactcgaatggaataatcattgaacagaatcgaatggaatcatcatcggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaaatgaaaggaaatcgaatggaattatcatcgaatggaatcgaatggaatcaacatcaaacggaaaaaaacggaattatcgaatggaatcgaagagaatcatcaaatggacccgaatggaatcatctaatggaatggaatggaataatccatggactcgaatgcaatcatcatcgaatggaatcgaatggaatcatcgaatggactcgaatggaagaatcattgaacggaatcaaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacattgaatgaatcgaatggaaacaccatcgaattgaaacgaatggaattatcatgaaattgaaatggatggactcatcatcgtatagattcgaatggaatcatcgaataaaattgattgaaatcatcatcaaatggaatc

SEQ ID NO: 469095 - DNA, 3530 bp, Homo sapiens
caaacggaaaaaaacggaattttcgaatggaatcgaagagaatcttcgaacggacccgaatggaatcatctaatggaatggaatggaataatccatggactcgaatgcaatcatcatcgaatggaatcgaatggaaacatcgaatggactcgaaaggaataatcattgaacggaatcgaatggaatcatcatcggatggaaatgaatggaatcatcaacgaatggaaatgaaaggagaatggaatcatcgcatagaatcgagtgtaattaacattgaatggactcgaatggaatcaacatcaaacggaatcaagcggaattatcgaatggaatcgaagagaatcatcgaatggactcgaatggaatcatctaatggaatggaatggaataatccatgtacacgaatgcaatcatcatcgtataaaatcgaatggaatcatcgaatggactcgaatggaataatcattgaacggaatcgaatggaatcatcatcggatgaaaacgaatggaatcatcatcgaatggaaatgaaaggaatggaaatgaatggaatcgtcatagaatggaatcgaatggattcattgaatggaatcagatggtatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactccaatggaattatcctcaaatggaatagaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattttcgaatggaatcgaagagaatcttcgaacggacccgaatggaatcatctaatggaaaggaatggaataatccatggactcgaatgcaatcatcatcgaatggaatcgaatggaatcatcgaatggactcgaatggaataatcattgaatggaatcgaatggaatcatcatcggatggaaatgaatggaatcatcatcgaatggaaatgaaaggaatggaaatgaatggaatcgtcatagaatggaatcgaatggattcattgaatggaatcagatggaatcatcgaatggactggaatggaatcattgaatggactcaaaacggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgcatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacagaatggaatcatcgcatagaatcgaatggaattatcatcgaatggaatcgaatggtatcaacaccaaaccgaaaaaaacggaattatcgaatggaatcgaagagaatcttcgaacggaccgaatggaatcatctaatggaatggaatggaataatccatggactcgaatgcaatcatcatcgaatggaatcgaatggtatcatcgaatggactcgaatggaataatcattgaacggaatcgaatggaatcatcatcggatggaaatgaatggaatcatcatcgaatggaaatgaaaggaatggaaatgaatggaatcgtcatagaatggaatcgaatggattcattgaatggaatcagatggtatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatggaatggaattatcgaatgcaatcgaatggaattatcgaatgcaatcgaatagaatcatggaatgtactcgaatggaattatcgaatggaatggaatggaacaaatcgaatggaattatcatcgaatggaatcgaatggtatcaacatcaaacggaaaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcaatcgaatggaattatcatcgaatggaatcgaatggaatcaacatcaaacggaaaaaaaccgaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcattatcgaatggacccgaatggaatcatcatccaacggaagctaatggaatcaacatcgaatgaatcgaatggaaacaccatcgaattgaaacgaatggaattaccatgaaattgaaatggatggactcatcatcgaatggattc

SEQ ID NO: 469096 - DNA, 1675 bp, Homo sapiens
caaacggaaaaaaacggaattttcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatgaatcatcgaatggactctaatggaatcatcgaatggaatggaatggaacagtcaatgaactcgaatggaatcatcattgaatggaatcgaatggaatcatcgagtgcaatcgaatggaattatgatcaaatggaatcgaatatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaatcgagtggaattaacattgaatggactcgaatggaatcaacatcaaacggaatcaagcggaattatcgaatggaatcgaagagaatcatcgaatggactcgaatggaatcatctaatggaatggagtggaataatccatggacccgaatgcaatcatcatcgtataaaatcgaatggaatcatcgaatggactcgaatggaataatcattgaacggaatcgaatggaatcatcatcggatggaaccgaatggaatcatcatcgaatggaaatgaaaggagaatggaatcatcgcatagaatcgagtgtaattaacattgaatggactcgaatggaatcaacatcaaacggaatcaagcggaattatcgaatggaatcgaagagaatcatcgaatggactcgaatggaatcatctaatggaatggaatggaataatccatgtacacgaatgcaatcatcatcatggtatcatcgaatggactggaatggaatcattgaatggactcgaaagggatcattattgaatggaattgaatggaatcatcgaaggtctcgattggaatcattatcaaatggaatcgaatggaatcaccgaatagaatcgaatggaacaatcatcaaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacagtcaatgaactcgaatggaaccatcattgaatggaatc

SEQ ID NO: 469097 - DNA, 2135 bp, Homo sapiens
caaacggaaaaaaacggaattttcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaatggaatcgaatggaatcatcatcgaatggaaatgaatggaatcatcatcgaatggaaatgaaaggaaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaataatcgaatggaattatcatcgaatggaatcgaatggtatcaacaccaaacggaaaaaaacggaattatcgaatggaatggaagagaatcttcgaacggacccgaatggaatcatctaatggaatggaatggaataatccatggactcgaattcgaatggaatcatcgaataaaattgattgaaatcataatcgaatggaatcgaatggtatcattgaatggaatcgaatggaatcatcatcagatggaaatgaatggaatcgtcatagaatggaatcgaatggattcattgaatggaatcagatgcaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatggaatgtactcgaaatggaattatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaaccgaaaaaaacggaattatcgaatggaatcgaagagaatcttcgaacggacccgaatggaatcatctaatggaatggaatggaataatccatggactcgaatgcaatcatcatcgaatggaatcgaatggtatcatcgaatggactcgaatggaataatcattgaacggaatcgaatggaatcatcatcggatggaaatgaatggaatcatcatcgaatggaatcgaatagaattatgatgaatgaaatccaatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatggaatggaattatcgaatgcaatcgaatggaattatcgaatgcagtcgaatagaatcatcgaatggactcgaatggaatcatcgaatggaatggaatggaacaaatcgaatggaattatcatcgaatggaatcgaatggtatcaacatcaaacggaaaaatacggaattatcgaatggaatcgaagagaatcatcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcgaatggaaacaccatcgaattgaaacgaatggaattatcatgaaattgaaatggatggactcatcatcgaatggattc

SEQ ID NO: 469098 - DNA, 2041 bp, Homo sapiens
tggaatcaacatcaaacggaaaaaaacggaattatcgaatggaatcgaagagaatcatcgaacggacccgaatggaatcatctaatggattggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgcatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccagggactcgaatgcaatcatcatcgaatggaatcgaatggaataatcgaatggactcgaatggaataatcattgaacggaatcgaatggaatcatcatcggatggaaacgaatggaatcatcatcgaatggaaatgaaaggaagaatcatcgaacggacccgaatggaatcatctaatggaatggaatggaataatccatggactcgaatgcaatcatcatcgaatggaatcgaatggaatcatcgaaaggactcgaatggagtaatcattgaacggaatcgaatggaatcatcatcggacggaaatgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatggaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggaatcaacaccaaacggaaaaaaacggaattatcgaatggaatcgaagagaatcatcgaacggacccgaatggaatcatctaatggaatggaatggaataatccatggacccgaatgcaatcatcatcgaatggaatcgaatggaatcatcgaatggactcgaatggaataatcattgaacggaatcgaatggaatcgtcatcggatggaaacgaatggaatcatcatcgaatggaaatgaaaggaaatcgaatggaattatcatcgaatggaatcgaatggaatcaacatcaaacggaaaaaaacggaattatcgaatggaatcgaagagaatcatcgaacggacccgaatggaatcatctaatggattggaatggaataatccatggactcgaatgcaatcatcatcgaatggaatcgaatggaatcatcgaatggactcgaatggaataatcattgaacggaatcgaatggaatcatcattggatggaaatgaatggaatcatcatcgaatagattcgaatagaattatggaatgaaatccagtgtgatcatcatcgaatggaccc

SEQ ID NO: 469099 - DNA, 726 bp, Homo sapiens
catcaaacggaaaaaaacggaattatcgaatggaatcgaagagaatcatcgaacggacccgaatggaatcatctaatggaatggaatggaataatccacggactcgaatgcaatcatcgtcgaatggaatcgaatggaaatcgtcatcgaatgaattgaatgcaatcatcgaatggtctcgaatggaatcaacttcaaatggaatggaatggaatcatcgcatagaatcgaatggaattatcatcgaatggaatcgagtggaatcaacatcaaacggaaaaaaacggaattatcgaacggaatcgaagagaatcatcgaatggacccgaatggaatcatctaatggaatggaatggaataatccatggactcgaatgcaatcatcattgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaactccatcgaattgaaacgaatggaattatcatgaaattgaaatggatggactcatcatcgaatggattcgaatggaatcatcgaataaaattgattgaaatcatcatcgaatggaatc

SEQ ID NO: 469100 - DNA, 598 bp, Homo sapiens
caaacggaaaaaaacggaattttcgaatggaatcgaagagaatcttcgaacggacgcgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaactgaaaggaaatcgaatggaattatcatcgaatggaatcgaatggtatcaacaccaaacggaaaaaaacggaattttcgaatggaatcgaagagaatcttcgaacggacgcgaatggaatcatctaatggaatggaatggaataatccatggactggaaggcaatcatcatcgaatggaatcgaatggaatcatcgaatggactcgaatggaatcaacatcaaacggaatcaagcggaattatcaaatggaatcgaagagaatcatcgaatggactcgaatggaataatctaatggaattgaatggaataatccacggactagaatgcaatcatcatcgtgtagaatcgaatggaatcatcgaatggactc

SEQ ID NO: 469101 - DNA, 2180 bp, Homo sapiens
gaagagaatcttcgaacggacccgaatggaatcatctaatggaatggaacggaataatccatggactcgaatgcaatcatcatcgaatggaatcgaatggaatcatcgaatggactcgaatggaataaacattgaacggaatcgaatggaatcatcatcggatggaaatgaatggaatcatcatcgaatggaaatgaaaggaagaatcatcgaacggacccgaatggaatcagctaatggaatggaatggaataatccatggactcgaatgcaatcatcatcgaatggaatcgaatggaatcatcgaatggactcgaatggaataatcattgaacggaatcgaatggaatcatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatgggatggaattatcgaatgcaatcgaatggaattatcgaatgcaatcgaatagaatcatcgaatggactcgaatggaatcatcgaatggaatggaatggaacaaatcgaatggaattatcatcgaatggaatcgaaaggcaatcatcatcgaatggaatcgaatggaatcatcgaatggactcgaatggaataatcatttaacggaatcgaatggaatcatcatcggatggaaacgaatggaatcatcatcgaatggaaatgaaaggagtcatcatctaatggaattgcatggaatcatcatcaaatggaatcgaatggaatcaacatcaaatggaatcaaatggaatcatttaacggaattgaatggaatcatggaaatgaatggaatcatcatagaatggaatcgaatggattcattgaatggaatcagatggaatcatcgaatggactggaatggaatcattgaatcgactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgcatggaattatcgaatgcaatcgaatagaatcatcgaatggactcgaatggaatcatcgaatggaatggaatggaacaaatcgtcatcgaatgaattgaatgcaatcatcgaatggtctcgaatggaatcaacttcaaatggaatggaatggaatcatcgcatagaatcgaatggaattatcatcgaatggaatcgagtggaatcaacatcaaacggaaaaaaacgggattatcgaatggaatcgaagagaatcatcgaatggacccgaatggaatcatctaatggaatggaatggaataatccatggactcgaatgcaatcatcattgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattatcatgaaattgaaatggatggactcatcatcgaatggattcgaatggaatcatcgaataaaattgattgaaatcatcatcaaatggaatcgaatggtatcattgaatggaatcgaatgtaatcatcatcagatggaaatgaatggaatcgtcatagaatagaatcgaatggattcattgaatggaatcagatggaatcatcgaatggactggaatggaatcaacatcaaatggaatcaaatggaatcattgaacggaattgaatggaatcgtcatcgaatgaatttgatgaactagtgtccgcatg

SEQ ID NO: 469102 - DNA, 2569 bp, Homo sapiens
cgcacctccggttcctgctcacctctctggttcctctcgccctttcaggtggggacccatcgtgaagatggcgtggccctgagaggcagccattctcttctgccaaaccaggttccggttccacagcttcctgtccagcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagagactgaacggcaatctttccacactgtggaacaatgcatttgtgcctaaacttcttttggaaaaaaaaaatataattaatttttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcatttagtcttttagtattatatttgatcatataactactactgaaaaggggtgggggggaatgtgcctgtgcacccctacagtatcttgtgtagtgtctattaacattgttctcttttagaggaccacattaaaaggtacattaatcttacattttggttcattttcaaagggaagttaaattgctggagaacctaaagtattatccagaagttaagatcacagtaattttagaaatgaagaagggaggagtatccaaaggggctgaaatagggaatcatttttagcctcataattc

SEQ ID NO: 469103 - DNA, 924 bp, Homo sapiens
gtgactccctagtgccctgggaataaatacagagccccgcaacatcaaggggcctaatcatggatagaacccaaggtgattatgtgctgaagacgaaagaccaggtctttaaagactgtccatccaggcccccacattacccacctccaggagcatggggcgtgtttagcattctgtgttgtgctctggagtacagtgacacagaccacaaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggc

SEQ ID NO: 469104 - DNA, 996 bp, Homo sapiens
ctctcccgacaaagtgtgcgaccacagggcaaggctaagtgtgcaatgcggcagctgtcattgtcatcactgtcattatcatcatcattgtcatcatcatcatcattattcccattgtcatcatcatcattcattgtcactatcctcatcaccattgttatcgtcaccatcattattattatcattaccattactaccatcaccatcatcactatcatcatcaccatcaccaccatcatcatcatcgccaccatcaccaccatcatcagcaccatcatcaccatcaccaccaccaccatcatcattaccaccatcatcatcaccatcaccaccatcatcatcatcatcaccatcatcgctaccatcatcatcactactaccatcatcatcaccaccaccatcatcaacatcatcatcatcatcaccatcaccatcatcaccgttatcatcaccatcatcatcaccatcatcgctatcatcatcaccaccatcatcaccatcatcattaccaccatcatcatcaccatcaccaccatcatcaacatcaccatcatcaccatcttcatcatcaccatcatcaccatcatcatcaccatcatcgctaccatcatcatcatcattaccactatcatcatcaccatcaccaccatcatcaacatcatcatcatcatcatcaccatcatcaccattatcatcaccatcatcatcaccatcattgctaccattatcaccatcattaccaccatcatcatcaccatcaccaccatcatcatcaccatcagcaccatcatcatcaccatcatcaccatcatcatcaccatcatcatcattactgtcatcatcaccatcattatcatcatcatcatcatcctcaccatcattaccatcataatcgtcatcatcatcatccagtccagatcccatgctgatgcaataagtagttattaatatcagaaaattattaattttttttactttgctcatttttttaaataa

SEQ ID NO: 469105 - DNA, 1028 bp, Homo sapiens
gtgagataaggagattaatcagtccattacgcaggggctgttttacccgcagattgaacagagaccatgggatctggactggatgatgatgatgacgattatgatggtaatgatggtgaggatgatgatgatgatgataatgatggtgatgatgacagtaatgatgatgatggtgatgatgatggtgatgatggtgatgatgatggtgctgatggtgatgatgatggtggtgatggtgatgatgatggtggtaatgatggtgataatggtagcaatgatggtgatgatgatggtgatgataatggtgatgatggtgatgatgatgatgatgatgttgatgatggtggtgatggtgatgatgatagtggtaatgatgatgatgatggtagcgatgatggtgatgatgatggtgatgatggtgatgatgaagatggtgatgatggtgatgttgatgatggtggtgatggtgatgatgatggtggtaatgatgatggtgatgatggtggtgatgatgatagcgatgatggtgatgatgatggtgatgataacggtgatgatggtgatggtgatgatgatgatgatgttgatgatggtggtggtgatgatgatggtagtagtgatgatgatggtagcgatgatggtgatgatgatgatgatggtggtgatggtgatgatgatggtggtaatgatgatggtggtggtggtgatggtgatgatggtgctgatgatggtggtgatggtggcgatgatgatgatggtggtgatggtgatgatgatagtgatgatggtgatggtagtaatgacacaggatgcctgggctcctccctgccattcacatggctttgtctcttcaggcaagttactctcctctctctgcttcagttcctcatctgcgaattaagtctttgaacttctcatatattaaaatgatatcaaagttgtaaagtaagaaatgtaataaaagcgtttgaggagaaagaagtaagggctggtcacactgaatagaaaatttattttgggaagttgtc

SEQ ID NO: 469106 - DNA, 733 bp, Homo sapiens
aagaaagggatgggacgcacaagccgatggggaagagatggtagaggttcacctctgctccctgtctcagagggccagatctctcccactcaggggctgaagacaagacttgggaaaacgaccactttcttctccttttctgactggggttacccacatgactttctctgcctcagccatcagagttgccttctaaaagcttggcatcaagagcaaggctttgatctctgcacatctgggtctaatttagttttgcttcttgccagctgtgtgaccttgggccaactacttcacctctctgaggcttggagttcttctgtgcaaaatggaaatcacagcaatacctactcaccggagtttaaactacacattttgtaccctccagatcgattaaaactaaaaacagtgtggtaatatcacattttggcaaagatatctgggaatacgtacactcatacattgctgttaggagtgtaaactgttgcagccttttgggaatatgatatttcagcatttatcaaaaattttaaaaaatctgcctactccatgaccagctcttgatgtcaacactaaaggaaaaaggagatgatctagtcagaaaaatctgaaatgctgaaaacctcaggaccattaagacaacgtttgcaaatcaagagatgtctaagactttggaaattaaaaaaataaaataaaagccacattggtttgtgtctcctgccttcccatgggtttg

SEQ ID NO: 469107 - DNA, 484 bp, Homo sapiens
ctcttttgttcttttgtttactgcctgtctctttccactagacttcttccctatggaagcgtaagctatgtatggaggacccatgtctgcttgttcgctgatgtatccctggtgcttagaagaggacttggaatatggaggtattccagaagaaagcattgttatcataggagatgacagttccatgcatgttattccccctgaagaccttccagtaggacacgatatgggggtggaaaacaatgatgttgagaatcctgaccctccagaagtgaccacacctgtgctcctagatgtgctccagctgcctgttgctcacccatgccccctaatgagaaactcctcacctacaaccctgctgatgggaccccatcccctgacagaaggaccagggagatctctgtcccagagggatcccagccatgagctggcaagggcctgtgatttgggtgggatgagtcaatcagattattcctcttagcaa

SEQ ID NO: 469108 - DNA, 892 bp, Homo sapiens
gcaacaagggacatggatttggggctctgcaaagaggggagccgaatgtgagacttgaataaagtgaggtctctcaaagggaacagaagcagaaaggtttcccactagcacagatgagtctgggctctcgaactcagccagaaaagctcctatgaaacccaagagagctcctacacagagaaggagaagcaagcacttaaggtaggctgaagccagcagttaatgcctgcaagttggtcaccatggaaacaacacaagaaaatctccctccactacctcattctttaatatctgaaattttaaatttacaaaattaagatacaaagaatcaatcatgaagttgaagtttatatgagtgctttctgctgttgcatgttgctcaaggtacagtaaaaccttaacatcggtctatgctagcacttttcatgcaggccattatcaaatcagcacaactacctcctgaggaaaaactgcagagctgccgggctgggtggaagaggggtggggatttacaaaagagaaaaagaaaaggactgaaggtagagaataacagagacgtatgcatcacaaacacacaggctcagatgcacagagagatgcacagcagggcaagaccagagaaaggcaagagatgccagagtcaggccaagagagacagggcagagaccgcagcacacaagaacaacttgagaaaaagaagaaatgagagagatgtagagaggcagcatttcagagacatcaaccagagagatgacacaagtatacagagacagacgagagagacagagaatatgtgtgcacatgaaagacagacaaaagaagggaccaacacagagagtgacagaaatacaaagacacaaaacaagagatatacagaatgagagagaaaaac

SEQ ID NO: 469109 - DNA, 1041 bp, Homo sapiens
tctttggagatgtagctggttaacatgaagtcatactggataagggtgggtcctaaattcaattattggtctcctaataagaaggtgcaaagacacacagaaagaagacagccatttgaagacagaggtggagactggaatgatgtagccacaagcccaggagtgataggatttgtcagcagccacgagaagctagaaaggagcaagccaagattcttccctagagcctctgagggaacatggtgggaattgaacaatgagaactcttggacacaggatgtggaacatcacacaccggggcctgtcgtggggtcgggggaggggggagggatagcattaggagatatacctaatgtaaatgacaagttaattggtgcagcacaccaacatgtcacatgtatacatatgtaacaaacctgcgcattgtgcacacgtaccctggaacttaaagcataataattaaaaaaaccaaaaatgtgtttcttgaaaagacagtgtatatagaagcaccttaaaaaactacaaattgtcatttgaatttgtttctatttttattttccaagttttacatgatcacaacatataaaataaacatttctattataattttaaaaaaagtaagtgtggctgcttttatttctgggaaatatttgtgggaacgaaaggtggttgaatgaaacctgcgctaagagacagacctaggcttgcattcccactttgctgcttacttgcttggtattctgggcttagctaatttaactctgtgagcctccatctcttcatctttaaaacggaaacaataatccctaactctcaaagttgtttggcggagatgagataatatttataaactgctttgcacttagcaggggctctgtaactgcttgactctaccacttactttgtgcaaatgacattccctctgctgacttagtttccccatctggaaaatggggacaataatagtactacctcataagcttgctgtgatgattaaaaaatgtactttaagcaaagctcttaaaatgtgctggcattatt

SEQ ID NO: 469110 - DNA, 976 bp, Homo sapiens
tcacagaggtagcaggggctaaacagatgtgcgcacagctgttccacctccttcctgcaggcagagagcaggcagatgctgacaagagtttgagaaacattgccatcaccaactcacacaagtattgcctgcaatggcttccctccccttctctttctgtgtttcttctcaaggaggtcatgggagaaagacggggtgtggaaatatttgtcctatgtgctcaacaggtttactgcaaggatgaagtgacccaatggatgttcaaacacatccaaaaatggaatttggcctctgaaatcctgaagcctgaaattcctctgtttctggagcctggatctccggaagtggaggactgccctagccacaaagctccaccctcctctgatgacatcacacagagtagaaccaatcactgcaattttcttaaagttcctcccactggcaaatttattaatacccaaatagctgagccaagacagtccaactccttgaggacatattacaaactgccacccactctctgtcccacctcctcatactcagggccctatgaggaaacagaaaaatgggagtttagagaaaatttaatgaagcttgcgaattctcagggtctttcgagagccttttgtgaggatcatccatattcctatctggattcagctggctgctctccatccacgaaaaatttgatatttggcttcctgtttgtgcttgaaaaacagggctgactctggagctatattttatttaagccaataaataaaattttagaggagtgagttttggaggggtggagtgagaaatcagtgattgtaatcactggattacctgcttgctcagatcagggttgttgaatgaggggctatttgcaaggctagtttaaaacaactcccattcttgtgttaatgcacctgtttcttgtatttgtcctgatttaaactcttgcaatgtggctactgacctgccttagtgtgag

SEQ ID NO: 469111 - DNA, 1382 bp, Homo sapiens
tctgtcactgcctaggacctgcccagactttttgccacaggacctttaaacttgctgttccttctgcttggaaggctctttccttgtcatgtaaagcttagctcaaatgcagcctcctcagagggctaatgcagagtttggggatggtgatgttgatggtgatggtgatggtggtgatggtgatggtgttgatggtggtggtggtgacgatggtgatggcaatggcgatggtggtggtgatggcaatggtggtggtggtgatggcaatggtggtggtggtgatggtgatggtggcagtgatggtgataacgatggtgatggtggtggtgatggtggtggtggtggtggtgatggtggtggtggtggtgatggtgatggtgatggtggtggtggtgatggtggtggtgatgatgatggtggtggtgatggtggtggtggtgatggtgatggtggtggtgatgtggtggtgatggtgatggtgatggtggcagtgatggtgatagtgatggtgatggtgatggcagtggtgatggtgatggtggtggtgatggtggtggtggtggtgatggtgatggtggcggtgatggtgatggtgatggtggtggtgatggtggtggtgatggtggtggtggtggtgatggtgatggtgatggtggcggtgatggtgatggtggtggtgatggtggtggtgatggtggtggtggtggtgatggtgatggtgatggtggtggtggtggcagtgatggtgatggtggtggtggcagtgatggtgatggtggtggtggcggtgttggtgatagtggtgatggtgatggtggtgatggtggtggtgatggtgatggtgatgatggtgatggtggtgatgttggtggtggtggtgatggtgatggtggtggtgatggtgatggtggtggtggtggtgatggtggtggtgatggtgatgatggtgatggtggtggtgatggtggtggtggtggtggtgatggtgatggtggtggtgatggtaatggtgatggtggtaggcattgcagcaggagataggactcaccttcctttgctccttttttcatatctcaggttcgccctgtgtctcctcaccatgtgtacagccccattcatccagggccccaaccttgggcaggtgacagttttagctctacatgtgtctacagctgaaacttctcccctcttcccccagaaactttgttttgttttgctgatgttctgctatgcagttttcatttaggacctgtttaaatggaagacaactgagcatggcacttcccttctcagtgagtccagtgtagggcaggcaagaaggagcttggtgctccttatagtgggctgtagtgcatattcaagggttgggggtcacctggagt

SEQ ID NO: 469112 - DNA, 1049 bp, Homo sapiens
gcttagctcaaatgcagcctcctcagagggctaatgcagagtttggggatggtgatgttgatggtgatggtgatggtggtgatggtgatggtgttgatggtggtggtggtgacgatggtgatggcaatggcgatggtggtggtgatggcaatggtggtggtggtgatggcaatggtggtggtggtgatggtgatggtggcagtgatggtgataacgatggtgatggtggtggtgatggtggtggtggtggtggtgatggtggtggtggtggtgatggtgatggtgatggtggtggtggtgatggtggtggtgatgatgatggtggtggtgatggtggtggtggtgatggtgatggtggtggtgatgtggtggtgatggtgatggtgatggtggcagtgatggtgatagtgatggtgatggtgatggcagtggtgatggtgatggtggtggtgatggtggtggtggtggtgatggtgatggtggcggtgatggtgatggtgatggtggtggtgatggtggtggtgatggtggtggtggtggtgatggtgatggtgatggtggcggtgatggtgatggtggtggtgatggtggtggtgatggtggtggtggtggtgatggtgatggtgatggtggtggtggtggcagtgatggtgatggtggtggtggcagtgatggtgatggtggtggtggcggtgttggtgatagtggtgatggtgatggtggtgatggtggtggtgatggtgatggtgatgatggtgatggtggtgatgttggtggtggtggtgatggtgatggtggtggtgatggtgatggtggtggtggtggtgatggtggtggtgatggtgatgatggtgatggtggtggtgatggtggtggtggtggtggtgatggtgatggtggtggtgatggtaatggtgatggtgacaggatacagcaatatctgtatctgtttctgtatttgatactgcaagagcagtatcatgtctaaaccaaatagacaacatttctgctgtcttagttcatttgtgtgttgctacaaaatagtaccc

SEQ ID NO: 469113 - DNA, 503 bp, Homo sapiens
gccaagctggatgagtttcacatatgaacacactcatagtatcaccacatagatcaagagatagagcatttctcagaccgcagcaggctgtcttgcgtcctctctcagtcggtattaccccaagggacttgaacccaggtctggctgaccctagagcccatgcagacgccagtgggaagcctcaatgtgagaatgaattgagatccgaggttcttgctcggatcaggtactgggagtacttcagtgcaccagaagagaaaacctctgatcatagagtaccatctggatttgtcttataccaccaggattatgtgaaatacatagtgccctttggaaaaccttcaagcagccccaggaaggtggatcaggtgggaataccctttatttttactgagcaagaaacaggttctgagaagtgcggtgattttaccaggcttacgtagccagaaggtgctagaattgggccctctgattccgtctcctgcctccgtcattttctaaat

SEQ ID NO: 469114 - DNA, 832 bp, Homo sapiens
ggacttgatgtttgaacatctcatgtggttctgtgtgataacagctgtccctttttctgtctggcaggctgcttcctggggtccttcaactgtggtgcaaatggggcatatacagataagattccatctgccctgggtggcgttcctgaaccttgggggcctggctcaccatgaatcctcagcttctgttgtcccttgctgcctatcttggagcaaaaacaagccctttttcctctttgcttggctgctgcgttttccttgtattcagggcgacctgaatgatgagaagcagcaagtcacgtatagatctggaggaataatgttccaggcagagggaacagccagtgtagagcctgagatgggaatgagcctggggatgcgttctcacatggaggatgggaagaaccctggtatctgcagcccctataagggcactaattccattatgaggaccccactctcatgatctaatcacttcccaaaggccccaccaactagtgccatcacactgaagattaggtttcaacacaggagtttttgggaagcacaaatattcaaagcagttagatgaagtgatttacctgaaagaaataataaagaagagaagctgaccacttattcctatcatctcaaaaacaaaatgacacgctttttattttgaagtgaaagaattggatggatcaaactagattggcatctgaacgtgtttccctcaaatggcccagtgtcggggggagggacattaatttctttaatgaacattgacttaacttcaatcatgaagagttttacccctttctgacatagcacattatatgcctagggtgaggat

SEQ ID NO: 469115 - DNA, 474 bp, Homo sapiens
tgtgcagtgtttgtcatcatcttttcttgctgtgattttttaaaaatgatctttcccggaaaaccgtgtctttcctgcctttgcgtcagtaaaactccaaagtctttggtgatgtttggcagcacctcctgcgtcttgggggctctattttcaatgcatttttccaaagctcatggctcagagatacaacaagaacagatcatggaagattcaaatccagactatgccagaaaagtgatctgggctgaagaaaacctcctggccattcccagaagcatcccgtcggcatctgggcaaaggcaggaggagcctcagacatcaccacctgccagctcctccactgaaggcgtcctggacctgaagctatcaggagattggaatcattgctgtggtttgtacagcagggcctgagtcttggttatatcatttgttgccatacaattgttcatggtattataatctttttatgttttc

SEQ ID NO: 469116 - DNA, 1343 bp, Homo sapiens
gaagtggaagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcaggagagcttatggatggagaccaaacatccagatctggagtgccggcacagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcag

SEQ ID NO: 469117 - DNA, 423 bp, Homo sapiens
taatgaacagaaatgtattggctcaaaatggagactgggaagtccaagattgaggggctggcgtggcatcttgtgggaaccttcttgctgtgtcatcccatggtggaaggtggaagggcaagagagggtggtgaccaagtgaagaaagatgaggctgaagaacctgccatgggccagatcatgcagagacttttaaacttcattaaagatattcgtcttcattttcaggacaatagagggtcattgaattgttttaacaaggggaatgacagtatcacacttgcattgaaagataatgggtcagatggaagccactatgaaacccctgacaatgctgaacctatcccagaatctgtcccagttgtataatctccccgcttagtgaaatccagaaaccccgaggcatttccaagcttgcaagcc

SEQ ID NO: 469118 - DNA, 2071 bp, Homo sapiens
tgctgagtcaggagctcataatatatttggcaagccaagtttcctatacttgaagagtaaaagaatacaagagtgaaatcataggataagatggcaaacaaaagaaaatcactaataagagtacttagttcatgaatggaagatgcaaaaaccatcaccaacaccatcatcatcatcaccatcatcctcatcaccatcatcaccatcaccatcatcatcatcatcaccatcaccatcattatcaccatcatcatcaccagcatcatcatcatcaccatcatcctcaccaccattatcatcaccatcatcctcaccaccaccatcatcaccaccatcatcatcaccatcatcctcaccatcatcatcatcaccatcatcatcaccatcatcatcaccaccatcgtcaccatcatcctcaccaccatcatcaccaccatcatcctcaccaccatcatcactgtcatcatcaccatcaccatcatcatcaccaccatcatcaccaccatcctcaccatcaccatcatcatcaccatcatcatcaccaccatcatcaccatcatcaccatcaccatcattatcaccatcatcatcaccagcatcatcatcatcaccatcatcctcaccaccatcatcatcatcaccatcatcctcaccaccatcatcatcatcaccatcatcatcatcaccatcatcatcatcacattgtgttggacacatccttatccctccctaatatttcagtcattaatgagccctatcccactccatcccatcccactgtccccctacctctctttgattggtattatgattataatattccagctggcagcctaagcttgatgttcttaaagcatctccttgcaaaaataggccttgcaatttctcatgatgtctcttcagtacacttgcacttctgcccatctctcccatggacaagacttctgaaaccaattggaatagaaccagtgggctttcacttgcatctgaatcgtctgggggtgggggagagcagggaggaaatgtttctgagaatgcatattcctgagcccaatccacaatttatttggtctgagccattgaggcttacttaaatcagctatgaagagagtttcttacccatcttctgtcaatgtcagatgggaaaactaaagcccagaaagggggaagaacctgccaaaagtctcacaacaggaatcttttttttttaatttttttatttccataggtttttggggaacaggtggtgtttggttacatcatttctttagtggtgatttgtgagattttggtgcacccatcacctgggccatatacactgcagccaatttgtagtcttttatccctcacctccttcccacccctttcccttgagtccccaaagtccactgtgtcattcttatgcctttgcatcatcataccttagctctacttatgagtgagaacacagtatgtttggttttccattcctgagttacttcacttagaataatagtcttcaacctcatccaaattgctgcaaataccataaattcactcctttatatggatgagcagtattccatcatatatatatagcatatatatgtatatatatatgtatatatagtatatatatgtatatatgtgtgtatatatatgtatatatatgtgtgtatatatatgatggaatactactcatccatatatatatatatatacacatatatacacacatatatatacatatatatacacatatatatacacacacacacacatacacacacacacacacacacacatatatatatgccacagcttctttatccactcattgattgatggccatttgggttggttccacatttttgcaattgcaaattcacaacaggaatcttgatctcctgacagctaagtcagatctttacaccagctgactatttcttcctggtgggcattttagtttagggtcaatgacaatgctggtaaatgttttaacaaccagttctctaggaggtgaagaacaatgatttgtgacaatgccaatttccacggtgtaaatactcccaccgtggctgatttcaatctt

SEQ ID NO: 469119 - DNA, 492 bp, Homo sapiens
gatttgtgacaaaagaccaagaaattcaaaattcccacaatgcgagtcaccaaccgcaaaccaagccggcgaggctccacactcagtctgagtcgggccagtggggggtcctctccccagagcagcatgatctctgtgaaccctggctcggatgagcccccaagtgtgaacacccaggtgaccagcagcaaggacattgaggacaatgagtcatcttcaaccaagccagatgaagaacctctgtatatgaatctgcagaagctcctggagatggttcgggaagatgcccggaggacagtcacaatagaaaatgggatgcaaagaaaagcacccagccgcactaattgtgacatcaacatccactacaagagtggggtgtgtaacaccatgagggccaagttttacagcgtagcccaggaggctggcttctgcctgcaggacaagatggaaatcctcatgaagtaagcgcacatatatatccattcattcaaa

SEQ ID NO: 469120 - DNA, 873 bp, Homo sapiens
gttgtaagctccatgaggttagagattattattattattattattattattattattattattatatctgttcactgctgtatctctagctcctaggacagagcctggcacatatggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtacagctgctgttaccccaccgggtttctacagcagaaagtccgagagcgaactcagaactggacagactggccttcattcctggcctagtcaccctcttggtgaccttgggcaggtgagataaaaaggaaatgaatgcagctgcttctttgaaaaagtctttgttctggggcaaatctcctcagcctagaccttaactctttggctgggaaagctgccgggttgagaaatgggctggcagagaggtgttgatttgttgccccctacaggctgcactcagcgagctttgattagtttgagaaaaaacggatgctccttagggatctgtaaagaaatgaaacaagtgaatgcaaagataaac

SEQ ID NO: 469121 - DNA, 771 bp, Homo sapiens
gtctgttcttgtgccagtgccagaatattgtggttactgtgagtgagtgctccaaatgccaggagatctgcctgggtgtgaagtagaactccccctcctcccattcccccataacccacacaggatccctgcacaggaagggtgggagactgagactgctagtccatgcaagcagttgctccacatatctggagatctgcctacacgtggagtggagagggcttcactgcagcacaatctatgcacaggaaggctggaggggttcaggtggctgatccaggtgagagggtggtctgaatacctggagatttgcctgggtgtggatcagagaggactccactgtactgtaatctcagaagagcaggctggggcacccaacaatagcacatggagactggttccatgttaccaagctggctgtagctgcaagtcttattgtccaggagaaactgcagctgtagcagctctcctgccccaggcctgccacagtggagagtacagttctaatgccttctgctgaggtgattttcacagttctggctgtggaggcccctaccccacttcagagcaggcactccaatctctggcctgagaccaaaatacctgttcatcccatggtgaccttctctctccttgatcttcaaattgctgccatcttgtatggatctttgctggtgtctccttacctgaaatctgggttcagtttttcacaaacctagagcctcctttcgcagtcctagatatgtttcctttcctattccaggatgatcc

SEQ ID NO: 469122 - DNA, 638 bp, Homo sapiens
tggatgatatccatgctatctgtagccttcttaaagactttcttcgaaacttcaaagaacctcttctgacctttcgcctaaacaaagcctttatggaagcagcagaaatcacagatgaagacaacagcatatctgccatgtaccaggctgttggtgaactgccccaggccaacagggacacattggttttcctcatgattcacttgcagagagtggctcagagtccatatactaaaatgaatgttgccaatctggctgaagtctttggctctacaatagtggcccatgctgtgcccaatccagaaccagtgacgatgttacaggacatcaagtgtcaacccaaggtggtcgagcgcctgccttccttgcccctggagtactggagtcagttctcaatagtggagcagagaacattgaccccctacatgtcactgaaaactcaaatgccttttcaacaccagatattaaaaatgtttgacttcatattgacccttatctgtaaaacacctatttagaataatatttggaaaaaagtaaatagctttttcaaaatagaaaaaaaaaaaaaaaaaaaagatgtgcctcttcccctcctgccatgattgttgttaagtttcctgtaagttacaaagtttccc

SEQ ID NO: 469123 - DNA, 723 bp, Homo sapiens
ctctctctcctctcctctctctctctctctctctctctctctcgctctctcgctctctcgctcgctctctctcgctctctcttctctcctttcccctgaacccatgaagagtctccaaggctccgggcttgttcccgcatccagtattcctatatccaccaaacacttgaacttaccactgaacacacttgaactcgccactgaacacttgaactcatctctcccaaaccttccaggcttggtcaaattctccaggctgctgcacaagcttctcctgactaactccaaattccctgaggaaaaagaccctaatgttcgtaatgataagtactattggaggaagcacaagagagaggactggaatttcagatatcagaagaagatcataattggaggccaaaaaacacgattgattaactcgttggctactggtgatcgaacccaatctctaacacctctggaggtggggctcagggaggggctgaaagctccaaacctcgaatcatatgggtaagccctctggcaaccagctccccattcttagggactttctaaaagtcatctcattaacataaactcatggtatatttttaatgattgtggtttatagtaacctaatttggctctgggtgctttcagggatgaagactctgtatgagttccttgtttatagagagtctttatattatggccttttcagctgctggttgtagtgacaatgtg

SEQ ID NO: 469124 - DNA, 1022 bp, Homo sapiens
ccttgcatttccatgcagaatgtacaacagcagtagaatctgcagcaaagaagtatgcctattcccgcaattatgatcaaggtcacaagaagaaaaagaagaaagaaagagaaagaaagaaagagagaaagaaagaaagaaggaaggaaggagagagggagagaaggaaggaaggaagaagaagaagaaagaaagaagaacggaaagaagaaagaaagaaagaaggaaggaaggagagagggagagaaggaaggaaggaagaagaagaagaaagaaagaagaacagaaagaagaaagaaagaaagaaagaaagaaagaaagaaagaaagaaagaaagaagaaagaaaagaaagaaagaaagagaaagaaagaaagaaagaaagaaagaaagaaagaaagaaagaaagaaagaaagaaagaaagaaagaaggaaagaaatggttaaaaatagggtacttgattacaatatttcaagcctgggtgcctaggagaaactgatgcaagggcagaaatagagatgcctggagaagacttcacttgtgggacagttgacgatatgaggtgctgcttgcagagtgcccatgacatgttcagcaagtgcttggtaacacaggcccaaagccctgaattgtggaatcagtaaatgaatgaatgaagcactcagatcaaacaaatattcatattataaacaaatcatgtttacatttactgctaatactgggatcactttgtatgtcacagatactttatctcaccttgaagattagctaataactttgtactatttttactttccagagctgagcatgtaaaaatgtgaaatctttcagtacaaattatgatgataaatccaatatgtgattaaccaattgctttggattgcatagtctggcacctctcaaattttaaagtatgggaagtgttggagaaatagatttgaggctgtactttattaaaaaaaaaaaaaccatcactgttgctgttgccatgaggcagtaaaagccagggagtcaccttcactt

SEQ ID NO: 469125 - DNA, 583 bp, Homo sapiens
tcgatgggactgggcgccgtggcgcagtgggtggcgctcattggggaggctccggccgcacaagagcccagggaggggtgggaggctcaggcatggcgggctgcaggtcccgagccctgccccgcaggaaggcagctaaggcctgtacaccctccgcagccgctggaccaggtgctaagcccctcattgcccagggcggcagggccagcccgctgctccgagtgcggaccggccaagcccacgcccacccggaactccagctggcccgcaaacacccgcgcagcccctgttcccgctggcgcctctccctccacacctccctgcaagctgagggagccggctccggccttggccagcccagaaagggactcccacggtgcagcagtgggctgaagggctcctcaagtgccgccaaagtgggagcccaggcagaggaggcgctgagagtgagcgaaggctgtgaggactgccagcacgctgtcacctctcaatatgattgtatacctagaaaaccctaaagactcatccctcatccaaaagattactaggcctaataaataaattcagcaaagtctaaggttac

SEQ ID NO: 469126 - DNA, 678 bp, Homo sapiens
ccaacagctccaaagagacagcgaccatcgagaacgggccatgatgacgatggtggttttccaatttgtgtcagtaacacttgaagagctggtgactgagaaagacttccttgttcttcagataaagctactaaaagtgtgctctcttcctgtttggatgatgagagtgagggggccaagtccttcatcaccaaattcttcccaggttgtagctgctgcacttttccatggaccatgtaaattgggcaagcaaaaaccaagagaaaaacaaatgggtcacttgggtatcaaacatattatttcctatcccttttgtggaacagctgccctactgaaatcagaatcaattaccgttgccagaatggtgactcctttccttgtttcttggaatgagaagactaaaatgaccaggcagcagctagagtttaatgggactcttcctgtgtctgctagtggaaacattttctctctcgtagccaaaatctctaacttacggagaaagaagaatggctgtcactggttggtacttccaggcaaatttatgaaccaggtgccccaggttggttccatatcttttcaattgtgaattgtgctgctattaacatacttgtgcatgtgtctttttcatataatcttctttacttttgggtaggtacccagtagtgggattgctagatc

SEQ ID NO: 469127 - DNA, 1054 bp, Homo sapiens
gacagtggataggcttctgttggttaaaggcactcagagctacagtgcttgtgtgcatcgctgatctactgcctcaccttgctggctacagggctgcagctgagcctaaggcttcttcagctgtggccacatctcctcctttagcttctctaaatcttggactactgcatgtgtagttccatggtgaaagccaccagctcctcctactacaggtctctagccttgaccaggctgcagatggtcagatgcagatgtgggttccattttgttctttgggttccagttgtccttgtgggttctggtgtgtccttgtcctcccccagttcacatccagcttttcttctcaatatcagtcttgctgagaaatctcaggcccactatcagatgctgaagcaacagccttccatagatttctttaccaacttccataattggaggacccagacacacaactggtaccaggagtggtctgaggacgaaggcagtaggatgggttgggggttggataattcgctggtggcaaggagcaccccaccccatgatacatggggtttaacgccggcgaggaccccaggggatggggcaaacttgctgctagggtcgctcttagaaatctgggctggggccagtgacccagctggctggtcagaggactggggaaaaggatggacactgtttctcaaggacaccaccagcatcttggtagcagctcagctacaaagggtcacgtccatcctggaagggccagtggagcttgccaaatgcctgatctgcaggtgtggaatcccatacagcatagcatctgaccatgggacccacttcacaggagcccagtgccaagaccagccctctgtccttcgtactttgttcctcaacctgctgcccttggcttctcagggcccccaacggttccagcctccactgagtgaaagttgacatctcatgtttctctgaattttgtcttccttcacttaaattaccagtcctagtagccagaggctttgaggctctgttctttgatagttaaactaataaattgccaatgttactaatc

SEQ ID NO: 469128 - DNA, 574 bp, Homo sapiens
ggaaaagagacaaggcaataaggccagcaaaggaggagagacaatggaacaatatgtgtgtgatggcagaactggggatgggcctacaatcagtgccatttatggaggtgggaacaatgaacctcctgggccctgtagtgctcctccttgcaatgagagagtacttctaactaagaacatagactgtaagggactgagactgcagagacaatcccacagccacaggattttagagaccgccaaagggaccttagaaaccactttccgccatgatcgaaagttttctgaggaccccccagaagcagatgctgctggaccaggccaagggccttactgccctgcgcagccttgggacatttttcccggcatcctggctgctccagctccagccttggctcaaagggccccagatgcagctcagaatgctgctccagagggtaaaaaccataagccttgggggcttccctgtggtgttaagcctgtgggtgcaagagtacaagagttgagtcttgggagcctctgcccagatttcagaggataaatggaaaagcttcggtgtccatgcagaagcctg

SEQ ID NO: 469129 - DNA, 711 bp, Homo sapiens
agcagcagatgggagctgtttaatacgcagtcagggtggagactcactgaagtagagagtgaagagagccagaatgaaatcctgcagaccctgcagcaggcagcctgaaatgcaggaggcagtcttgggatgcacctgtaaggagcaagaatccaacactccccaatggcaaagacaactgaacatgtttaaaagcactcacttcctagcagtgtttgttttgactactacttttccagactctatgaatcagtatgaacaggtgggctgccttgtcctgaaaggatggacatttttaagcctacttgaagatgagacaccatgtggagcagagaagccttcccagccgagccccacagaccaaaccgggtttctagttgcaagatcatctatccccagtggagctgccagcttactggagagtcagctgagccaacccatgcctgaagaactctcagctgacccagagaatgatgagaaataataaacatgagaaataaagtttgttgttttaagccactatattttgatgcagattttaatatagtaaaagttaactgataaatgccctcagttataaatggaattctaggggagttgaagcctgggcaatacaagatcctaaaagtgggttactttgatagcctacataaaactgtgtaatactatcaaattgagtgcatgaaaaaaaaaaaaaaaacttaccccata

SEQ ID NO: 469130 - DNA, 580 bp, Homo sapiens
cctgccttctgcgtcgatctcgctgggagctgcagacctgagctcttcctgtttgaccatcttgccagcaacccccaagtactgcggtatgaccgcatgtttaagagtcctaaaaccctatgtaagaagtcagtccctaactgaacccatacccaaatcaacaggctcattcctgcggcagcaccatggtgccaccaagtggacagcttttgaacaattaaactcactttgggaagctattgtgacaatgccagctgaggaagcaaagtgcctgaaggactacaattcacatccccaatgtgacagccttcctacagctgtgtgctgtgaattgaaagtttgtgaggaaagaagaggagtattaactcacacgatcacaaggtcccacaaggtgtgcaagctcaggagtaaggaagccagtctgaaccccaaagctgaaaaacttggagtccgatgttcgatggcaggaagcatccagcatgggagaaagatgtaggctaggagactaagccagtccggtcttttcgtgttcttctgcctgatttttattctggcctcactagaagctgattagattgtg

SEQ ID NO: 469131 - DNA, 588 bp, Homo sapiens
gactaaatgatacctttgccctttctttcaaacaaaatctgtgatgatgttcgccatgcgtttgtcatatatggcctttattatgttaaggttaataccaatgacttgtgcaagcactggtctggatgagagtccaggggcattcctcagtcccctggagaaatgcccggtcaaggagcagagcaaccactgctgcaatgatgtcccggcacaggaagtgaggggtggcccccatgccaagaacttgctatataggccaaaaccatacctctcaggcaaatcttcttgtgctcggtcctgtgaaggggagaagcccaattctggcacccatggctggagctcacgctacactttatctgaagtttcctttaacttttctgttgaattctcattttccttcttggataaaagttcactgtgtgaatctctgcatgatagtttgcttcttccaaattggccaggccataaaatctactttcaaaggatgcctcctacataaattttctgctttggaagaaatcacctgggcatgataatcaggggctgtcacattttggagatggtaaggaggaaatttggctagagtat

SEQ ID NO: 469132 - DNA, 1332 bp, Homo sapiens
ctgtaacaccacgaggggctccaccggcggacctgtgcccactgacctaggtgaggacagtcatttctgtttttgtgcccaaatgttgaattttccaagaccaccctggcccaccatgcccccatcctgtgcctataaaaaccctgagaccctagcgggcatgtccacaagcagctggacatcaagaggcacacaccagtggaagaacacacaagcagctggacgtcaggaggacaatgagaggggcacaccggcagaagaacacactggcagacaccagcagatgctggcaggccagctggaaagagttgtccatgttgcaagcagaaatgagacaaacctgaaaaagtctaaaaatttgggccatgaacaggttggaaacgtctatgactacagcttctggatcccaaacagaaatctcagaaaccacaagtatttccacgaaaaactgtcacttcaggaaatagctacagatatattaccttagcaaagtaaatcagcataatttggtttttgttaattcagccaacattcttttgaggcactgtgattaaggcagtatgcaaggttgatttgatattttttttaagctacaaatttccacttatttttaaattgagcaattaaatgtatttattattaagtcaataaattgtagaagcctcatggaatcgtttgttcaatgaaagtctttactaagacaaagaacatgtatttctgctttcctaaaagaggaatttctcttctttttagaatgatactatgctgttttccactggcaaattagaaaagaataaatttcaaggtctgaattggacattactttgaaatacccacagagagaacatttaaaatactcctataataaaatgcagtcatcaaattgccaaaatttgtcccagttgcatgaagaactacagaaagcacaacactaaggagagagatgttctcctatttggcattatagagtgaaaaattacctgaagtgaaaagcatttcactttctgattctgagtagaatcaggtctataaaattaaatgatataagtgtggcccagttttaatttttttaaattacatttttaaaatattttctggatacctatatgacagtgtatcctagatcacactttgataatcttaagcaatgttttctaaatgttcccaggcatgagaattagttagggtgaggaggtgattgttaacatgctggttctcatatcccagaatcagattcattaagtgttgtgagggaccaagggtctgcactttcaccaattcaccttggaggttaaaatgttcactttgaaagttagaatgtatgctagatat

SEQ ID NO: 469133 - DNA, 551 bp, Homo sapiens
gcccagccaactctgcggccggagggaaccctggggggcaagccatgaccggggtcccaggtcacagccccagagctgaccgcgggagggacggggccaccagctccatatgcggcccgccagccgcatcccgccggctccaccagcccatccccagtctggggacgcctgcccctttcactcaccattctcgtcttcggggctgtcctggcgtcctccctatggctcctggagtgtgcagatctcagcgaacagcagagacgccaaacccagtgcagcgggcgcgagaagcaggactctgccagaaacagcaacgaagcccagcacctgcggccaagaagatagacacaccaacaagaacatcattattaaatgcatggaaaaactggagttatatgacagcaatattcaataaaggaactaaaggagaataaaagcaaacatttaaactagatcagagaagcagccccctgcacctacagttagcaaggaaaacccgcattcgggaggctaagagtattccaagcttgggagtcagactctgacccctc

SEQ ID NO: 469134 - DNA, 693 bp, Homo sapiens
tccttaaaaagttgttcatggggctgagagcccccaggggccccacttatgcaccactgtatccccagtgcctgctgcaggcctggcatctgggaggtgcttattcaatggtttttgaatgaatatgtgtgaatgatgaggcctgagaaagaaaatcagcccctgacatccagaaatgggtctgatgaccagaaacaggccattatcattgtcgctttattggagataaaagatgacggggagaaaaggaggatggacaaaggtgaagggacagcatggtgctcctccttgctgatccacgtggttggaatggaggctgagagaaaaaatgggcagagccagaaatcccaggacctggtgttagtgggatgtggggctcagctgcccacctgtggcccagagcagtggaggatgccttggctgtgccctggcacacagccctctacctccctggcatctgagcactggggactgtggcagtgggctccggtaacccccacaggcccccatgatgtatgttcccatcctacatatgaggaaatagtatctcagggagatgatgtgacttgctcagggttacacagcaaatacctggacagggtgtgacttgacaaagctttttgtccaagttaaaatgccagagacataatattgcaataatgccagtagaagttgctatttattaagctccta

SEQ ID NO: 469135 - DNA, 1020 bp, Homo sapiens
cagcagtatcccacactactggtcccaagtatgactgtgcaaccactttgctggcaagggggtgtaacagcttcttggaagctcatgggcctctcctacttgggaaagggctttcagcagggtggactatgtcagagggaaaatccggggctcaagtgctgctgttcagattttgtcccacaaggtgctccctttcgtcacgctttccctcttcccatagggatggggctccctgagagccaaagtgcagtgattgttttttcccttctgggtctggctaccacgtggagctactgggctctgggctggtacaggggtggtgggcggggtgtctgcaaagaatcctgtgatgtgacccatcttcaggtctctcagctgtggatgccagcatctgctccagtggagaatgcttttaatgatgaggaaaaggatctttatacttatctccagaattttaaaaaacttaactcagaggatttatctaaaagtcccatagcctaacatacaaatcaaatttcaaggatctgatttcagcttgaagaattttagctaatgaattacttggccaagcaactactcttcttttttttcttttaattaaaccaaagaaattatctatggtacaaaatactcttaacagtccaataattcatgtgatgagtgaaactgtaaaacctgcagttgtttacataactgtataaaactgtgccctctccaaactgaagccacagaaccatcacaagttgtatctgaggattttctccttatttacaagctaattatcatggaggattgatcatttcctgttccactaggaattaactgcaaggcctttctgtccctaaagccaacagtacactctcacttgtttcctatttcaaattatgtccactcatgttgtccaacataaactatctaagattctgaaataagagcaaaagtcaaattaggatagtccaataataatatgccaacaggagatttccaaatctggaatatatcttctctaatttttatatt

SEQ ID NO: 469136 - DNA, 869 bp, Homo sapiens
tccccagcaatacaaccagacaaccccaaaatggcacatgtgagtgtcagcaatggcaacattgggctccaggccagctggcccttaggtttccaggtggggtgcataggcactggtgggccgggtggtctgctccttgggtccccaggtgggacactggacattagcagtgaagatgtatataaggcactgcatgggcttgggtgccagcagcatagccacatcctcagatccagcaggacccacaatgctgcagtcctctgggtgaatgtgggagactttgatggggccctgggatatggggatacagaagataatgaactgtcggatcgtttgccaatggtggtgtctaatattcactggggaccaagccctggctcagtgtttctccgaaagttcctatcaatcaaaagcactatagaaacctgggtaatgagagcttgcagtctagtgatggtagcaaacttatatagaggcaacctcaccagaatgcaatgagagttaagcaaagaaaactacagccaacaaataactgtggacccagaaataacaagtgagacacatgtatagattattcccttctctaggggctaaagcacacaagaaatataaacactgggtgggtttgccaaatgcaagagctactcagccttcctctctcttctgacacccatgagatttacaacacatgagtccacttcccagacaacaggttgtaccaaggggtgcacttgacagaaagacaactttgtagcccatacttaggttagaaaagaaaataatattttagaagatttttttttttttttgaaaattggacattataaatagtaatgttgtagaactttctccttagttcagctaaaaac

SEQ ID NO: 469137 - DNA, 597 bp, Homo sapiens
tccaccgtcctccagaccccagaatggtagatccactgacagcttgcactggaaaagctgcagacactcaacaccagcccacgaaaatagctgggaggaaggccgtactctgcaaagccacagacgtggagctgctcaagaccattggaacccacctcttacatcagtgtgacctggtagcagagaaggcagatgacgggctcctcattgctgaactccagcccataaaaatgcttcaccgcactctgagctatttttgcaaggacatctgttgccaaaaaagaattttaattaagcaaaaacacatctctgttttgtccgtggcaaggaggcttgtgaaagctttcttgtctcagatgcatgctaaatctggagaaatggaagctttaagaagcaatctacataaaaagcacaacatggtcttcagttagcccctgccctttgtaacagagaatgtttagtctgagatgtcacacttagtgggagccgctaaagtaattacataattatagtctccagctacacttcattttgtgtagtttaataattttaaaatagcatatgctccctccttcttccttagagtaataaggtttg

SEQ ID NO: 469138 - DNA, 630 bp, Homo sapiens
agccctgccatggcttaagctttcaaactgcctctcagggccaacttacagtgggtccctggactcatgcagttgtcatttccccagtgccggaatgcataatgggcacagacatacttagcagctggcagaacctccacattggctccctgactggtagggtgagggctattatgatgggaatggccaaatggaagccattagagctgcctctacccagaaaaaggaacagaagaaggctctgcaataggtccaggctgctgtgcaagctgctctgccacttgggccatatgacccagcagatccaatggtgcttgtggtgtcagtggcagataaggatgctgtttggatcctttggcaggaaccccataggtgaatcacagcagaggctgctgggattttggagcaaggccctgctatcttctgcagataactactctccttttgagagacagctgttggcctgttactgggctttggtgaaaactgaacatttgactatgggtcatcaagtcaccatgtgatctgaactgcctatcatgaaccgggtgctttctgacccatctagccacacagtgggtcgtgcacaacagtattccatcttcaaagggaagtggcatatacgtgatc

SEQ ID NO: 469139 - DNA, 664 bp, Homo sapiens
cctgctcgagccccatcatgtatataccacttccatttgatgatggaatgttgctgtgcgtgacccactttatggctagatggctgaaggcaaattgcttctggtgggccttatggacaggaatggagaaaaaggcatttgccaagtcaatggctgcatactgggttccagatgtgttaatttgctcaagcaatgaaaccacatctggtacagcagctgtaattggagtagaggcagctcaaatggcttcccaccataatagccctcaccctactagtcagggagccagtgtgggggttctgccagctgctaaatatgtctatgccaattatgcattctggcactggggaaatgaccacaggaagatctttggtactacattacttgaaatgttttggggatttaaaatagaagtttttgtttttgttaggtttttccctcagtggagtacacgaggtaacaactacactgtaaagggagtagtgtgtaaagaggatccctttactgtcctatgattaattttatcaacttttcctaaaattaggagtgaatacatcattaacagaaatagcagaaaacaattagataatgataagaagtacagagctaataggatagattttataaaggagagtttattaagtagtattaattcacacagtca

SEQ ID NO: 469140 - DNA, 653 bp, Homo sapiens
tctggtcagcagggacctggtcaatgtgggctgctgagcactgcttggataagccaggtgcaatgtgcattattgaaggccctgtggacagctgggatagcccagtgatgcccaagggcctagtcgaaagtggacaaagcacatatttggatggacctgggagatcctgctcagagattctgacaggacaaaggattccagaacactgctacaaggctctgagtgtttgttcctcacataggattccagaacactgctgccattgtctgaatgtttgtcctccacataggattccagaagtctgctgctggggtctgaatgtttgtctcccatctaggattccagaacactgctgtgagggtctgaattcacatagaattccagaacactgctacaagggtgtgaatatttttccctcacctagtattccagaacactgttgcaagggtctgcatgttggtccgtcatataggattccagaacactgctgctgtggtctgaatgtttgtccctcacataaaattctggaacactgctacaagggtctgaatgtttgtccttcacataccattccagaacactgctgccgtggtctgaatgtatgtccctcacataggattccagaacactgctactaggttctgaatgttttt

SEQ ID NO: 469141 - DNA, 3287 bp, Homo sapiens
gcacagcgcttcattcaccgacctcagttcacatgtgctgatccttgaatgtactcacacctgctgcagggcactgacaaacaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgcctcagcctgcattcagttccaacctcgggtttcccgcatccaacagaaaaacatccgcatttcggcagggcagatctaccacacgacagggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgacattgtgctgaatttccgtaccacattcgtgtccaagtcgggccaggtggtgtttgccccaaagtccatttgcctccactacgtcaccacctggttcctgctggatgtcatcgcggcgctgccctttgacctgctacatgccttcaaggtcaacgtgtacttcggggcccatctgctgaagacggtgcgcctgctgcgcctgctgcgcctgcttccgcggctggaccggtactcgcagtacagcgccgtggtgctgacactgctcatggccgtgttcgccctgctcgcgcactgggtcgcctgcgtctggttttacattggccagcgggagatcgagagcagcgaatccgagctgcctgagattggtactggaggctccctctgcatgtggtggggagggagttgtgtcagaggagtgctggcagtgaaggggcaaagcggcgggaagccatggggctgggtctgtgtctgcgtgtccccacccccagggcccggcatcctcgcccacagtcttcctgcctgctcaggccctgctgttcccccctcaggctggctgcaggagctggcccgccgactggagactccctactacctggtgggccggaggccagctggagggaacagctccggccagagtgacaactgcagcagcagcagcgaggccaacgggacggggctggagctgctgggcggcccgtcgctgcgcagcgcctacatcacctccctctacttcgcactcagcagcctcaccagcgtgggcttcggcaacgtgtccgccaacacggacaccgagaagatcttctccatctgcaccatgctcatcggcggtgagcccggccgcgcgcgtcttcccggggccactcccagacttctgcccgcaggcggcgccgtcccactccccggagggcctgaggccgggggctcttccgctttagccctgatgcacgcggtggtgtttgggaacgtgacggccatcatccagcgcatgtacgcccgccgctttctgtaccacagccgcacgcgcgacctgcgcgactacatccgcatccaccgtatccccaagcccctcaagcagcgcatgctggagtacttccaggccacctgggcggtgaacaatggcatcgacaccaccgagctgctgcagagcctccctgacgagctgcgcgcagacatcgccatgcacctgcacaaggaggtcctgcagctgccactgtttgaggcggccagccgcggctgcctgcgggcactgtctctggccctgcggcccgccttctgcacgccgggcgagtacctcatccaccaaggcgatgccctgcaggccctctactttgtctgctctggctccatggaggtgctcaagggtggcaccgtgctcgccatcctagtcaaggacttgtacatgtggggaggtggtgacctgaccactgctgacgacatcgaatcctcaggcagccaaggcacgtgtagattcactgtggggactgctgaagccctggggctgaggtttctcattcatctggcaatccacaatcaagatgagaagcaggaaagggccaggaaggcttcagctacagaggcccagcccagctctgaagggaatctcagcaacctgcagccccctcttctctcctcatggctgaagctctcagggcttgctgacctctacttcctctccccagggaagggcgacctgatcggctgtgagctgccccggcgggagcaggtggtaaaggccaatgccgacgtgaaggggctgacgtactgcgtcctgcagtgtctgcagctggctggcctgcacgacagccttgcgctgtaccccgagtttgccccgcgcttcagtcgtggcctccgaggggagctcagctacaacctgggtgctgggggaggctctgcagaggtggacaccagctccctgagcggcgacaatacccttatgtccacgctggaggagaaggagacagatggggagcagggccccacggtctccccagccccagctgatgagccctccagccccctgctgtcccctggctgcacctcctcatcctcagctgccaagctgctatccccacgtcgaacagcaccccggcctcgtctaggtggcagagggaggccaggcagggcaggggctttgaaggctgaggctggcccctctgctcccccacgggccctagaggggctacggctgccccccatgccatggaatgtgcccccagatctgagccccagggtagtagatggcattgaagacggctgtggctcggaccagcccaagttctctttccgcgtgggccagtctggcccggaatgtagcagcagcccctcccctggaccaggagtcaggtcctaccaggtcaatgtgctctaactggggcaaggcctagacccccaaat

SEQ ID NO: 469142 - DNA, 2871 bp, Homo sapiens
ctggacaaagcagagcgtagagaacaccttctctgctctctgtgaaataggaatgatgatgatgttgataatggtgatgatgatagtgatgatggtgatgaggatgatggtgatgatggtgatgataatggtgatggtgatgatgatggtaatgatggtgatgtgatgatggtgatgatgatggtaataatgatattgacgatgatgatgattgttacaatgatgatgatggtggtagtggtgatgatggtgatgatgatagtgatgatgatggtgatggtgatgatgatggtgataatgatgttgatggtgatgattttatgattatgatgatgatgatggtggtggtgatgatggtgataacgatgatggtgatgatcatggtggtgataatgatgactacgacggtcatgattgtcatcatgatgatgatgatgatggtgatgatgatgatgatggtgatggtggtgatgatgataatgatgatggtgatggtggtgatgatgatgatggtgatggtggtgatgatgataatgatgatggtgatgattattatgatgataatgatggtggtggtgatgatgattatgatggtgatgatggtgatgacgctaatgatgatggtgatgattattatgattatgatagtaacgatggtggtggtgatggtgatggtgatgatggtggtggagagagcccagctctgcccccgggacacccaggccttcaccccaaatagcggatcctgtgggacccatagcactggggccctggggcactgggcgctgggcctgcgtggatttcccagccttgctggaattccgtgcttcgcagcaaactccttcatgcgggggaagccggaggagaaggcccagggaaaatggcccctcagcccaccgtggtaccaagtggccaaagtctacgccatgccccccgaacgcctacgagctcatctgatctcggaagctaagcaggggaccctgttggaggccacgtgggtaacaggcctgcaccggacacagcacttcggcgaaggcaatggggatcctgattggccgcccagggccctcccagagccagacgcggaaggggagggagctctcccgggagcctcacgcgggacactgagcacagcccctatcgcacacgcggttatcgataaacgcagacgtgacacgttcgtgggtccccgcctcgccctgcccacctggggtgcgctccctgcaagtctgcgcccccacgcgccctcggcccggcgcgggtcttctgcggacgcctccagccagctccgggtccctgcgcggaggacgctgattcgtgtctgcccccgcagcagccaccgagcctcgaccggcggcttccgaatgcacgaagtccacgctcctgcccgggaccctgagtcggggcctggtccacgcgtgccgccgcctctagggccctgacccctcccgggcacagcgggcccgtccccggaggcgatgccggcccgggtctgccctgcggttccccctcccgcgctgcttcctgcccgcagtaggggccgctcctcaccgcgcaggccccgctcagaggagccccagagctggagaggcccccgcggctggagaggccccgccgccccccagatgcccccgggccctgcccggttcttcccttcccagccccagaacctctggcttcacctcttcccttcatttcacggatccgcttatttcaggggagctccaggagggcagggattttgtccgtttctttcacttttggatctgcagagcccaggacagcacctggcccgtagtagacacaagattccgcgtgtcaactgtatccacggaaaccattccttagtttattgtcaccgccattcctaactctgatgtgaaaatccctgcgttcatcaacataacccagttagggtcgcactcatcacggggcccccattgcctctggcgcaccccacgactgacatctgcggggccttcgcgctaggcttcgagtttcagcttccgcaccaggcctgcctttctgcaggggccagggtgggggtcgtgtgctgattgggccctctgaaccgccaccgctgcagaggggctgttccttctgtcacatcccttgtgcccgaatccaccctgtgtcttctcttttctcagcaggacattttaaaagcccagaccccctccttacagagcaaatgtccaggcttcggaggtcactgtcacatcccaagaacccccttcaccaggtgccactcttgagactggactgaagccccctggagagttccacttgcctttgtcctgctgcctgaggtgaggacatggacggccgggtacaagacggggcaggcaacctcgcagtggtggtaaccctgtgcatgaaccctgggcctggcacgtggacctcctgtgaccgtccccacaggcccgtgaggctgagcttggcactgcccaagaccacacagtccatgcgcggtggagctggggtccaggctgcccaccagggcagtgactacaatggtggcagcaggggacggtcaccgtcatgagctcaagccaggcgctgcactgaccttgagggagggctccatgcttccccttcccacagctgcagagacggagtccagggactccccaggcctgggccacgcgactgccctaagagcctggcatcagggagcagtgctgtgtgcacccccaggtccactgagagtagggagggggcttccccacgggtaggtggggatggagggtggtccgaagatcaggagacggagccccgcccctcttcgcagacgaagaagaagacgtctaaatgttgaaatgttgaaatgtttcaaatgttaaatgttgaaaacccttaaacgaagaatgt

SEQ ID NO: 469143 - DNA, 3915 bp, Homo sapiens
gggcctgagagacactggatccctgccgtgatgcgtccacgccatcttcacaggactgcctcatttgccctcacaaggcgatcgtgtcaatacgacagttatctgcattttacaggaagctccagcgcccccttccccgaatcccagcctgcagagcttctcttccagacgcaggtgccaccgttcgcgatgctgggagcagagccgccctgcgccatggagaagagcagagcgaacctggctctagtgctgggctctggcgctgccgtgagcacgtgctcaccacacgtccttgtcgtcttctccggggagagccctgacttatccgagggagccacatgcccttccatcctgctgcggccgcctcctcgatttctgcatctccgctccagagcccagtccttcagcctgcagacgagaataatcaatgcccaggtcttggaagagttgaagagaaagcctattgcatgtcagaacatgcctcagaagggaacgggtgccacggaaacactgctgacaccgttggtgtgtcccctgactgcccctggagagggcccgactgggattcagcacccagactgtgcagggaaacatctcctcacaggaaaggaaatctccatttctaccaatggacattccatgcaagtcaccctgaaaattcatggcggaagggcagtgggacctgaccgaggggctggatcagggtgcacgggtgctctcacatgctgggtgacagtacaccgagtgaccttgctgggtgctctcacatgctgggtgacagtacaccgagtgaccttgctgggtgctctcttgggctgggtgacagtacaccgagtgaccttgctgggtgctctcttgggctgggtggcagtacaccgagtgaccttgctgggtgctctcatgggctgggtgacagtacaccgagtgaccttgctgggtgctctcttgggctgggtgacagtacaccgagtgaccttgctgggtgctctcatgggctgggtgacagtacaccgagtgaccttgctgggtgctctcttgggctgggtgacagtacaccgagtgaccttgctgggtgctctcatgggctgggtgacagtacaccgagtgaccttgctgggtgctctcttgggctgggtgacagtacaccgagtgaccttgctgggtgctctcatgggctgggtgacagtacaccgagtgaccttgctgagtgctctcttgggctgggtgacagtacaccgagtgaccttgctgggtgctctcatgggctgggtgacagtacaccgagtgaccttgctgtaccccaaaacctaagcacaaccatcaaagctacagctacaacagccacacaaaaatcagccagacagatgtttgcactcttcttcctctggctgtggcacgcgaccactgggccaagcctctgtgtgagtttctttcatctccacgcggtttctgctgtgacctttttccccagcactgactttacaggaagtccgcttaaatggggccagcatttctgcgttcaataattcaatgcttgcgctcaccgccaggccggttaatttagtaacagtggggagcacaggctgccttccacccgtagatcatgttccatcatgttccgctttgacttccagagcacacgggtgggtgaggacactgtccttcccagcgacggctgtgacttttacgtggccatttaatgctcccagttaatgtgatggtgagaggaaaatgacctgtgctgatagcagtcctggctgcctaaaggttcccagcattttcctggtaaaacgctagtgccactaatacacaggtgtgtgcaaacagtgtgcacatctgtaatacagtggacacacagaccatatttcaaaagctctctggcagggatttgaaattaagtgacaagacatccctgtcaaggacaggatgaagcaatgttccatggttgctaagatgccaagttatttggacaacaattttcccttgtcctaaagagctactgttgattccaagggacgcatcctccttgtaatgacccaggtgacaaactgctcctgggctcacactcttccgtgccagccccagatatcttcccagctcagtcccagggaggaggtattgagcttcctttgggaaatcaagagcaaagctccctcccaactcatggtgttccccgagcagaatagaggccggctgtgtgcgttgaagaaatgaatgaagtgattgggagctgagtgccggcggagaccggcccccctgggcatatgtgaaaacctgaggaccccactgaactttcaaaatccaaagaagagaatcctgaggaaagatctgtatcatttgctggggtgtaagatgtgcaaggatattaacaatttaacaaacacgtatcaaagggaggtataagtactcattttataactcccatgttcattcaataaataccctacctgtatcctatgtgccagacacagatccagatgctgagaagagtcaactaacagctcacaggtcacactgagcttgtgctccctaatggaatgatggtgatgatggtgttggtgatgatgatggtcatgatggtgatggtgatggttgtgatggggatggtgatgattgtcatgatggtaatgatggtgatgatgatgggatgatgatggtgataatgatggtaatgagagtgatggtgatgggatgatggtgatgatggtgatggtgttggtgatggtgatgagataatggtaatggtgatgggatgatggcagtgctgctgatggtgatgatgatgatggtgatatgatgatgatgatggtgatatgatgatgatgatggtgatgtgatgatgatgatggtgatgtggtgatatggtggtgatggtaatggtgatggcagtgatggtgataattaaggtgatggtgatggtgacgatgataatggtggtgatggtggtgatggtgatgatggtgataatggtgatcatgacagtgtcagcagaggaagcaggcacagtagtagcaatctgagtaaacattacacagcccttaatatgcaacagatgctattctgggcacctcccatatgtcaggtcactcaactgacacgacatcacctgaggggcaaggctgcaattaaacatctcattgccctggctcccgctccgggactgcctgcaggaaaaccaatgatcagaaatgcagctggtggggtgcccagactcctcagggccctgccttcatctgatgatgctgctgagctttgcacatgaactgtgccatcccaggaggctgtgctctcatgaggaggggatgggtgctctgatgctgagatcatgtatggggctgtgtgcgtggaagtgaggtaggaggtgagggctccactctggaggagattgaagactgggtgaaacagagaaaaggccacagcgcctctccataagacacggccactagtgccatgacagtttaccattgccacgacaacactgtgaacttacctcacctttccatggcagcaaccccaagacctggaagttaccacctttttcctgaaatttctgtgtaatccattccttaatttgcatgtaattaagagggggtatgtatagatatatatgattgcagagccgccccaccgctcccctcagctcactgccctgggctgagccccacttttggggctctcctgccctgcttcagaaggggacaccccagcatgcaccagcccacaccccgcctcctccgtcctcttccccactcactggcctcattggggaatgcttggaattattccaggacagctttgtcctttgcccagtgctgtgtccccaggtaaacagtgggtacctgcagagagaggtcctcatggggacagagcctgcagtgccacagggcccatgccacctccctcctgggtacactt

SEQ ID NO: 469144 - DNA, 1119 bp, Homo sapiens
ggccagcatgcagggaccactgagtctgcgcttgttctgccccacaccacccccagctcagagcctgaagggtagagggcagcgccaccttcctaaagcactggggggcagagggccggatatcaacgtaacatccggttgtttgaacccgtggagaactgcggggcacggttctcctctgcttctcagccacgccgtcccgccatgcgttcttcacccacatttgtcgacctgaaatgtgggggtcctagagggcccctcttcagagccacacttacagccagccagttgcaaagagggcaggtagattccacaccatcttccacagcccgctgcctgccactctctgcagctcaaatttcaggggctcctgcagctgagacatggaccctactttacgccaagcagagggccgtggggttccctcgtgtgactgtgaggtttgctggagactgcgagcctgccagtgtggcctctgccctgcctggtgcccatcctgtctccgatccacctgcacgccgcatcctggatcctcatctcccgcacccatggatttcagcatccagtgtttcttggcgttccctctcacaggcccagttcctcatggacgtcaccacctgcagcctcactggggcttcttccattcctgaatgagcgcaggggcctctgcgctcgctgcttcctgtctggactgttcttccctggatttctgcgtgttcccccctccttgttcaggtctcttctcaaagaccactccccagcgaactcttcactctgtctcctcctctgtgtcattgtaaccagccacctcctggggctgaccgtcaggaacaagaactgtccaaggaagagcagctctgagaagccctaggtcttgtcttctctcagaaaagagcctgggttttatgaacatccaggtctgctccccattccttgtgggctgcccattgtcatatgatccaacatggctgtttccccccaaaggacaacaggcagggcttgggagggacccaaagagagaacctggctaggactgtccatgctaagggacatgctgttcaaagatgtcttaggatccttggagcccctaacaaaccatttttgctagcaaagcttttt

SEQ ID NO: 469145 - DNA, 2931 bp, Homo sapiens
caggtgagggacggccggtgtcatcgttggagcttcctaagactcccagaggctgatgcacctcccagacccgcctccgcccggctccctgggccctgctccaggggcttcattgctccctgccccgggtcacccctcggctcaccgtctctcaggtgtggaatatcctgctccaatcaaagccatgtcacctgcgttgtccagtgaaacgtcagcggacaggcgctgcccgggctccagggagctcctcactgaggctcactccctgtgcctctgccatcagcacagggggacatgcctggctgcctgtgggaccagggaggacgcgcggtgcgggagcagagccagccacactgccgctgctgcactgttcatctgagtggcgcaagaacttgtcagtgcctttaatctgagggatgagtcttcaggagagtttgttgtcaggatttaacacttactcttggaaaagcagtaatgtgtgctggaaatgaaccgggcagaccctgctcccatctccatctgcctcaatctcagtgccctccactccccaccagcagcgcctgttaccaagtcactgcacaacaaccacaaatggagagtggaggagcatcactttccaccccgggatcatgacgagggctctgtaacttcaacaaatgcgcagaagacgcctggcctcgagcttgtgcagcacctccggagcctgccttcccttgtcacccacggcaccatgactttggagggtctcagctcagtcctccctccagaggggctgtcagtgctgggcagaaaatcacccttcaacgaccgggcccagctgcgctctgtcagagagcagagaaagcaggcctccgggaggttctcactccaccaaggagacgtctccacccagcgctcatcctgagcaagggcactgggaggaagaaatgcaattttaaaacctgtgctgcgaatgatgacttctgctgcttccgtctctggagagctctgggcacttaacatccttccacccacatgcccgagtctgtgcagaaacctcacccacgcggaggagactgcatttcccagtagcagattcaagtcctgaacttcctgtaccacaaagtgttacccacactggtgggtgccagcctgagactcaactatcaggaaaaacatgaagaattcagtccatgccctcaaatgcacccatgtggctcccaaacggcaaatctcagcaatgagattctcagctaggaaagtccacactgaactcatgcagaggacaaagtacataggcctggggttcttggcacctgagatctctgagcagttttctgaattttcctatttcctgttgaagacataggaacacgtggcacagaggcacagagacctggaaaccaacaggtgacctcagggaggtttgtgaagcaccctgatgagaagacagttgggcagacgtggctggctattccccaagtccattttccctcctgggaccagagctgactccatttctcaatctgccttgcagtgagcatagtcagcttcctggcactgctggacctgtcttgaaggctcttttggccggaaatggatgggcagggatctgagagcacctgctatcgggtgagtcctgctttactcatgtcagagatttagactaaaacaaacacaaaatgcaacaaagacctaagtgtaagagctaaaagtataaaactcttataaaaaaagtaagtgtaaattttcatggtcttggattaggtagcactctcttagatgtgctatcagaagcacatacaaccacaggaaaaaaaatacataaattgaatttcatcaaaatttaaaacttttgtgcattaaagttcatgatcaaaaaagcgagaagaaaacccagagaatgagtgaaatatttgcaaatcatacatctgggacaagtatccagaatatataaaaattcttagaactcaacaatataaagaaaaataaccaaattaaacagtaggcaaaggattcgaagagacctttgtccaaagaagatacacaaatgaccaatgagtacgtgaaaagatactcagcagctactcattatggaagtaccactttccactcatgctgagggctataataaaaaacaaaacagaaatgacaagtgcagtgaagatgtggagaaactggatttctcatagattgctggtgggaaagtaacatggtgcaaccaatgtagaaacagtttggcagttccttaaaaaattaaacagagctaccatctgacccggcttctgctcctaggtatttatacacaagggaattgcagacatatgttcacaccaaaactagtatgagaatgttcatagcagcattattcacagtacccaaaaagtgggaacaaccccaatgcccattgaaagacgaatgaataaacaaagcatggtgtgttcacaccatggaatgtgcctgtgtcctcagccatggagagaatgaagcactgacacaggccaccatgcggctgcacctcaaaaacataatgccagaagaaagaaggcacacaccatggccatgtgttttatgatcctactcatagaaaacgtccagagcagccagcactacagagacagaaagcagattcatggttgccaggagctggaggaaccttggtcagttctgttcctgccctgagatgcctcacctagagaggcctccccagtcccagccccctgggtcaaggcccccagcccaacgcggcccctctgacatctccggaaaaagccctgctcccacagagaggggccacctgccctacaatttttcctttttaaattaactttcccgacattttcctgttctaagcacaactcatcattggaggaaatttagagaatgtacactgtacagtgtaatactgtacactgtacaagtattaaataaaaggaaaaatgtccttctcta

SEQ ID NO: 469146 - DNA, 651 bp, Homo sapiens
cctggcttccgggctttggcacagcgatgacccccaggcagcgggggggctgtctggcattggtaattagtgaacctgcttctccactgggaggagtggccgccccgagggagaaagaggaagaccacaggccgccccaggagcttgtggcctgtggggcccaggccccctaccagtcctcgccccggctctgtgtttcccgctctcctgtggggtggcggggccaggcctcccttctggctgcattctgtggaggggcgctccacgaggcccgttgtacagaaggagaaaccgacgccagaaaggcacgtggctccctcggccaccgccagccctggtgcctggagaagggaagtggcctccggtccagggacctcaaatacgcggaccagaagtctcctctcaaggccgcgtctaccgatggccgccccgttatcctggctctagaaaatcttcctgactgaggcaacattgaaataacatgagaaatgcggtgctgacacaggtgcgcagacacaggacagctggggaagggggatagacagagcacagctgtcccgggcccagagccagtgcaggccgcccaccacccgatggagtcagggtttggattagagaaggggccttgctcaggttcaggcctgagcagaa

SEQ ID NO: 469147 - DNA, 834 bp, Homo sapiens
gtcagctgatctgcgatggggaaaagccggctctggtgtggcctttgcccagcggccaccgttcaggatgggggagcaaggacacagaggacgaggccatgccggggcctcattacccacagatgtcacacggctcctcctcctcccctcctcctcctcccctccgcctcctcttcctgttgctcttcttcctcctcttcctcttcctccttctcctcctcctcttcctcctcttctcctcatcctcccctcttcctcccctcctcctcttcctcttgctcttcctcctcctcctcccctcctcctcctcctcacctcctcctcctcctgtccctggggctgttgtcatggacaccaaggggcaggtccatttctggtcacagacgtgcatccagcttctgtctgcagccaaatggaagcagctgcatttgctgaagccacaggggcctgtggtcgccggtcctgggactgtccccgacaccgatgctagctgggatgtccgggcgtccctcccacaaggtgctgaggaatccaggcagagcacagtgtcctttgctgcagggtctgagggctctctgcccatagagctgctgcggctacgcactgttacatctccggaagatgtgccttgttatgctctcagtacttataaaaaaggaattctctgtccacaatttattcctgtgctttaaaagtttgaattccagtggaaaagcagcaagaagacatgagcctcaaggatggttctggagatgggtctgatgattgtgcttggtccaccaaagcttcccacgagaacagcatgtttgtttttgctgacacccccagccccca

SEQ ID NO: 469148 - DNA, 519 bp, Homo sapiens
gtcttcaggaaacacataccgtatggcaattaaaatgatgttctccccctccgtctcagggatgagacatgtgaggaccagtgagaagtactcatcttttacaatgaatgtcaacagactcttacaaatgaattcaccccagactacattgtcatctcctggggacacgtttaaatcgccttctgtgtcttctgtgtggtctgtggtcaattcggattggtccatgcaccattctgataagtccatgctctattttaatatttcagtgccctggggaatatgttcccaactggaacttcccactggtttggaaagagcggggaaattctccccaccacatcacctgtctgtggtttatccccagagtctatacatcagtaggcaggtatgaaagtggcttatgtatgtaaatatgtatgttatttttttctgaagtttaagttgtctggcttcagttcacagggctttaagaaagcacagcttagtttttagtgactctaaattaggaaaaatgggggg

SEQ ID NO: 469149 - DNA, 727 bp, Homo sapiens
gcacatcattggctgagatcagtctctccattttcctaatcgattcttcatgcaaagccacattttggagaaaaggaatggttagaatcatggcaggtatgtttggtcgtgctgtgcactcaggatccgacgaggaacctgagggtctgagacacaggaagctgctcgatcctccagccaggatgaggctgagggagagcccaggccaactggctctcagagtttggactttcaaccacgaattttccacaactgtgcggaaatcaagtggcatcagccccaacgtgggagcgatagggcgtggcggggactgtggcgcagagagggtgcagtcccaaggggagcagcggcttcacccacagatgctgcagcaaggagagccccgtgccagctgcccaggctgttggatccgttcagggatccggcttgcacgtgggcccacgaagggggtctgcacgcaggcagggtctctgttccccgagcatctatccccagcacccacagcagtgcccagctcagctagggtacggtaaatgatgtgtgaactggtgaattcatggaaatctcccactttttacctattggggattaattccatattttaagtctgggccggcagtgccacgtggtcctccaggtgctgagggaatccaggcagagcacagtgtcctttgctgcagggtctgagggttctctgcccatagagccgctgtggctatgccgtgtt

SEQ ID NO: 469150 - DNA, 651 bp, Homo sapiens
ggcagcgagtccatgataaggtctgtacataaaagctcacaaaacctaggggtccttcatggcagaagctgctgtggaagtcggatggacgtttattcctctgttgctgggttgaaccctggctgcccccatgcccctcaagtgctcgtcagcatcactgtcaccatggaaaccacatcctcaaaggggaacgtgcttaaaaggcagaaacaccagtatccgtgggctcattcccatagcactcagaatggtgatgtttgtgatttcccaggctcctactggactcatgtacagaccatgtggacatccaagaagggtctgagagtctatgccaatgggaccctgagcacctgtgacatgagaaggaaagtgtctcatgcctatggggaccctgatgtcaatcttgtgatgggatctcagcaggactggacccagcattatgataacggagctttggatgagttcaacatccagggatggccctacctctggatgaggtcaccatgtacttcatagctgctgctgtgacacccaacactaacagggaaagaccccatcttttgggggtccagctttgtcagtaactgtccatgtgtcttccatgagccagtcaccttgactggggaagaagagatgggatgaaatgtagac

SEQ ID NO: 469151 - DNA, 730 bp, Homo sapiens
ctgcaacacaactttctctgtggttacttagaagagccagcatggatgcacggtttacagagcaaacacaaaacccaaaccatccaaacatgggatcagattgggttcttaaatgaaaatgaagcacctacagtggctgcagattttttgcgatcctatcaaaaccaaaagctaaatggcaataccctggagattggaccagcgagaatgttccaattcgaggggaaaaagggtaaaaacttctgtggaaaaagaagaggattaaaaatgtttaaaatatacttcatgtctgataaagaaatgaaaagaaccatttacctatgtgttagtaaagatacatcattcttttctacaattgactattatgttaaaacaggatttctttataatttacaaagctatcctaaagattcaaaagaaatattctgtgttccaaggcctgtactaggaatcataaatattattgagaacaggacataaacacatttggactaattttaaaatttcagagggtatgataaattgtgctcattgtcccctcctaatctaaaaaccacacagagaggttagttacatatgtatacatgtgccatgctggtgcactgcacccactaactcgtcatctagcattaggtacatctccccatgctatccctcccccctcccccaaccccacaacagtccccagagtgtgatattccccttcctgtgtccatgtgatctcattgtt

SEQ ID NO: 469152 - DNA, 1532 bp, Homo sapiens
cgcatagacatgcttagcagctggcataaccccccacattggctccttgactagtaggatgagagctattatgatgggaaaggccaaatggaagccattagaggtgcctctacctagagaaatagtaaataaaaaacaatatctcatccctggagggattgcagagattagtgtcaccatcaaggacttgaaagatgcaggggtggtgattcccatcacctccctcttcaactctcctatttggcttgtgcagaagacaaatggatcttggagaatgattgtggattatcgtaagcttaaccaagtggtgactccaattgcagctgctgtaccagaagtggttttggcaaattcctttttctccattctgtccataaggcccacaagaagcaatttgtcttcagctggcaaggccagcaaagagaagaaggctcttcaacaggcccagtctgctgtgcaagttgccctgccacctggtccacatgacctagcagatcccatggtgcttgaagtgtcagtggcagatagggatgctatttggagcctttggcaggcccccagacagctcttggcctgctactgggcttcggtagaaacagaacgtttgaccatggggcatcaagtcaccatgagatgtaaaccacctatcatgaaccagctgctttctgacccatctagccataaagttgggcatgcacagcagcattccatcatcaaatggaagtggcatatatgtgatcaggcttgggcaggtcctgaaggcatgaagtggggaatgctgccaccaggagacacaacaataattccattaaattggaagttaagattgccctggaccactttgggctcctcttttcctctaagtcaacagcttacgaggggagttacagtgttggctgtggtgattgacccaaactatcaagatgaaatcagtctattactccacaatgcaggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaataataataataataataataaaaaaactgggagagtgtaatatattggaattcaaaagaaaatattccaaggagaaagaaatgtctaaattaaatgctgctgagaagtaaagttaggactaaatatagaccataaagccacagaattaccacatgaagattatcaatatcgttgaataaatcaattttagtgaaatagttgtgattaaagccctaagagatgaaatggagacagtaaacataaaccttttgagaaattttgccaaaatgcaaatagagaaattgggcaataaccagatgatacacagaatattaaagagttttctttttactttaggtacatgtgcacaacgtgcagg

SEQ ID NO: 469153 - DNA, 469 bp, Homo sapiens
acagaagcccccagagagcagcacctcaccatggactgcacctggaggatcctcctcttggtggcagcagctacaggcacccacgccgaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagacacagttaacattcacagagtgggaaaggcagcaatcaatggagtggatgcaaacattcctttgtgaggacataaattttaaaatc

SEQ ID NO: 469154 - DNA, 628 bp, Homo sapiens
tctctggattcaataatagtatatgctatattttaattatttatttttaaagtttctgtctcatctaactggaatagccctggctggggctgggtggcaggacagcccctcagatgaggtcagcaacattgaggggcatttcctcaatggaggagttgtagaagatctcgatgtctcgaagagtcctcttgtcttcttctgtcaccacgttaatagccacacctttacggccaaaccgtccacctcgaccgattctatggatatggttttccctgttggtgggaagaattggcggataccctccaaggtcaacacttccttcgtgacaagaatccgaatgaggtccctcatgaacttcttggtcacctcaagcacatcagaaggcatcgcagctgacagcaaaactacctgggttcatgtcatcaaagctgtcaacaatctcattccagttactctcaatgacacctttgggctccatcccattggggccgttgtctctggatcaggaatcctggctcgcagacatgatccttagaaactctagaatagttttttgttggcatttggttttggttttggtttcgccattttggtcagaaaacatactttgtataatttgcatcctttt

SEQ ID NO: 469155 - DNA, 655 bp, Homo sapiens
ccagcattggaatcccagatctatcatgttattatatgacctcaagggtgaaagtttgtttcaaagttctaaggagaactttgatgttaacagtcctcatctgacaaaatcggtaaagaatacaatgagatgttggtgttccgctgacacagtgttggtgtttcccacacatggaggaaacttagggatatgtctgaccttggtactagcaggaagcaggagagcaaatcttgctgaggtgcccagaggaatcctaacttcccgcagaagcatgaatgtccatggattgaatgccagactctacatccgaagaaaaccagacccagacctacactggatggccacgtggcacttctctatgtttttgcctttgtctccaccctgccctttggaaagtcaaggagcgcaatggccaagtgaccagggactcggtgcctccttgcagaagacagtgacccagtggagaaaaacaaatcataaggctctcaaatcctaagaaggggctttgatgtcaaacggatggatgcaatgcagggaggagatgaaaatgaggagaacatctggaaacatcagtggaccacaagcttttgaaaagtaaaggtggtgtctttctcattttcatatacctttgcctctcctggctttcctgctttgc

SEQ ID NO: 469156 - DNA, 904 bp, Homo sapiens
ccacacaaggggatggaagagttgtacaaccaaagagctatctcaggagaagattctcagagaccaagtgcccacttagccgtgaaaaagatatttgttggcggcattaaagaagacactgaagaacatcaccaaagagattattttgaacagcatgggaaaattgaagtgattgaaaccatgactgaccaaggcagtggcaagaaaaagcgctttgcttttgtcacctttgatggccatgacttcgtggataagactgtcattcagaaataccacattgggaatggccacaactgtgaagttaggaaagccctgtcaaagcaagaggtggctagtgcttcatccaggcaaagaagccaaaattgttctggaaactttggtggtggtcatggaggcagttttggtgggatagacaactttggtcatggagaaaacttcagtggtcatggtggctttggcggcagctgtgatagtagtggatatggtggcagtgaggatgactataatggatttggtttcaagcctgtttaaaaaaatgtttttaaacttgaaaggaagacaagtgaccaatattataaggttaatgcagaaaataatggtcatagtatttaataaacttcaatttatcaaataaacctgataaataatgtgatgctgaataagataaacctaaagttactaagagacaaacactgtatattaagtgttataaccacacatcagaagaccattttagactgtggtttcagggtgctagaatattcgaaccctgtttgcttagctgactaatctaactttttggtaagactggttatatttttttctgtatagagaagaggtgatgagagaaagtattctttagtttattcattcacaattttttaaaaaggtcactctggttacc

SEQ ID NO: 469157 - DNA, 616 bp, Homo sapiens
ttgtgaacatctctttaggaactcattgccttctgcggcagcataggaatcagatgagcaaatggggctggcctttctgtggtctaagagtggcagtggatttgtgtcttgggggccctgcctgttcccgcttgccatgccttccccgacctcacccccaggacccacggtcagaccccaggccctgcctctgttgagtggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttgggacttcttgggtccacaggctccagtccttgtcatgttcccttgtgccaagagacaggatatgaggaagggaagaggcagccagggtctactaccctgcagctgaaatgtccacaagaactggcaccttctcactcttgcctctcttgttt

SEQ ID NO: 469158 - DNA, 745 bp, Homo sapiens
agagaggtggatgatcatgatctccctttcagcaccttcactgtagtatgattctagaccagattctagagctggggaaacagagggacgtatgtctgcacaagctccaaatgcatgtagagatgtgcccagacctacgcatgtgcacgggacccagcaggaccatgagggaggctggggcagtggcagacacaattctgacctctctcccactccggccacagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcaagttggaaatagacaaactcagcagccatccttgaaaaacgagtggtcattatgaaaatgtgttgctcatcctgcaagccagctgcatttgcggccctcttctattatgtacaaaattctgagcccccctccccaagcgccataactgcct

SEQ ID NO: 469159 - DNA, 882 bp, Homo sapiens
caagctaaaccagtgttccacttggctttggtttagcaagtgatggcaactggtatccttcctgagggtgacgagccccccttttccttccaggccttgccagagcccaccccagtctctgaccctctgtgtaacaggctgttctcttctctctgtagacacactgtcagtgccacgctggtccccgcagatccctcgcagagatctcggcaactccatcaagcacagtcctgctgctgcctcatatctcttggggaagaaagcaccctggcaatatcgaggggagatgtgcccagggagttaatcgaatgcacctctgctccagttggtttatcgctgtacacaggagacctccaaactgctcaagtttgcagcaagtggatggggttggagagcgaggcaatatttgttgaacaaatgaatgacccttacgaaagttcaaggttttccaccaagtactggatgtctcagacgtgcacagtctgtgggaaagggatgctttttggcctcaagtgtaaaaactgcaaattgcttaatgacaacgacaacgacaacaaaaaacaggcttatgactgcttcacagggggccatgacacatctttcaagaaaacagcagagctgcttgtgaaagagaccatttgtcccccgcagcacctttcaatgaaggaggaaaggaaagggagattccccacagctcagggcttcccaaacatcagtctggccatgtcatggtcctcagaaaacttcagtggcttcacagcacctgcagattcaaatgcagaccctttgccttagcttttggggtccccaccccctccccttcctcatgtccccaccattcgtgttgttctcttcactttaaaagttctcatcactttaaaa

SEQ ID NO: 469160 - DNA, 857 bp, Homo sapiens
tacagagaccagtctgcagaccagggttaggacctggtgatgattttcaccaactgccaaccacctgagaaaataatggcaatgtatcatcacaagatcagcatatcattgattaatgaaaaaggtccacccgaactccagtatggcttagagcctggacaacttccaactctgtatcttcaagagtcattcctccttctgttcatccaatcagaaacattttttgagtgctcacccgctgtgatgggcaacgaggaaacggatgaattgatgtccaagatctccattctcatagaacacccaggctgctgggaacacagatataaaagggccgattatgacaatgttaagagctgcaaagtggaagttcagaatgctacagaaatctacaacaggggagcagcaatggtgctactaaaccgtgctgtttctattcttctcttcaagggcaacttctgctacctgacagatgaataaccagttgcctagtggcgtttattgaataaccttccttcctctactcatctgtcatgtcaacctgtcattgatcaggtgtgtaccttaactcaggactgtttctgtactccctattctgttctcttgggtgtgactggtttgttatttcagttttcctctttcatatctacctggatgatcttaaatgttttcttattatatatatccttacatatatatatatctccatatacatatatccatatatatatatatatatttggagtacataagatttattttaatttttttattttttaactatttttccaacaaacacgggagtgcagatatttcattgatatacggatatttcctttttttgttgttttgcttatata

SEQ ID NO: 469161 - DNA, 3759 bp, Homo sapiens
tcattcagctgccctggcatcgtgatagcgagtcttttagtgttgtgatgtttaagggagccagtgagctgccagcagtaactgcatccctgccctcgaagacggctctctggtttacccgcacagcttctaactgttgttactattactgcattgatccctatatccactcaggtctggagccagagcctggttttcaaattgcaagacaacgatctgatttagtgatttatccgattaggcttaaatgtatttattacatgcttaaacatattccagtgagctctgaaaacgatccgcagaggaaaacagaaccagaccctaatccaatcagcatctgcgttaggcagaacatcccccgcctcctgtcaataacctcagtgcccccaaacctttatctggagtttagaagagattgcagggaggtaatcttcagggggtccaaggtcacctagactttaacgctcctctgatttctccctctcatagagctgggtaggggggaacccttagctgtcttctagttattgttttaaagtaacatttctctttttgatattaaaatggtttttgtttgtgaaaattatgaaaaatgaagaaatatgtaaaaaaagaaaaccaaatcacccataatcttgctcatattcgcattttccggtgagtcttttcaatatttaaaaatgctttcaaaattacccaagtaaagggattacattttaattataaaaccttttaggcttttttcctatgcatttttaacaaagcagaaatggtatcaaattatattgattatctgatgccctttttccttcccttctttttttttggagggccatgtcattaatttttgaaaatatcacgcttaatagctataccctgtttccttcctgtgaacagggggaatttgcataagtattgggttttggttatattatgctttttggtttttctttttgctattgttttttgaacgagtgattatttttgctattattgacactactactctgaatatttttgtattacctattctcattccacttcttttgaacgtgagattttttttgacagcttaactgagatataatcaacatttaatcagctgcccagatttatagtatgcaatttgatgagctttgacatatgtagatacccaggaaaccatcaccataaatcaaaagagtgaacatggcttttacccccactgtgccctccagcatccttgttctgtgtgttgaaataacctcaccaggtctaggaggctctcagcaactctggatccctgaggcacctacgacgccctctagggcatgccctcacttagaagatgccgtagtagatgtttgctggatgaaagaatgcaactaaactctgctgggtgtgtagatacctagctggtgtacacctgcagtgacggggaacttcctcccaaataactcagtccccttccacagctagcttgttctgggtggtcaatccttgattgagctcaaactggccttattcccctgagcctgatgctacatattttggccacagtgagggggcggtacagacctagcccctgatctcatagagctcatggtttcttggtggggatggacattgaacaactaatgatgtaaatcatgactgaaccccagggtgagcaatgctctggaaaaaaggggtataagagctataaaaacttgtggtggggagctggtgttttgggggctgccctggtcagcaaaggcctccatgtcatgcttcatgatagccttttatgtctctttgtcattttctcttccctggtctaaacattatgagttgctttggccacgtctccattgggcaggattttcagattcttcatctcctgcctgctcttttgtcatccttgcacctgcagctggggaacactaagatccctgtctccaaggacatttgcctaatcatgcagccaatgacagcaggcgttcctcctcctctagccacagaacgttttcagcaggatcaaaggctggcttagaaacgacaataaccacaatgaaaacactgccacccatgaacatttatcacatgcttctcaggtggcatgccctgcactaagcacttgctatgggctcattcactgcgttctcccagccacaatatgagctcaaacctctgagccaaccttttacccataggctgtgctctgtcactatcatcaactggctaagagtgatgggtcgtagcgaggcttttctcccccttgattaaagttggtatatttccccgtcctatttaaagtgactattctgtgtgtgtgtgcacgttgggtgtgtgtatgcatgttggtataagtgtgtgcatattggtgtgtatgtgtgcatgttggtgtgtgtgtgcctgttggtatgagtgtgtgcatattggtgtgagtgttttgagtgtgcatattggtgtgtgtgtgtatggtgtatgtgtgcatgttggtgtgagtgtgcatgttgatgtatgtgtgcatgttggtgtgtgtgcatgttggttgagtgtgcatgttgtgtgtgcatgttggtgtgtgtgcatgttgtgtgtgcatgttggtgtgagtgtgcatgttggtgtgagtgtgcatgttggtgtgtgtgcatgttggtgtgagtgtgcatgttgtatgtgcatgtgtgtgcatgttggtgtgagtgtgcatgttggtgtgagtgtgcatgttggtgtgtgtgcctgttggtgtgagtgtgcatgttggtgtgagtgcatgttggtgtgtgtgcatgttggtgtgtgagtgcatgttggtgtgtgtgcatgttggtgtatgtgtgcatgttggtgtgagtgtgcatgttggtgtgtgtgcatgttggtgtatgtgtgcatggtgtgtgtgcatgttggtgtgtgcgcatgttggtgtatgtgtgcatgttggggtgtgtgcatgttggtgtgagtgtgcatgttggtgtgagtgtgcatgttggtgtgagtgtgcatgttggtgtatgtgtgcatgttggtacgagtgtgcatgttggtgtgtgcatgttggtgtgagtgtgcatgttggtgtgtgtgcatgttggtgtatgtgtgcatggtgtgtgtgcatgttggtgtgtgcgcatgttggtgtatgtgtgcatggtgtgtgtgcatgttggtgtgagtgtgcatgttggtgtgtgcatgttgtatgtgtgcatattggtgtatatgcgcatggtatgagtgtgtgcatgttggtgtgagtgtgcatgttggtgtgtgcatgttgcatgtgtgcatgttggtgtgtgcatgttgcatgtgtgcatgttggtgtatatgtgcatggtatgagtgcatgctggtgtgagtgtgcatggtgtgtgcatgttgtatgtgtgcatgttggtgtgtgcatgttgtatgtgtgcatattggtgtatatgtgcatgggataagtgtgcatgttggtgtgagtgtgcatgttggtgtatgtgtgcatattggtgtaaaggtgtgtgcatgttggtgtgagtgtgcatgttggcgtgagtgcacgttggtgtatgtgtgcatattggtgtaagggtgtgtgcatgttgatgtgagtgtgcatgttggtgtatgtgtgcatgttggtttgagtgtgcatgttggtgtgtgtgcattttggtgtgtatgtgtgcatgttgggtttattccaagtgtgggcagcatttcacacacagattagggctctcctccagttcttttcttttggagataacttgcacattatctggcttt

SEQ ID NO: 469162 - DNA, 685 bp, Homo sapiens
gagattgtaaggggtgagaagtgccaggttacgagaacaggtgccagccctttcatattttgtttggacttagaaaggaatgctaacagttgatgtaaagaaacaagtgaaaccagaaaataaaatgaaaaagaatcagagaagagggggagagaaagaagagaaagtaatgtccctgaaactgtgggaagattcagatgcccagtgtggtagaattggaccaagaacagcagaggagtggctggagagctccggaatccaagatgttagcattgtgaatctttcgagagctttccagagaacctaccataaaatacagctctatgggatctgccagagaacaaaggtgaggataaatgctaagtgcattgatgctaactatgcactcaaagattcagaaaatgaccacaagagggttcatggcccgtatatcagcaaagaccatgcagccaacagtacttacatagtctgggcattgtctttattctatcaaatatccatgggtctccttggagatgaactgggaaaattctaaccacaagctgtcagtctccacaatttctaattccagaatccattacaagatctacttcctagaaccatttcagctgccaactgtctcagtaggggtttccacagaagcgccccaaaacaaagacttggtgtgactagttgatgggatttt

SEQ ID NO: 469163 - DNA, 464 bp, Homo sapiens
aaggtttatcctagaaagcagctgctgccagggatggcgcaggggtggtgtggaagattcaagactgtcttttctcccctcttcagtgcatctttcaatgacatgaagttaaaaccaggccctctcctgcaggtctgctggagtttactggagatccactacagaccctgtttgcctgggtatcaccagcagagtctgcagaatagcaaagattgctgcctattccttcctctggaagctttgtcccagagggcacctgccagataccagccagagtgctcctatatgagttgtctacccctgctgggagatgtctcccagtcaagaggcacaggggtcagggacccatttgaggaggcagtctggcccttagcagagctcgagcactgtgctgggagatctgctgctctcttcagagctggcatgcaggaacatttaagtctgctgaagctgggttgacagcc

SEQ ID NO: 469164 - DNA, 1691 bp, Homo sapiens
taacaacccagctgccctatcaagatgcattcctgtaaacagttcttatgcaaatacgtttcagagagggtgcaggaaggctactggttgtcagtggtctcagtgctttcaggctacgcccttgtttacactaacaaggaatgttggggtgatcagacccaacaccaggtcgtgggggtgacaaagttgggcagagtcaaaggattgagaaaaagagagaaaaaagatgccagcacatgcaagcatgtgcactgtaccatgtcaccaccactggtgtgcacaaacactgtcacactgatatcctggtgtagctggcacatgcagtcaacatttggtgacacccgttatggccccgtgagtcctctgcccaaaatacactcaaatgtaaacttttgtccttgtatccatactgtagtgggggaggcctacatagcagagagagaacgtgaacattacatactccagggatcaagtagtgtagtgttgtcttttcaactaattacgtcatatcctaagtctgaattcattttatctgtttcactttgctttacactgtctgctttaaattgattcaagtcattcaatttgatctgtgaacctttttgctccccaattgttggcatagcttgcacgctagtttacttggaggctacttttgtgtcaaggtaattttccacatgacactttcttacttttggagcggtacattttaaatattttgatgcatttaagcaccaaaatattgcataaaatattttaagcatttgtagtgttttgtgtgaagaatcttaatatcacacagtgttagccagaacacagaaaaatgattataaatgtactaatgggcatgtaaatttacacacatactctttcatccgataatataacctttagtaattattctgcaataactttaaaatatacacaaatatatacgtttcaagttataccaaaatttcttatacaatgtaaatatacattaggaaataaagtaatagtttgaagcttttaaaatggatgctaatatagagcgctctcaataataaattgaattaaaaatgaaagatatcagagtaagcatgcttgtatgtgtacaaaaataaggtagagctacaccgaacatagaactttttctaaaatgtcatatgttagtgtatttatttgaatgtacatgtatacctgataaatatttggaagaacacacaagaaagctcagaatagttacctgtgaaaatgaaatagaggtctggaatggggaaaaaaatcagtattttatttttttttaattttttttcttatggagtgaatgtattattaatgtaattataataataatagattttatacataaagtagtagttataataagttcaaactctgaagttaggctactcctaattgtatcaatttgtgatgttgggctggttactaaacatcttagtgcctaagctcccttatctgtagaatgtaaatgacagtagttcctagttccataaaactgataggaaaagaaaaatatttaaaaagtgatattaatattttaaaaatctgatattaaatattgcattaaatacaatgttatataatcttattgttgttattttcttcaaagaaataggtctttataatgactcttccactgataaacattgacatttagaaagaaaaatgttaaaataaaaaaagaaata

SEQ ID NO: 469165 - DNA, 773 bp, Homo sapiens
gaagagcaaataggaagatcttgggcccgtgcctgaccaaatagatgagggctatccctaaacccttggggcaagaccgtccacgtaagttgggatgtgaggtctgtgggatcctcaaaggcaaagaggaactgggagtcagagtgcaggggaatacagaagaaggcatccttgaggtccagaaccgcataacaagaaaggcacgtgaaaagagcaaagtctcccaattacaactgaggaggtgggagaaatacctggttacaggctgtcccaggattccttggatggtaatagaccttgaggacagttgtccaggacaggagattaacactgagaagaccacaccagtgtccaggaggaagtcaatttcctggccctcaatagttaaacatacctggggctcacctggcactggtgctggcctggtgcctgctactccttgggccaacctgaagctgaagcatgcccagaagtatgaatcttcatttaaaaaatcaaaaatgaagaaaatatttgaccagacattttaccaaagaagacatatggatggcaaaaagcgcatgaaaagatggtaaacatcattagtcactaggagaatacaaattaaaaccccaactaattatcactacatatttattataatgtctaaaattaaaaagattttaccataccaagaagcggtaaagatgtagaaaaaccagaactcttctatgtagtttacggaaatgtaaacttgtaccaccactttggaaaatttagtagtctattaaaac

SEQ ID NO: 469166 - DNA, 3029 bp, Homo sapiens
ttctgcttcatggcttcagcagtctgacagccacaaagtctacaccataatttaggaaaatttaatgacgctcaataaagacataagggaaattcataaaagaggacattaccacaaaattcagtgtgaagttgatagtgacaggagacagacaaattcccaggcagacagagacagatccctggttaaacttgaccttcaagccaaggacagtatgaagcctgaaaaccaaactactagctctgaatggagtccatgcactggagacaagaacctggaacttgctgaactgtgggagcaaaaagagctgagagaagccactgggcaccactctctcctgctgagcaacaggagagaagaagtgaagccactagatgccactccaggtgatgtgctgcttcagcttaggcctagtgggcatggctgctctggagagagggcaacacttcagctcaagcacaaggggtgattaaaatagttactttaccattctcctaaccagtcaaatacttaaaagaagaataatagctatggctgctgggaggagaagggacaaacttttcattagcatatatatgattgtctggaagacttaagagaatcaagtgaaatatactaatgggagtaaatgtaaacacaaaagtttcgccgtttttctgtatatcaaaataaccagagagaagctcatttttgctgtgaacctaagactgccctaaataaactctattaaagtaaatatatatatacctggaagcatctatatgagttagataaggcaatcttttagattaattttagcaaatatttccatatgtatgaaataaagattgaattactgctgtagtataaagagctactcattgttagggtcagagttaaaccacatgttctgatgctgcattctgtttattttttatatataatttctgcaaatacatctgtagcaataaagtaaatgatattctaaaacaaagtatttgtcttattcatcacaccaacctaacaaaatctagttttcataaaatttgcacttcttgcaaattgtctgcagacagcacttgataatagtatctgaaaaggtaaaaacatttgataaatatattagaatcataactatttgattatgtttagtaataaatatattactactactctaaagataaatggaaaaaaagcatactttggagtcagctttccaaaaaataaataaattacagaaagtcctttcataagtcagaaatgttgaataaacttaaatgataatactaaataaccatacaaaataaatgtacaagcaattcataagttaaaaagaaaggaattccaattctaaagaaatatccatactgttttccagaaaggttttactaatttacattcccatcaacagtgtgtaagcattctcttttctctgcatccttgccaacacctgttattttttaactttttattaatagccattttaaatatctaagatgatatttcgttgtggttttaatttgcatttctctgatgattagtgatttttttaatgttagttggctgcttttatgtcttttaaaaatacctgatcatgtccttagcccactttttaatggggttacctgctttcttcccttgttgagttccttgtagattctggatattagtcttttgttggaggcataatttgcaaatattttttccattttgtaagttatcagtttactctattgaatgcttcttttgctgtgcacaagctttttcatttcaataatctctatttgtctatttttggttttgttgtgtttggtttagaatttggtcataaataattttcctaggccaatgtcctgaagagtttttttctaggttttcttctatgatgtttttagtttcaagtctatgtttaggtctttaatccaacataagttactttttgtatgtgatgagaggtatagtaatatttattttgtcaatctgggtgccttgatattgggtgcatacatatttaggattattacattatcttattgaattcatttctttgtcattatataatggcagtctcttttattactgtttttgatttaaagtttatttaatcttatataagtatatcctactcatttttgctatctgtttgcacggaatacctttatccaacctttcattttcagtttacatgtgtttttatgggtaagttttcatttcatgtatgttaagctgtgttattagtgcattcatatctaggattgttatttttaactgacctcaatattatgaaataacgtttcaaaaattctggtaatatcttgtgctttaaaatctactggttcaatattcatatgtcctgtccattcttctttcattagtgttaatataatataacttttccccctctgttttaacctactcatgcctttacatttattatgtgattttagtaacgagattttatttcaggcttatttcctaaaaacctaatctgacaatctttgccttttagttcatatctgcattttatttgtatttaatcttttacagatggttggatttgtacctatcatcttccattagtttttaatatatcccttttcctttttgtttctttttttttctttttctgtattttccattaactaaacatttttttagaattccattttatttctttgttggtttattagctataattcttattttattattgatttattctgagtttccagtatacatctttaaggtatcacaatctatcttcaataatattgtaccacttcaagtagagttcaagaacttaagtattcttctgattctcccctcactgtgggtttgttgttggtgttttatattgaactatttgtaactctacacaattacatttctggtgttcaacaaatagatcaaattgtttctttgatttctttgactgttcaattactatttgtccaagattttgttactcatatttcctcttccattcattcaccctttagttcctatgtcccttttcatattttatttatatttggatggtccatttgaac

SEQ ID NO: 469167 - DNA, 524 bp, Homo sapiens
taccctgcaaagccacagatgtgatggaaatagcaggagaactagaattagaagtggagcctgaatatgtgactgaattgttgcaatctcatgagaaaattgtaacagatcaggagtcgctacttatggatgagcaaataaagcagtttcttgagatgaaatccactcctggtgaagtcgctctgactgcaagactcagccaatcttctggctgctgctgtcctggatctctgggcccagcccatgccctcatcgcctaccctgacttctccctgtgtggggaaggggtgctcctagaatgtaagggaaatttagaagcagctagaattgtccttcttttcacttttgttgagattgatgccagaggcatgatggaatacaaatgtgtgctactccatctttattatgaagaaaacattatgaagagccttacctgatgatagtaataacaaccgtaaccactaagtagagtctatatttattaatagcaatgtcatcttctctaacagttgtccagtgtccca

SEQ ID NO: 469168 - DNA, 1076 bp, Homo sapiens
caaccagatgatccaacaacaggactgatggtgcctgggcaagcgccagctcatgtcatcaacctcactgagccccgggtatgtttaattattgagggccaggaaattgacttcctcctggacactggtgcggccttctcagtgttaatctcctgtcctggacgactgtcctcaaggtccattaccatccgaggaatcctgggacagcctgtaaccagacgcactaatgaggcagtaattccactatatccagttgtacccaacccttataccctgctctctcaaataccagaggaagcagaatggttcatggttctggacctcaaggatgccttcttctgtattcccctgcactctgattcccagtttctctttgcttttgaggatcccacagaacacacatcccaacttatgtggacggtcttgccccaagggtttagggatagccctcatctgtttgacattaaaacagttgagggggttccttggaattactggcttttgccaacatggatccccagatacagcaagatagccaggcccctctatactctaatcaaggaaacccagagggcaaatactcatctagtcaaatgcgaaccagaggcagaaacagccttcaaaaccttaaagcaggccctagtacaagctccagctttaagccttcccacaggacagaacttctctgtatacatcacagagagagctgggatagctcttggagtccttactcagactcaggggactaccccacaaccagtggcatacataagtaaggaaactgatgtagtagcaaaaggctggcatcactgtttaagggtagttgcagcagtggccatcttagtgtcagagtctatcaaaataatacaaggaaaggatctcactgtctggactactcatgatgtaaatgacatagtaggtgccaaaggaattttatggctatcagacaaccacctacttagataccaggcactactccttgaggatggtgcttcaaatatgaacgtgcatggccctcaaccctgccacttttctcccagaggatggggaactcatcgagcatgactgccaacaaa

SEQ ID NO: 469169 - DNA, 469 bp, Homo sapiens
aaggagccagttagacgacgataaacaacaaagggaaaagagatgctgcacgcacaggagaatggaatcttgtaccttgttgatgatgtgtatcactccatttgtggctgcgttgtccccatcgacaatggaggccccttcaattgtgatattctagacagctacactcagagactgccatgtgaacatgaagatgccatctacaacccaaggagagaggccaaagacaggcccttccctcaaagccttagaaggaaccaatcctgcccacatcttgatcttggacttctggccttcagaactatgaaagtcagcatgctcaagagagcacgctcagtctcttctttcacctatgctgggatggggggttcagagaggccccatacagaagcaacaggaagctgtcctggggtgggtgctgaccaggcatggactatttggcatgtgtctattttaaggggataaacca

SEQ ID NO: 469170 - DNA, 769 bp, Homo sapiens
tctggctttgtgctgatgctttcaggaaacaggtttatagcaaagtttctccttcctgctggcagttgaatgacagttgccttgaaaactaaatcagaccagaccaaagtcaaacactttaggaacccttaccttatcgctgttgaagatttcccccgactttccagtcaaggtgtagaacatgtctgtgttattcatatattcgatgttcatctgaccagcaattatgtggagtttcacaaagtattgagcagctttattatccaccaaaagctcatttacctaagagagaagagccaattttactattatttgaagaagaaaatgagttttgtaacacatgctgtgccttacttattatcaaagacatcaaagccagggcaccctaacttgggtttgggcttttgcaaatacaaatgcatgaaagcactgacaattatacttgctatacattaccatcagtgcaatcaacctgggccaggccttccagggagtagaaacctggagagttggaggcaatgcacaatctactctcaaaccaggggaggttgctttagcattgaaactgacatggggaaagcacagcatcgcaatggccccaggaggaacaaggaacaaggaatctatcttgaacatggaaagcagatgggaataaaatttgaagtttcatggaaagagtaggtaaagcaagtaagctgattgtacttttgaatagaaaagttaagatttttgaaatccatgggatcaaatctacttttgtcattactac

SEQ ID NO: 469171 - DNA, 819 bp, Homo sapiens
cacagtaagaagtcaccacctatgaatcaggcttcaccagatcctgaaactactggtaccttgattttggacttcccagcctccagaactaacctgaggcaagggtatattcacaagtatggtggagataatgctggcttatctgcacctgctatgaacagccacttttggccatatcctccataccctgggaatggtctcaggccctggaagctggtttggagctgtttgggcaggaaattgcaggcttctgagtaccccgagtgtggtctagtggggggcccaggctcttggggagcatgcccctttggacgttcagattccttgccctggagtagccagcagagggccagaatgggagcttctaacatgcagtgcccaggggaggggctcctgttgcccaggtctaagggtcaaactgctggaaacacatctggcagtggctgagctgggatttaaaactagatccatctgagaatgtctcttgccactgtaccatgttgccttggaaaggactcttgggaagactgtttacactgaggatatcccaacctgtacagatcttatataaacactgaatatcatcaatgtcactagcattccaagagtccctacacttcactgttgtttgtacttttgcacaactggaatgtaaactgtgcttattacaataggcccactcagccgtgtcctggctatttttcagctgagtttagttaaatgagagagaaatgctcatctcttctactgtcccttacttcctacatctattaataagtaaaagtaaaaaggcaaagcataaagttatttgttctcagt

SEQ ID NO: 469172 - DNA, 542 bp, Homo sapiens
agatttccagcaaatattgtcaaggcatctctgcaactttgctatccagtgactaacgccatgctttttccagtggtattcagatctcagcctggagggaagaaggttatacccatccctgaatgtgcagccttgctctgcccagaaaattccagatgttcgccttccactgaagatgaaaacaaactggaatgcaaatgccttcccaattaccgaggcgatggcaaatactgcgaccccatcaatccatgtttacgaaaaatctgccaccctcatgctcattgtacgtacctgggaccaaatcggcacagttgtacatgccaagaaggctaccgtggggatggccaagtgtgcttgcctgtggacccctgccaaattaactttggaaactgccctacaaagtctacagtgtgcaaatatgatgggcctggacaggagcaaggattgtagtaggtactcaataaatctttaattaattaaacactcaacaattatttcctttatatgaccattagaatactctggaatattgttgtggcctg

SEQ ID NO: 469173 - DNA, 588 bp, Homo sapiens
ggcgcaattgctgtcaacaaaaggaagctctatttgaacagaagcagggcaggctgccttgggaggccccaaggatgagtggaggcacccaccctgggggctggggcattttggcaggttgtgttgccccctaccctggggtgacttgtgccaatggcttgatctccagggatcccacagctccttatgaacctgctggtcctctgtggttgccaaagtcagagtatattctgcggtatatttgtgggggttgtggtgatgtggtgacacaagggctgaggttccttgaggagggcagtggcccaccatgggtgcataatcagtatggcatctgctgtctcagtgaagatcgaaaattgccactgacagcattgcctaggcctgcaagggcaaagaggctccctgacattttggctgtcagcagtttatcacagagccccactgagaattctgaggaagggcctatccccctgatgtgggcttgctgagtcatctgttgtttggataaatggattttcagaaagttcctgaaacaaacaatgcagtatttggattttcatcttcttggcaagaaatttctgaaatggt

SEQ ID NO: 469174 - DNA, 645 bp, Homo sapiens
agggtccaggtgatgtggcttccaggatataatgataaaaaaggaaaaggtctcctttgctctacacggcttcctaaaggaaaattgtcatattaaattatatatgtcaatgatggctgtgatgaaaatggcaacactagagttgcgcaatgtacacagtctggacaatttaacagctttatctttgagcaagaacaggtgggaagaagcaacaggaaaatatgacatgggaaagggcaatagggtgctggcgctaactggcactggatcgtcagagctgattgcccatcggcccacagggatgatccaggaagcattgccgtctcacaatcttgtgactttatcaacttcaaggacatgtcacctctgctccacttcagacatgcacaaccacagccacatcttggatcacaaagccaactttggaatagctgcatctttgaaatgtgattatgatgacaccttttctgcaggactgagtgaaaacagcagctgtaggaatggtaacagagtagacaaagggcattttcaggtgtttttggtgtgcaaagctgcacctctgtgatattgttggggttaagagagcactgggtatccatagccactagcagtacagtcttgggccagtcacttaccattttgggg

SEQ ID NO: 469175 - DNA, 2323 bp, Homo sapiens
acgtaacctcctcctcccattcattcgacaccccctcccttctttaccctattcaccgctgttacgcggctgcaggcatgcaagctttggcgcgccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcgtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaat

SEQ ID NO: 469176 - DNA, 673 bp, Homo sapiens
tgcaggccagacagtctctgtcatgactgttcaatttggctacatcctgaaagcagccacagacagcatgaggatgatgggcatggctgtgtgccagtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaagtgacccacggccccgcccggcgctgctccatcctctcttcctgcctcctctgtcctttcttacatgtac

SEQ ID NO: 469177 - DNA, 654 bp, Homo sapiens
agggtccaggtgatgtggcttccaggatataatgataaaaaaggaaaaggtctcctttgctctacacggcttcctaaaggaaaattgtcatattaaattatatatgtcaatgatggctgtgatgaaaatggcaacactagagttgcgcaatgtacacagtctggacaatttaacagctttatctttgagcaagaacaggtgggaagaagcaacaggaaaatatgacatgggaaagggcaatagggtgctggcgctaactggcactggatcgtcagagctgattgcccatcggcccacagggatgatccaggaagcattgccgtctcacaatcttgtgactttatcaacttcaaggacatgtcacctctgctccacttcagacatgcacaaccacagccacatcttggatcacaaagccaactttggaatagctgcatctttgaaatgtgattatgatgacaccttttctgcaggactgagccatggatattttgatagttgacttttctctcttgcatatgaatgataaaaagaaagtgatacattagtggaactgtcattttctgtgtggtcacagcaaatttaaaaaaatgcattttaatcataaaattagcctgattcatggtgtttctatctagaaattataaaaggatg

SEQ ID NO: 469178 - DNA, 514 bp, Homo sapiens
gggaagccttcagggatccaatggatatggtcagacagatactctggcagtgtctgcctggggcctctctacaagacctttcaaaggccagctacaaagtccattcattttcaaaggcatgcagccagaagctcaaagtctgctgcagaggtggagccctcatggagaacctctaccagggcaatacagaggggaaatgtggagttgtgcagcccccacacagagtccccactggagcaccacctagtggagctgtgagaagagggccaccatcctccagaccccagaacggcagatccattgacagtttgcactgtgcacctgttaatgctgcagatgttgtcaaggctggctgtcagtggcccacggacaaagaaggctatagcagggagagcctggaaggacctgccagaaggagcagggaccgactagaccatcccatctgagaaggtgtgaggtgatatctcatagcggctttgatttacatttcccagatgattaattatattgagca

SEQ ID NO: 469179 - DNA, 497 bp, Homo sapiens
tctgattggctgagctgcaatgcaggaaggaggagaacttagatggacacaaacaacagaggagatacttttcccaaaaccaaatcacctggctgcttctacagcagatgggattctgggcagttaaaagtaataaatggtattgagaaagagaaagaaaaatggctgctgagtaaggaaaaggcaagggaaggagaaaacagcagcacacagaggagacagggcattctgcaaagaaaaagaatgatggatcttcccagctgccttcagggaccatgcagtctgccaccttctggcttaatcccctacttaatcccttttgtccatcctgccccagactcactggtttccttgtcatcccctatcctaccagtgtctaattgcccttcttttggtaacagtgctctacttttcatcaatgaaatcacttatcccacttttagttcataagttttggggtgggagggaaacagtttcaatgcatggacttcagaatt

SEQ ID NO: 469180 - DNA, 550 bp, Homo sapiens
agagagcccaggaaggtgtatctgcagatcctagatcttggggatggttggttcaaatgttagtatgccagactcactcttgttcagccactctctggttctggtgtcaccagatgctgctactgagagactccttggctccaattgtcctgctctcctgggtgtccttctagccagaataaactctggctgtcctttggagacccagagtgtttcacctcgacccctgcccacgacctgcaacccttcttggaaagcaggaaacaagagggtgggtctccttgttgtcggaatactcctgggcaagctcctggatctgattgaggaaaggggtgctaccacctgcagattcctggcatcactaccaataggacccagaacaaatccccagccttcagcggataactgccaccaggtggcgccagcagcagtggacctggacagtttggactcctgcaaccctggctgttaaatcctcagtcacgtaactagcctggcactaaatgacctcacatttacacgattgaattttttggactttactttctgc

SEQ ID NO: 469181 - DNA, 3074 bp, Homo sapiens
agtgggtgcagcgcaccagcgtggcacatgtatacatatccccccacccaccgacaggccccggtgtatgatgttcctctccctgtgtccatgtgttctcattgttcagctccctcttatgagtgtgaacatgcggcttccaggggcagtgtttgatttacaacttgcagaggtagaatccacgcaagtaagaattacttggaagaaaccacgacaaccaaatggaattattaaccaataccgagtgaaagtgctagttccagagacaggaataattttggaaaatactttgctcactggaaataatgagctgtcggaaaacctcatgcaacaaatggaaatgccacacaggcagaagctggcccctcctaacccatttgaccttcttcctggagaaagtagcaccctagagtctctggccaagctgcatagacaatcagttattacagttgccaaagcagtaactacaaggaatcagtatattactgacattgcagctgaacagctgtcttatgttatcaggagacttgtacctttcactgagcacatgattagtgtatctgctttcaccatcatgggagaaggaccaccaacagttctcagtgttaggacacgtcagcaagaatatcccaatggaaaaataactcactatacgatttatgcaatggaattggatacaaacagagcattccagataactaccatagataacagctttctcataacagggttaaagaaatacacaaaatacaaaatgagagtggcagcctcaacccacgttggagaaagttctttgtctgaagaaaatgacatctttgtgagaacttcagaagatgaaccggaatcatcacctcaagatgtcgaagtaattgatgttaccgcagatgaaataaggttgaagtggtcaccacccgaaaagcccaatgggatcattattgcttatgaagtgctatataaaaatatagatactttatatatgaagaacacatcaacaacagacataatattaaggaacttaagacctcacaccctctataacatttctgtaaggtcttacaccagatttggtcatggcaatcaggtctctccatgttttaacctctaccaaagcatcttggctagggctgtctgtgttgccccagtttctaagtgggctgcctctgtggaatttctgttagctacctacgaattcacattccgtgcataactgtaacaatgaaccaaattttagtgttttccttttttacatgtaaaaagttgtattccattattctaagacattactgtgttattacacagcagctgagaaatgtcattctaaatgttttacctaaatggaaatataaagttggctgactattttgcagtaatgtttttattgcttattcaatgccaaatagcaaatgtatttatattttacactattacagcagagttacaagtagattctaaactattttcttatttacgtgctacattggcatttcctttgtaaaccattcaattttgaagactgagtgaacagagtttgatattattttactttttaatgacacaacagagattgaggaatgtagttttcatcatttgtgaggtcagtcattttaactgctttctcaatgttatgcttatcactttcccaacttcttggatgtgtgatttttttcccacctcttttttattgtctagggatctcttttactgtatatttattcaccctcaataaaatttttatttttattagaggatgacagttgaccaagatgtacttgaacagtaggtgagtcactgtgacataccccttgttcttctttctcatgaaatatttttttccattgaatcacagaaacagatgttctaataccaccatgcaaaatcttcctttatcatctcattttgaaagtaaacagtctcttgtgcttctggagaaaagcactgaacctaattcctttaccagaaagtttataataaaaattgtgtgcatttccatgttaactttttcttatatatgtttaataaaacacattattctataccctaactttacagctcctgattctccccctcaagacttctctgtaaaacagttgtctggtgtcacggtgaagttgtcatggcaaccacccctggagccaaatggaattatcctttattacacagtttatgtctggtaataattttttttttggaaatagttctgagaacagatattaatctgtaacataataggaatgtagcttttagatttcagaatgtggtgctacattaggaacctgattattaataggctagttaatatgttttgattaagaaacaagtttttccatattatgtagtggttcaatcatggtcaaatgaaataattttgcaattaaaacaaaaaattatgtgttacgcataattatactaaattcctactcttaaaagtcattgacaagtcaatttgtatgaatgtaagcatatacttttacacttctgaagttttacacaagtactctcatgtcattgtctttcaagtgtcccttgagcagagtaattttaataaacatttaaaatagctatttttaaagaaatctgttatttaaggtcaatttttaatttgaaatgtaaacaatgtatttcgtttctgatcactgttaccctgattgcctgtttatccttcaattgtgaaaaagatgaaatccaacattgtatctcatgttagttagcatgcttatactacttcatgagaacttggtagattgaaatctttactttgatgtaatgtaaatcctctttagattcaccaattaggtaacacattacctagtggatttcatatatttcaactcagaaaatacaatttacacaatacttcgtaaaacatagccatttccttttatatttctgaatttgaagggccagcattgagggagatgccatgatgttttaaagaagtctcctcttcttctctttcctaagttaagatttttctttccctaattcccctttaacccctttacatatttctctttaagactatattttttgttttctttgttgcctgattcctagtgactttgcctagtcgtgac

SEQ ID NO: 469182 - DNA, 803 bp, Homo sapiens
acttctgcagacttaaatgtccctgtctgacagctctgaagagagcagggcttctcccagcatggcgttagagctctgagaatggatagactgcttcctcaagtgggtggctgcccctctgggacaaagcttccagaggaaggatcaggcagtaatatttgctgttctgcagcctccgctggtgatacccaggcaaacagggtctggagtggaactcctgcaaactccaacagacctgcagctgaagatcctgttagaaggaaaactaacaaacagaaagaaacaacaagcatcaacattaacaaaaaggtcatctacaccaaaaccccatttgtaggtcaccaacatcaaagaccaaaggtagaaaaaactgcaaagatggagagaaaccagagaagaaaagctgaaaattctaaaaatcagagtgcctcttctcctccaaaggatcgcagctcctcgccagcaatggaacaaagctggatggagaatgaatttgacaagttgacagaagtagtcttcagaaggtcgataataacaaacttctccgagctaaaggaaaatgttcgaacccattgcaagaaagctacaaaccttgaaaaaagattagatgaatggctaactagaataaacagtgtagagaagaccttaaattacctgatggagctgaaaaccctggcacaaaaacttcacgacacatgcacaagtttcaatagccgatttgatcaagtggaagaaagggtattggtgattgaagatcaaatgaatgaaaggaagtgagatgagaagtttaaagaaaaaagagt

SEQ ID NO: 469183 - DNA, 577 bp, Homo sapiens
agaaattcattaagtggaaacttagccaaggtttctgtaaaccacagaaagaatacttaacgtggcgggaacctactatgggtgcaaaaaaacgacatctcctggaccatagattaacagtcaacacactaggaataaaaaggaaataccccaacaagataaaaggcatttatgagaaactcacatctaacatgattctcaatgcagaaagaataaaacttttctcattaagatcaggaaaaagagaaaaatttcattttgtacttttattcaatattgtactaatactcatggatattatattttctccttatttctctggtggtaggctctcctgcaggggtggctggcccaaagcagagctgccttttgggctaaagaaggaactactgtcacttaactcattggccaaaactggttatttggtttcactcaaccagaaggctatcagggagtacaactgtaccatgagttcagagtatttgatgaagagtgtcaacgactaataaacatttcctactttctatgaataatgtgctccttttactgttgctgataaactttataacattcccct

SEQ ID NO: 469184 - DNA, 599 bp, Homo sapiens
tcttctcggcttagcggctgaagactgacactgccggatcacctcggaagccccctagaccatcatggacgccgagcttcaggtaactctcacagtggaagatacctctactccctccttggcgaccgatcatgcaccccttaccatctcattaaaacctaatcacccttaccccactcaacaccaatatcccatcccacagcatgctttgaaaagattaaagcctgttatcactcacctgctacagcacggccttttaaaacctataaactctccttacaattcccccattttacctgtcctaaaaccagacaagccttccaagttagctcaggatctgcgccttatcgaccaaattgttttgcctatccaccctgtggtgcccaacccatacactcttttgtcctcaataccttcctccacaactcactattctgtgcttgatcttaaagatgcttttttcactattcccctgcacccctcgtcccagcctctctttgctttcacttagactgaccctgagacccattagactcagcaaattacctaggctgtactgccgcaaggcttcatagacagcccccattacttcagtcaag

SEQ ID NO: 469185 - DNA, 551 bp, Homo sapiens
agaaaggcactccctgacaaacaggaacacctgaaactggtgatcagcagcttctcgcatgcagatccaagagacaaaggaggacgttaaagagaagtatgcttaccgaccactaaactcattctgttgcaaggcagattttgtattatcccagtggaagaatgcccatggtttagcactaactttaaggcagacctcattggctttgggcttagcacgctacatgacaatggaaatggatacgacatttgcatttaataaagcgtttgctgaggaaattgagttgagtctgaaggttctgctggtgacagaaaggagattaatgtcaaacttcaaagaatcctatctggatatgttcagagggaatgatcactacactcagagtggaatgtttcagaagcttgaatttgcaatcaatgttcatttccaagggcaagctagggtttctcctatgtgtctgtgtttgtgaggaaagattctagtggatttctctctgtggcttactacctttggctggaagttactctctatttatttctgttccaaattgc

SEQ ID NO: 469186 - DNA, 731 bp, Homo sapiens
accatacgcgtgcttttctggctgctagtgaaggcgggaggagtttgacattttttattaaagtatgacttgggaaatgcaacattatgtggtcttgggaaatgcaacatttgggcaggaaaacaaaaatgcctgtcctcacctaggtccctgggcacaggcatggggttggaaccctcgccagggaccacacccttcccttcccagcacttccctgccccgctttggaggcttgagcagcttccaaagggtaaacattacacttagattctttaaagaaaattcttacttgtcatatatgtttaaaacactccatttgagagacaaatctgaaggagaaaaaaaatgttacaaaataccaaagtggtcagaaactttgagagaagagaagcggaaacagacacagagatacaaggaagaagaacatgtgaatgaagaagcagattttggaattgtgttgtcacaaaccatggaatacctggaatcaccaaaacctgcagaaggcaagtgaagattccctgcagccttcagatggagtgcggccctgcaaaccagacatatctcagagatattgcagattcagttccagaaaaccagaatgaaattttctatttgttgagccattttcaccatattttcctttacttctttgaataagatttccttttagtcttcagatatatttatgttagctgctttcgtgtctttttctgctaaactcaaaatcttga

SEQ ID NO: 469187 - DNA, 531 bp, Homo sapiens
gctggcaacagaaatcaagatggtgtttatttcatatggtgtctggaaaaagcgaatgctcatggaggccactatggtgaaaaagccaggggaaagtaattgtgtccatcccccccagaaaaccagtcttcttactggtttgacctgggcgctgactcactccctgccccatctccaccctcagaagtcagcctggcaaacacacgtggaaaaatctccactaactctactttttgaagcatgtgatatctggtcacagagagtcgagactttgcacacccttcaaagtgatgcatgtacagtggactttgttatttcaaaatctgtcactgtgtatcctcagccagaacttgggaaacatccttcatatgtatttccctgcactggccacagccatgttgtgattgaggggaaaatcccaaatgattccattaaatgttgctggtgtcagtagtgccaaaaacgcatgtatgacatgatacagtaggagttgtctatacagttaagtgactatcactcacccggtcttcc

SEQ ID NO: 469188 - DNA, 1862 bp, Homo sapiens
gcagcccaggaaactacactcgacccagtatgatgaaaagtagtagagactgtgatgaaaggagaaggcgttacatagcactagtcatcctctgtttccgggtaaacctgcgagtgcatctcctgtggccttttttcctgctgcctcagcctggattacacttacaggattattattactgctgttgctctgttgagcaggcccttatgaaaacctttctgctaaggatgtcaaagcaattctaccaaaggaaaaatccagccctgagaggctataaaccactttattccagtccacctagtaatgctacgagaagagcagagtgtcttcatcttcctctgtcagcctttaataaatcccagacgaggggtcagcagtccatgacagagatctcctgctactgctgtgtatggcatgtgtcaatcctagtcaaaacccctagtcagagctctctcctccttaaaccaaatatttgtggaaaagtttaaaaatggcaaaatgctgtataaatgctatacatttccctctatctcatgttctaactgcattccacggttttgtggtaactagcttgtaaaaatattaaaaaggaaaaggaaaaaagaaggcctgatttgtagcatgccaatttcatatttgtcttgtaaatactccaccatgaccaatttcaagctacaaatggtttaacaaccagttggaaaattttctgaatatttaacatttaatattgcaagctgatacaaaccagctctagcacactcaaattttcagtagtattttcatgattccttaattcaaaataggtcctaataaacactatactttgttatctgtccacatgtctttaattattaagaagtgtgttcaaatttgccattttatgggaatattctaattgttaatttcttaattgcttttattagaaatcatgcttgatacaatttcaatccagtaaaatttattgagattgactcaaagtccagaaataatagatttttataaatattatttgtgtgcctgaaagaaatgttttctgtaattttttggtacaatgttctatatccattcaataggtcagatttttaatctggtttaaatcttctgtgtcattattctttttctgcaagatgtatctatgacagaagtatattaaaatctcctattctgtgctcacttctgcagcacatatactaaaattggaacaacacagagaagattagcatggcccttgcacaaagatgacatgcaagttcgtaaagcatttcatagaataaaaatcttctattatgcttttttcctcatgcaattctttgtttatttggttttcggggacagcataccttgttcaattctgtaaatttttctcatatattacaaagctttattttgtgttcttacatatcaaagttgtaataattgtgttaattaaaacattttcattgtgaatttatacttctctaataatgtttagagtgtattttgttttatattagtgtattcttctaagatgtctactgattactatttgccggctgtattttttccatccttttatatgtcacctttttgtatccttacattttagacacgtctcttgaaaatattatacacaggaatgtatgcgtgcgtatttataactgcatatatacaaaaatatgagtatttatacaatatagtactctcatgttaatttatttttatatgatgtcatgtgtatatgtatttactacagcttgaaaatctttgtgttttctggagaacttaatccatttaaaatttttaaatttctaatatttgggggttaaaattttattttgtttttatatttgccttgcttcttttattaccttcttttgggtttg

SEQ ID NO: 469189 - DNA, 625 bp, Homo sapiens
tgttagttgagctactgttcatcagctgaccctgaaattgctctaattgaagtttgatagataatgttaggattcacctggttcataaaggataagagacatttgaagaggacccaagtacaacctgagcttgtaagcaaaccttacgagctagatgagctaaatcccagtcaacgtgcaaaaacaggatatagcttcaaatgtggcagcattgggaaggcactgtttctgggtgagaagaagacaacctggaaaggaaggactctgtaccacttatcagcttattgtctcccagctctgaatccaccctttcctatgcagctttgtaatactgaagccagaccctatagacgtttctcctttgccagctggcacacaaggctttatcaacagagggcttgtgaggataaaggtgcttttccaagttctttgtttctttgctgccactttccctcagcccagaagtagtagctgggtttttttttgaacatactacttttcgatctctgagagtcctgtttaatctttttaaatcttcaactattactagttaagaattctttatattaggctttccatttctaatcactgttgcattctttagttttctgactggaccctgacc

SEQ ID NO: 469190 - DNA, 444 bp, Homo sapiens
gattcccttggctgttctagcttgtgtccctcccctggaataaacgtgacaatgagtataattgatttcaagtgtgataagttcctaaagaaattaaaacagaatgtcatgaaagagaatgacagaggtgggactgtgtggactgggttgttggggccccgagctgaatcttcaatgacagagaaggataaaagctcagaggaagaccaggaagagaggaatgtccatggtcactctaggcagatgagggtagaaatcttggagacacctgaaaaccacagaaccaaggaaaaggcaaagcccagattaaaggtagtgtctgaagtgggtgctggtgatggagattgggaagggaggagaggattcattgaaccagtggactggagtcccacccttacagctgtggctgcagctgccagagactgactgccaattaccattaaa

SEQ ID NO: 469191 - DNA, 590 bp, Homo sapiens
atctgggactggataatttataatgaaaagaagtttaattggctcactgttctgcaggttgtacaggcttctgcttctggggagacctcaggaagcttacgatcatggcagaaggcaaagggaaagcaggcacatcttcatatggctggcaggaaatagagagtggggtggggagctgggggagaggtgctatacaccattaaacaagcagaacttgggagaagtctatcacaagaacaacaagagagaagtcctcctccatgatccaaccacctcccacaagccctttcctccaacactgaggattaattacaagatttggctgatgatctcctatcacacttcactgagaaatgggaatgattggaggagaactcccttttctcccaaccacctggtctacacatgaacctgtgtgtacccagtgtacccattttctcttttcctcctcttagtatggaaaaaaattcccttccttcctgtttatattataagaaagcaaaactggctttcctccactctgcctttctcaaggacttttcttcctcattactccctttttctcctgcatcgtcagtccctccctcttt

SEQ ID NO: 469192 - DNA, 559 bp, Homo sapiens
gtgttctctaaaccattgataagcaaaatgaagcctgaggactttgtccagtttacccatctagaaagatgccaatgccagcattctagtcctaaatccttactggttcttcaacaaaggccagatgccatcgaggacaggaaagaggaccacacaccgaagcccacagatctttctgctggggagttgttggcaaaagcattccacttccctgtttgtaaagtgggcaaatataatactgtgaaatgccacaatggcaagtgggagccaatgaagggtttggagcagcacagtggtcaggcagaccaagctgactcccagctgtttccccttcacagtggcctgggaggggctgctggctctgcagagtttgatatttcctcaggagactttcagtgttacactgaatacaaatgcaagagtgggcatccttgccttattccttagaaattccttagatggaaatttttttttaactataaaatatgatgttttctgtgggtttttcgtatgtagcctttactatattgaggcaatttccttctactgctagtttttc

SEQ ID NO: 469193 - DNA, 897 bp, Homo sapiens
aggacaataagacaagaaaagaaagcatgaagattgagaaggagccagaaagcgggccatgggttccaaccagcttggcgttttctcagctatggcacgatgcacttggacttcatttgtgatcggcccctcattgagcatgaaagctggttacctttttcctgccagaaaatctggctttctcatttgccagtgggaaacattaataccattcagcagaatcatgcttccctgtacttctggcctccttgaagtaaggcaaggcatggacacaccttgctctggccaatggcacatgagcagaagtgaactgtgtctccagacctctttctcctatggtggagcctgtgccaatgatgtacctgccaatatgatgtggatggatgtgtatgggggatttcatcatgaactccacatacaagccaatttcacagccatagaaatttccaaaattagtattgaggcagttgaccacagctctatgctaatttctgaggctattaattgtgtttgtgaaatataaatgcatgagcaatgactgtggatattgcttaagaatctaaacactttattgaagaaataagtgagacaaaataggtgtgataagagtacaaaatatgtaccatattgcatcaaatctagcatactataaattttaagacatatatcgtattccatggaccacaaaagatgctgccaattaaattatgacttaatgtattatcatattgaatttttaaaagacttttaaaggaggtcttttagcttattcaaacataactgccctttattactcatctgcataaattaaaaagaaaatgtaagccaaataaattggttaaggagttcctaaaactgctacaaatcaataatttgatctttttgaattgttttcaa

SEQ ID NO: 469194 - DNA, 766 bp, Homo sapiens
catcaatcagtatgcctcacagagaggtggaaaatgctgatgaatctgggaagctgcttaagtatagattggttaagagatgttttatggtaattaatggtatgagagcagataacaggaagattgagctaggctacaggaataacatgtacaaagggcccgtggaagggtggagactcggcatattcagagacctaaaagaaggacctcctgcccacctgcttagcagtgccctttttcctgaagaagaagctgagctctctctcttccatcacccacttgccaccccagtcaccaaagcctctcccttgaaacgacctgcccccccagccctgtatcaccagccctatgcttcattaagggagcacaatgtgtccccgtggtcgcctgccagccgggatgtcctgtgtgacagcagatgcaaagagaatgaacaggcggctgaaaaggctggagacaaaaagagcacattgtccagagctctgaaagggctgcctgagaggggacatatgcatctgaaaaaaataccccagggatggggccaaaacccaacctggaaagtgattgtgtcatacccataagaatcccagggcttggttggatttctgaggctgggggtccaagaaatgggagaggaaggaaaagctagcttgcaaatgagctgttattttgtgaaagatgacttcatagtttagcaaaaggggttcacaggtcaaatataagactctaagttctctgctctgctttgtgaacttgggcaattcac

SEQ ID NO: 469195 - DNA, 2066 bp, Homo sapiens
acgtgccagccaccatgtcgaagggacctgcagttggtattgatccctgcaccagctactatgtcgcctctacggacactgaacgaatgactggtgatgccgcaaagaatcaagttgcaatgaaccccaccaacatggtttttgatgccaaacgtctgattgcacacagatttgatgatgctgttgtccagtctgagatgaagcattggcccttcatggtggtgaatgatgctggcaggcccaaggtccaagtggaatacaagggagagagcaaaagcttctatccagagaaggtatcctctatggttctgacaaatatgaaggaaattgcagaagcctaccttgggaagactgttacccatgctgtggtcgcagtgccagcttactttaatgactctcagcgtcaggctaccaaagatgctggaactattgttggtctcaatgtacttagaattattaatgagccaactgctgctgcttatggcttagacaaaagccagcctggtgtgctggttcaggtttatgaaggccatattgagatcgattgtctctatgaaggaatcaacttctgtacctccattacccatgcccgatttgaagaactgaatgctgacctgttccgtggcaccctggaccccgtagagaaagcccttcgagatgccaaatttgacaagtcacagattcatgatattgtcctggctggtggttctactcgtatccccaagattcagaagcttctccaagacttcttcaatgggaaagaactgaataagggcatcaacgctgatgaagctgttgcatatggtatagctgtccaggcagccattctgtctggagacaatcacatgaccgtcctcatcaagtataatactaccattcttaccaagcagacacagatcctcactacctattctgacagccagcctggtgtgcttattcaggcttatgaaggtaagcatgccatgaccaaggataacaacctgcttggcaagtttgaactcatgggcatacctcctgcaccccgaggtgttcctcagactgaagtcacttttgacagtgatgccaatggcatcctcaatgtctctgctgtggacaagagtacaggaaaagagaacaagattactatcactaatgacaagggctgtttgagcaaggaagacattgaacgtatggtccaggaagctgagaagtacaaagctgaagatgaaaagcagagggacaaagtgtcatccaagaattcacttgagtcctatgcattcaacatgaaagcaactgtcgaagatgagaaacttcaaggcaagattaacgatgaggacaaagagaagattctggacaagtgtaatgaaattatcatctggctcaatgagaatgagactgccaagaaggaagaatttgaacatcagcagaaagagctggagaaagtctgcaaccccatcatcaccaagctgtaccagagtgcaggaggcatgccgggacgaatgcctgggggattccctggtggtggagctcctccctctggtggtgcttcctcagggcccaccattgaagaggttgattaagccgacccaagtatagatgtagcattgttccacacatataaaacattgaaggatctaaatttgtagcaaattctgtggcagtttaaaaaagttcagctgctatagtaagttatggggcattctcaatacttgaatatggaatataagcacaggggaaggaaataacattgcgcttcataaacactgtattgtaagtggaaaattcaatgtcttaaatacaactatttaaaattggcaccataaaaatattcgaattaatagtgcaagaatgtttcttctcaccactccaatttgtcattatactgtaaatcctagctagtacattaagaaaagaaaaggaaataaagggtatagaaattgagaagaaagaaagaaaactttatttgcagattacatgattgtctatgtagaaaattaaaaaaattcacatacacaaaaacttgatctaataaatgattatacgaggttgcaggatacaaggttaatatacaagtcagttgctttcct

SEQ ID NO: 469196 - DNA, 2282 bp, Homo sapiens
ggtcaagggtgggttgggagatcatcccggtcaagggtgggttgggagatcatcccggtcaagggtgggttgggagatcatcccggtcaagggtgggttgggagatcatcccggtcaagggtgggtgggagatcatcccagtcaagggagggttgggagatcatccaggtcaagggtgggtgggagatcatccaggtcaaggctgacccacggggaaaaaattcactgttacccagttaggtcccacctcagtggaccacatggtgcctctggcaggccgtgcctatggctagtgacgtaatttccaagctaccaggaggctgctgtgcagcaggtacctccagccatcctcctagcaacagcctgcaccatgccaccacccagcagacagctgctgctgccagttccagaaactagagagatccatgaccaaagtgaggctccagaatgtctctgtcaagacaatggagatactgatggtcacagggccagagggcaccaaaagcataggagcaaatgtttgatgccagttgaaggagcagtaaatccaagagacactgagaaagacagaccgtgtgcaggagaagctgtggtttatgggcagagaggagattataaaggaatatttggaaatgaaggaaaggaaactgctcttggaaaccctgaaatgaacacacaatgcatcagagccaagcctgcaatcactcaagaaagaatgattctcgaggcatcgagtcccccctggaagttaattgaaaggctgtctacagaaaagatggtcagtcctaagggagagcagttccattctgatgtccacagctggctggtagggtgagtcagcatcccccccagcagtcccattcaccctgggccactgctgggacccagcatttgaacagtaggacagagggctgcaggctggcctaagtcacaccacagtgagctggtcttcccaggaagctcccagccttcccgttctatggcactgtcagactgtacctctttatttcaaaacacatcagaatacatcaaagccctgactgttaggtaagtattactatgcccacttttataagcaaggaaatagagattgcaaaggggtaattaacttgcccaaaggcgcttaacttcataaaccagcctggattccgcacctattctgactctaaagcctgtgttctttcccttgacttcatgcggcccctgccttcaaggactttcctctccagtgtatctttaagtaagaaagcgtgtgtgggagactctttggccactcagctttccttttatgtaaaacgcctgtttgtgtcttttgctcacttttctattaagttgtgtttttcttactgattagatgaattctttatacatgctgaataccaatacatttctcagtctgtacctttttgttcctttaatggcgacttgatgaccagaagttcttcattttaacatgatcaaaattatcaatccattctcttctgttattttacatattgtgctctgtttataaaatcctgccatatcttaaattcataaagatccttgccagcgttttctgctaaaaggtctaaagtttggacttttatatttaaattttaattcatcttaagtttttaaaaattacatatactgtgtgaggtatagatgcaatttcacatggaaaaccagctgtcccagcaccatgtatcgaataatctatattttccccactgatcttcagtggccattctgtattatattatatcaagtttctaaatatgtatgaattggtttctgaactgtatcttgtcccattgatctgtttgttcttttatcattaccaactgtcttaactaccatagcttttgaataagtcttgatgttgagtaggataatctcctcaccttgacttctttaggagtttctcagctattcctggtcttttgtgcttcaattaaattttgaaatcagactgccacatggtaccaaaaccaaaaaacaacccaactgctggtatttttgttacaatttaactgaacctaaaaaaaaatcaaaatcagaagaatttgcagttgttcatgattacctttgctggcagttttcaattgcatgcatatttttaaaaaagcatttttcagctttgttaattctattttattttttgctcctatttcagtaaatctcctctttattaattcatcccttctatttttaaaaagattattcttttgcttattctaatttcttaatttggatgtttaccttgctgctattcagacattcttctttcctaatatatt

SEQ ID NO: 469197 - DNA, 1634 bp, Homo sapiens
ccaaacagaggagcagggaaagggggcagggaaggaaggaagtttaataaaaagtagtttgtcccgtgtgcttgcttttggttgtgtatatggctgcccctaagaggaagggaagaggggaaaaagaaaagtgtcagttttgctccagccaagcagctgggccctcagccagtgccttccctccagctgcctgatgtaggatgatctaaataagaaatgtgggggtgggggtagtgtcttccagggactcccttcactagcctcctgggttaaaaagcacactggggaatctctgcctttggctggggcagcgcctctggccagtttgggcaacaccctccgccatcatgactaccgtctctgctgccctgaaggggacgcatgtttccagatcatccagaaaggtcacagtttacaaaggctacatccgaaattgccctgtgacttggctggctgtctggactcctgggccttcggtcaatagtgcattgtcatcacaagtttcccacgcaagagttcttgctgtccagctcaattcctctggctgctatcacagtccctggaaactgggacgccagaattctcttgcgagagactcccgagcctgctacatttctggatccattttcctgacaattgttgcctttgtgcgcacccttaggtccagggaaggggcagcgggaagagaagatgggaaagcaagagacctccactggtcctgttttacaggcaggcctggttaccaggagatagactcttaatagagatctaaataccagattcagacagatgcatatcaaaattctaccttgataactgatgcagacatattagatgccacaatttaaatcatgccacataagcttactaataactgactgagaactgaattgactcattcgggctacagaccttcctagcagatgttagaatctgctctgaaatgctactgcttgctaattgtcagggcaacacatcatccgttaaacttaccccctttcgggtacagcgttagtgaggttggggcttccctttctggtttatacatatttctgttaagggcaaagcttggccttagaaatggggtaatttggcctatgatgggagttttcaatttagtgatgctgtagaacaaaggtggaaggatgacaatgtttatgcaatgacctcttccatctcactcttgtgaaaggttgtgtagcttctgggagacagtcccatgagaccacagcccagagagcttcactgggaatatggaaggtgctgcctccatatccccccaggtgacgaatgcatggcaagcctccttgacaaggttgtcaaaaaggttccttcctatgaacacatttctttgaattgaaaaaggaaggcaggctctttctgacagaagttaagtctaacttggctgcttggctatccattaaatatttttcacaaattgagtgaaacaaatttgtaccactaaggattttatgaaatatatatttaaagcaattgataaaagcatgttaatacaaagatataattaaaattaatgaatatttctattttccctaaacctttctgagaacatctggttaaacaagctgcctttaagtgaaagagtgacaggtataattaaaagccatttaata

SEQ ID NO: 469198 - DNA, 755 bp, Homo sapiens
gttttcttccccatttcctcctcatggcagcaacggaaacctgaatctcagagctgccatgggaccagggggccaacagaccagaggcaccatcctcagagcccccggtctgcctgggactgggagcatggctgtggcgcccaatgagaacatagtgtccatagtgaccatgattcttcaagtggtgtctgaatttcccacattagctaaattcctttgggagcttcagggtttccagtcttccagggtttttggcttaaatgcaagtacctcttggaagaatggcacatgcccccataccctcagggtaatgggacaaggagaagatggagtagggggtgaggctcagaaaggcaagggaaagtggctctatctctctccaagtcacttctcaaactgtgcagggtttgcaggaaagaatcacaccatgtctgtctcagacttctacttctattctcctatttgcccattgttcctttcaatttagttttggtccacgaacggcaatactaatgctatgtaacgagatagaaaaacttggattctccagaatttctcttaggagggaaattgtactttaataaatagatataggtggtacaagtgcacttgtgttacatggatatattgcatagtggaaagtctgggcttttagtgtagccatcacccaaattgcgtacgttgtacccaatgggtaatttttcctccgtcaccccctcccaccctcccaccttttgcagcctccagtgtctgtt

SEQ ID NO: 469199 - DNA, 512 bp, Homo sapiens
gggggaagcccctcatcttctgagcctcagtgtcctgggatggaagatgaaggggttggcaaggtcattgctatgggttctcatgcaacaaacattctgtgactcactttccatagttgatgttcacgaaagagagcacactagtgccaggcacaaggtgggcacacagtatacacgggtcaaatggaggaacagacaaggaggacatgggtttgaaatcattcacgcgcatgcttttatctgtcttcttaagcctaatggccacatctgtggaaagggaggggaaatagtgaatgacacccatggtcctggtgtctttagcatgatgctccaacacctgggccaactgtggctccagattaacctctgctgcaaaaggagtcttgggcccggaaatgtgaagtgacggagaatggtagcggtttcaaatcttttgataggccctttataaaagtcttagaggtcctttggcattggttcttaaccttaagtgtgcatttgaagtatatata

SEQ ID NO: 469200 - DNA, 4446 bp, Homo sapiens
tccccaatgttagaggtgtttgggtcatagaggtggatccctgagaaatcgcttggttctgttctcgcgatactgagtgagttctcactcactagctcccgcccgagctggttgtttaaaacagccgggcaatccccaccgcccctcactcattgttgcctctctcaccacgtgatgtctgcacacgccaacaccccgtccccttccgccatgagtggaagcagcctgaagctctcaccagaagcggtgttggtgccaaacttcttgcacggcctgcagaacggtgagccaaataaatccttttttctttataaattatccagcctcaggtattcctttcctgcaacacaaatggacgaagacgatcccctatacttcactttcttcatgccgccccctggagcatggactggggagcaagctctctcggcctctatggataaggacaaatcaaaaactgttgaagcaacaggaaagggaagacacaagtctttggatagtctgatggagcagagacgttttagcggcctgggtcatctgcctgtggacacttctacctcatttgggtgcggctgtcgtgaaacagaatctatattttaaccatgttgtgcttttagaataacattgcgcatatcacgaaacacctgtaaaatatagactctgaaaatattagtatttttaaatcagcttttaattttagaataagtgtcggctgcagctgaaatatgacggcacatttcctctcatcaaaactttgagtcgtatactcttataccacctggaaacccacctacccagtgcccctcaccaatggctctgcaactccccatagatttctgcccaattgctattttttgcacctgctgagtttgtcttttttgtatgtgtcataatgtacactttaacgacttatttctcctgttaatctagaagctggaaaaaactgggacctttgggcttcttcttgtaaactccatgttaatgacttattagcgtcttggcaaaaatacctaatgacttctaactaacctcctactgacaactatctcagggtttaagttctgactctgctagtttctagctatgcaatctttggcaattgacttaacttccctgtagaagtggtacctttgcttggcaaaggagggttttagtccccatgactgccatagccacccccaaacatgcaatgtgtagagtaaaatcaacacagagcaaaaatcagcttcgggacaaaacttcctggtatccctgcaaccaaattataatccataaatccctgtcataggttaacattctacagctgccactgctcccttcctctaaatttcctcatctggaaaaggggggaaataatatattgtagggtttttaaattgatatctaatattttacatatttatagggtacatgtgatattctgttgcatgcagagaatgtgtaatgatcaagttaggatatttgtggtatacatcaccttgagtatttttcatttctatatgttgggaacatttaaattctctcttctagctacttcgaaatagacaatacattgttgctaactatggtgaccctactctgttgtcaaacattaaaacttattccttttatctaactgttaagtttgtacccattcaccaacctctcttctttccccaactcttgccatccacacacccttcccagcccctggtaaacatcattctactttctacttccatgagattaactattttagctctcccacttatgagtgagaacacactaaacttgtctttctatgtctggcttacttcactaaacacaacgacctccagttgcatccatgtttttggaaatgacatgatttcattctttttttatgaccaaatagtattccgttgtgtatttataccacatttcctttatctattccaagtgtccgtcccttggtggacacttaggttgattccatgtaattgctattgtgaatagtgctgcaaaaaacatgttttctctttactctgctgattgtttcctttggtgtgaagaagttttctggtttaatatagtcccatctgtctatttttggttttgttgcctatgcttttgaggtctcagccataaaatatttgcctagaccaatattctaaagtgttttccctatgttttcttccagtatttttatagtttcaagtcttatgcttaagtctttaatccatcttgaattgatttttgtatatggtgagataagggctcaatttcacttttctgcatgtgcatgtccaattttctcaatactatttattgagcccatccatgagcatgggatgtcttttcaatttgtgtcctcttcaatttctttcatcagtgctttgtagttttccttgtagagctcttttacatccttagttaaatttattcctagatatcttaataactgttgtaaatgaaattgccttcttgatttctttcttaattattggtttatagaaatgctactgatttttgtatgttaattttgtttcctgaaactttactgaatttatcagatctaagagttttttggtagaatctttagattttttatatataagatagagccatcataaaagagggacaatttgacttctttttcaatttagatgccttttatttctttctcttgcctaattgctctggctaggactgccagtactatgttgaataggagtgttgaaagtgggcatctttatcttttttcagttcttagaggaaaggctttcagcttttccccattcagtatgatgttagttgtgggtttgtcacacatggcctttattatgttgagatgatctatttgaagttgtattatctactcgctatattggtttctctccatggaaaagatcctgttttccctacgaggcaagcaggatgcttaagatgaaccctttttgaccaaaggagaaatggagactagagaggatgagatgactcacgactgtttactgggtgtggaacccacgggaccttccctgtgccataccgtcaccagcatcacacactcacaccgtcaccggcgtcacacacacacaccgtcaccggcgtcacacatacacaccgtcaccggcgtcacacacacacaccgtcaccggcgtcacacactcacaccgtcaccggcgtcacacacacacaccgtcaccggcgtcacacacacacaccgtcaccggcgtcacacacaccgtcaccggcgtcacacacacacaccgtcaccggcgtcacacactcacaccgtcaccggcgtcacacactcacaccgtcaccggtgtcacacacacacaccgtcaccggcgacacacacacacaccgtcaccggcgtcacacacattccatacccgcctggaggtgccacagcatactcccaaaagccactgcagaaacatctttgcacttttcagtttcccctaacattgaagaacctggaggtgccccacttagcgagtgcacagggcagccgaggggatgcagttcccttctgggcagcctctccaggtctgggcacagaacctgcccctgcttctcttccaaagaatgaagcccctcccaagcctgctggactcatatgctttgtgatcaattccgtgtcctgcaagtgtttttctttattgacatgaaaacctcatgaaaacatgctttgtctgcattttcccgtagaggtgataggaagcttcaaagggtaaaggaagttagaaaagactgggaagggtgaggacagatgagaaaaaggtgtgcagcctgatgtgtgggcaaggacagatgtttccactgtgctgagcaatgcctgcctgtacagtgcctttatgtgttgttgatttttgccatgagccttcaggcttctccttgtagccctgacaagggaaatcccataatgaaggatttcacggagctccacgggctggtggaggcttttctttccatctgtcattttactttaagccttgacctttctgttcccatgtgaggcagtaccaggaaggggcttgggctggagagcaaacgtctgggtttggaccccagattgggctgtcagtgaagcagagaagataacctagggtttcgacaaccttaaaataagtcaaggaagacagcgcacatcccagggggtacgatgggggggcaaagatgggtggtgaagagtttaaataaaggagagccccttggtttagaaggaggtcctacatggaagtaggaaggcagagtagtctaggcgcccccctctctggccacccctggccactcagggatcccatttttactgaagaaagcagaggcttcagagtccaaaatatctgggtttgaatattggccctactacttgctggaaagttggagccacgtggcaaacaaccttgctaagcaaccttgggcaagctgcttattttctctgactctcagtttcctcatgtgaaagttagaggtctcaac

SEQ ID NO: 469201 - DNA, 830 bp, Homo sapiens
agatgttattgttaattccagtgtatagataaggaaactgactaatgcagatgctggaactccagggccccagggaatgcatcaagaagggaaagtgggaaccagagccgcagccggtgctggcattggtgctggaactgaggctgggaccgctgccggggctggggctggcgtggctggaggagcacttgctggtaccgccggtgtggccatcttgtggagaaagaaagcctgggaggaccatggcagtgatgttcacacctctgacagtgaaatatgtatactgtgacactgaacgcattggagttgacctgatcgtgaagacctgctttagccccaacagagtgattggactctcaggtgacttgcagcaagtaggaggggcatccgctcgcatccgggatgccttgagcagagtgttgcaatatgcagaggatgtactctctggaaaggtgtcggttggccgcttcctggtgaacctggttaaccaagtacccaaaatagttcccgatgacttcgagatcatgctcaacgggctaaaaggcatccgaattcacaatagagtggaggagaaagtcataaacatcatcagtgaccttggggccagttgtagaaaccaggaaatggtggagcagaaggaccaggagaatccaatgaacaagagtaagacttggtacaaaaatagtgaatttattccgaagtgagcttggggaaggggcacaaaacttcttgcctttaaatgtgctgcttcacctctggagcagataacagacacttttacaagaaaaaaatgggggcactcagttcaaatgtccctggtgatgtatgtt

SEQ ID NO: 469202 - DNA, 621 bp, Homo sapiens
gaaaagtaaggatcagacacaccgagccccctgttcactctagcatcccttcggaagggacaaagatcaatcagagtagaggcctgagtttgtaacttacccacagaccacagcatgttgggatggaagaaacctaatgtttccattattcctgatttaacgattgggttttccgtctctgtatctatcccattcccacctcataaaaccgtgaatgccatgggatgggaacctcacctcttcaagataattctcaatttatatgttattaaatgcttgctctttgcaaagcgcaaggcttggaatacgtacagggtggaggagactgcaagaatcagtaaaaaccaagcctctccctgcccctgcagcctgcaccaacacttctctgatagctggcagatgctgatgagtgaaaagagagtcatacagagccagggttgggtaccccggacttcagagggacatgacttaggggatccagagagcttcttggagaagttttttatagaaacaaacgcatgaagatgtaaaagtcttcagtctttaagctagggctacaattccagtcttctgattacaaatctatgggatctccgctatggcataccgtctgtcttggac

SEQ ID NO: 469203 - DNA, 689 bp, Homo sapiens
cacttccttaagtcattagtacatggatactcctgtcaggtgttgagcatcatactaggcaaaatatggaacataaggagagggacaatatggccgctttggctcaggacaacatggcatccatgctacagggactttttaaaaggaagaatgcccagtcatgcttgatatccttcatgggtcggcagattaagccccctttggggacccttcactgcatagtcatgcaagtctccccagtctttctaagcataagcattgacaaggcagggcttgttccatcttcatccttttctccttcctcagcctcatccagagagctgacatcacctttctcagcaacagacaatctccaccaacgagaaagtcattttttgtgtctgtctttaattaattcactcattaatagagatatattgatggtccacatgtgtagagcagttgccccttgttcagctcaccccacaggacagagattattcccaatcatctcccatgggcaaagagtccagccctaccctgtgaggaaggcatgagagggaactgcccaggtgggtgctagaagggtttgaaagtggttattaatggaggacagagcagtgatcacatgggagaggaactaaatgtgctgaggctgctgaaattgaaaacgcctgttaatagcacaagtgacacatcatagatcactc

SEQ ID NO: 469204 - DNA, 1153 bp, Homo sapiens
acactgttggtgggtgttattcacaatagcaaagacatggaatcaacctaaatgccagtcaatgatagattggataaagaaaatgtggaacatagagcaggacgtgtggcttctgagcgagaacatttgtagtgccagtgacgaaagagagaatttgagagatattgagatgttgagaaagagagatgttgagaaaggcaagaagatttttgttcagaagtgtgcccagtgccacaccatggaaaatggaggcaagcacaagactgggcctaatctccatggtctcttcaggtggaagataggtcaggccattggattatcttacatagacaccgataagaacaaaggcatcacctggggagaggatacactgatgaagtattttgagaatcccaggaagtacattcctggaacaaaaatgatcttttccagcattaagaagaaggcagaaagggcagacttgataacttatctcaaaaaagctgctagggagtaataattggccactgccttatattgcaaaacagaaatgtctcatgacttttttatgtgtaccataatttaatagatctcatacaccagagttcagattatgaatgactgtcagaatattttgttgggcagtcctgatttaaaactaagactggcttgtggttaaatgaataagtttggtttttgaatattaatagtaattccaattcagtgaatgctatcactgtttaccccttctaaagatatgattagactttgttaataatgtttaagatggtgagtaccatcttaaaacttattggagattggttttatatttatatttatattggtttatatttagatttatatgactggttatgtgaatatatttaaatactggggaaattccttcactgtctcagaaccaagcaagatgcacctgtgttttgtgtttatttgcctcttaaaggcaagggttgaagataagacaaaagtcaactactgctgaggcacgggcttaataaatgttgactaaaatatccaactcaacgaccaatcctgtgtaattttcaaactgtgtcagtaacttgctgggtccaacctccataccctggccgtgtgacggatgaagaaatgcactcagacacaggtatcccatgaaacagcaggctaggggacc

SEQ ID NO: 469205 - DNA, 789 bp, Homo sapiens
gcgagtatcaggcatagtaatgacagtcttacagtctgagcaccccctgggcttggtggagcagatgctcaggcccccaggatcaaggctgcatttgaacaagatgctggctgttctgcacaaggagtttgagactcgacaaccctcttccagctctaaacttctcagggtcactgtacccctggggcaagggcctcagtcttggagccctcgagcttcccccgggagcctttgcacctggaagccttgctgtcatgtcaccagccatgagccaggaggcgtggggtccagtgggggcttggcagggtcccgggggccccaaggcctctcatccccagccctgcatgagaagctgccccgggaaccagggcctcctcccctcacacctcccttctgggccttggcccaccctgcgctgtgtgtccatcaacaaacccctggagcagcaggtaatgcccaggacaccctctccactccacttccacccatgggttcctcttcctaaactgatgcctctcaaattccgcgtggccaatactttgcatgttgttctctggccttgctcgcgtggccaatactttgcatgttgttctctggccttgttctcattctaaacacctgaaaaactccctcttcctgcctctctcccgcatccacattccacaccccaagggctaggtcagtcccagccccgccttgaaggtatccctaagggctctggcctgagcaccatctcactggcctgggggtcctccctctgttctagtttgtccggagtgtttggcactc

SEQ ID NO: 469206 - DNA, 568 bp, Homo sapiens
gggcttgggagatgaaatatttgcgtagtggtcaagaaggactatttaccgacaccggttttcctccccacccagtacgtcttgtcctcattttacccatctcctattcaagatggagttgttctggttcacacgcctctaacaatgtggcaacaggaagtgagaacttgagtgtttacgttttagtggtcatggttttgctgtgtgtttgtgtgtctcagaatagggacattgtcttcaacttctttgtatttccaaagtgtgcaaagcaggccctggacaaaggacctgtcactgatgctgaattcctgactcaaggaccgcccagagtggacaaaactgttcacataaagccaggacaaactcacttggacattgatcgaaggcgtataaacagtgggcaaggtctttcgggtcagagctctatggatgactcattgtctctagaagaatgtcaggtccagaaggatgcccttggcctgtaaatgctttaaagcaccactggcaattcaaaaccttgcccccttgattttactggcttaaatcttgttttgaagtcttagatact

SEQ ID NO: 469207 - DNA, 1820 bp, Homo sapiens
acccccagcacacgggctcccccaccagcacacggatctccccagcacacgggttccctccccagcacacgggttccgccagcacatgggtccccccagcacccaggttctccccagcacacgggttccctccccagcacacgggttctctccccagcacgtggattcccccagtacatggataccaccagcacatggatccccccagcacataggtccccccagcacacaggttctccccagcacacgggttccctccccggcacacggcttccctccccagcacacggatctccccagcacacgggtctccccagtacatggatccccccagcacgtaggtccctccagcacacaggtccctccagcacacggctcccccccagcacacggatccccccagcacacggataccaccagcacacgggttccccctcccccagcacacagatctccctagtatacgggtccctccagcacacgggtccccctagcacacggatccccatagcacacgggtgctcccagcacatggatccctccggcagaggtgagctgctgctcaaggcccatgagacagaccccatgagacatggagatggtgcctgtcttccagagagaaggggcaatggctctgagctcggccttcactccgtgctcctgggagactctaaccaggctgagtccctcctgagcaatgaccacaaacctctgaagaaggaagaagagtgggacccgggccccagagaccctggtgggagtgccgtggtgtggcctccaggtgtttggaggatttcaaaggcacagatcctcccagccctggttggtggagtccaggtcgtatcttcccttctgtggccaggcagagtggccggtgccctcgtcctcttacatgcccttattagaagcacagactcttctccacagtgtgcaggggtcttccatcctcccacttcacagagctggatctttcgagcctcattgtcgaaacaggacagagaggatgggtgtggtgggtggacgcacagctgagaccctgctcacacagctgagaccctgcacacacgcacagctgagaccttgctcacacagctgagaccctgcatgcacgcacagctgagaccctgcacgtgcgcacagccgagaccctgcatgcatagccaagaccctgcacgcacagcagagaccctgcacgcacagcagagaccctgcacacatgcacagctgagaccctgctcacacagctgagaccctgcatacacagtcgagaccctgcacacacgcacagctgagaccctgctcacacagctgagaccctgcatgcacgcacagctgagaccctgcacgcacgcacagccgagaccctgcacgccctcccagctcagtctacgttggctgttttcttgggatgtcattgtggaaggtcctgcctggggcatggcggcttgggaatctgagcctcggactttcaatgccacgttccagttgctgccatgtgtttcctcccctaaaggaatcctgcagataaaatggattatgtttgtcctggacacgtacgagtgcatacatacctgcggctttgggcacgccgtccttgccaacgtgctcttcttgggtggtttaaaggctgatgtgctctccagggcttgtgagtcttcctgggcgcccctacccagtcaggatggctgcagacgcatcttcatgcgcattccagcagcgtctctgccaggggtgctgaaagtcactgtctgaagcagctgggagatggaagtgattctgactttggggcacccaccctctggaaaatgtggcacatcatt

SEQ ID NO: 469208 - DNA, 717 bp, Homo sapiens
gaagtccaagagaggtgaagaggggagaagcaggagacacggatgctgtggcatagaagaacatggactgctagtgaatcactcacagaaggtgactcacagagactgggtcaacatctcagaggacacagaggtgtgccctgcacacgccacaatgtgtgcacagtgtgggggtacagtgaatgtccgcagcggggggctgggtttcatcttcagctttgtggatgatgaattcttgattgggaaacccagcatctccctgatgccgactactctgaagataaaacatccacagggcacagcaaggttagtgcatcccctgggacgggaggcagtcaagggcaggcaccgagcccatgaaagcctcgacagaggcagctctgctcccctacgagctccagcaggaagcccgcaaggacccattttccccatgttcacggagctggactggaagcccaagctggtccagccggcacgggcagtcagaggttggaagctgggggggcctcccacatttctgctggatgctggggcccagagcactgcgcttccttgtcaatcaacatgttgtgataaggggaatattgggggtgcatctatcacctcagggggagaagcatgagtttaatggtggaggaaaggttgaccttagtgtatgacaaattgtttgtttgtttttttcaattgtttgagagacctagattttctttaatgttc

SEQ ID NO: 469209 - DNA, 943 bp, Homo sapiens
caaattccaaagaacagacttaaacatgagctgcgggacacaacccatgtgtgtcatgtgatgacagtgggcctcctggaccatccagaacgaccccccaccccagcatcctggccatcatcgcaccagcatggtgcctttgccatgtgggtgcacagattcagaatctccaaggatccaggccgtgacattagcaagcaggtctgggcccgaacgtcagccaggcagaatggtgtcatcaccaaacaaggacctggggtgtttcaccagctccagcgtcctggctggactctcccttctgacattgccactccctctactcctgaggaaaagccagtgccgtccttcctagaatctccttcctcgtttggttccaggcaagagtccaccaaggaggtgctggagaacccactcttacagagaaagaaaggtgggtgtcattgtctggaggtgaagacgatggccgcagaatttcagggctacatggaggtgcgtgtaaaagggaaaagcaatgtttcagaaggaatggaaggggaagaattcaagcctgcaaaggaggcactcattaatgagagagtgtccagaacaacatctagcgccagtcccagaagaaacccacaggagcacaaagatcttcagcctccgaagggtgggccagccccttctgtgggtcttgaccccaagtgctctgagaaggagagacttaaatgtttggtgcctaaactcaatgtagcatctgaaggagccatattagcataaggtgttctagaagatatggctaagcctaatgctgggttaaggtttaccttttcctaaatgtatcccccttgaatttgaatatcgatgtgtctgaattttttctcttcatttttgtagttctgtaataatttgagtctttttcctgaaaattagcttctgagcctgttttcatcctcaccaatgt

SEQ ID NO: 469210 - DNA, 1273 bp, Homo sapiens
attatttccggtcaaagtcactttgtcaagtcggtaggcgacctaatgttacctggacctttatctccggtaaaaagcgaactcagtcgcagggtggagagaacctcgggctccatgctctttggaaacgagtgcctgggggcagctctgagagagtctgctgaattcttacaattcctgggcgtctcttctgcaaatcctatttgaacacagccttttctgagcagcacctctgccgcctctcccaaaacggcatacagaacatgtgcctgcacttgcatgccgtctgcacacacagagcaccagaccctccaacagctcaggggcctcgcatccaatgctcaacacattccacgctcactgggacgttccaggtcaatgttccctgtttttcctgactctctgcagcatcatagccagggctccttggctgttatttcttcctgcaatgcagcctccgagctcactgcaggaatctttgagaaatcgcagctctttgccccagcacctgactatcggtttgatatcagagctactctgaagccaatcatgctacagcagctagatggagccctttcctctttaattaacagaaaaccattttatgaattaattaacaagttggagaagtcagccaacagtgcaagatctgtattggaattactcatcaaacacatcttctcaggaacaaggcagatgatgagagaggacggagtggaagggatgtagaccagtgcagtctcatagctgatctgtcaggaagagcctctcagtaggtcagtgtacaagaaaagggatgcatggtaaaaagaaaaaaaaaagtactgaagcgtgtgatatgaccaattgcattacacaggacgatgccttgaacaaataccttggaatgagtcaggcagagtggggatatttgcttgataaaccctggggctagttattgcaccaagtggacttttctctaagtggttaagtcaaacttgcctgggtttttccccccagggtatttcagcattcaggagaaagaggctgttggaaaatttaaactccagtaacaggttgcaaacacaaactttgctgtttgtttttaaagggaggtgtacagatataaatcttgtctccactcacccgtaagattcttggagactgacatattccttttctctgtaaatttaacttaatgctgtgtctcaggcaatatatacatttttttttataatgggcagaaggttttgcattaagaggaagttcgcattgaagtttataacctgatgtt

SEQ ID NO: 469211 - DNA, 742 bp, Homo sapiens
actgcctttctcaaaaaactggtggggagggggtgctgcgggcatcccgggatgctgtgagacatcctacagtgccagggacggcgccaccccaaagagcttcctgccgactcagaatgtccgcgggtcccaggctggaaaacacgctgcaggcatttcgtcttcaaaggagacaaggtcttccttcatccccagacagtcgtctatttgtgtctattttaattcaggatgaaaacccgactgctgaggccctgtctcgccagatctttacaggcaaaagggaacaggaacgatccctgcaaggacttttatgcaataggtcctctggccggcagcgcccccaggttctgaacactgaacacatggcgtccccacaccactggacatgtaactgggaggacgagccagggttgggagcaaaggagagtggcaggaggtggggggctctcttccaatgtgtcactgcccccaggaggggtgtgggctgcgagaatgacccatgctctggggcaatgttattcgacgccatttttctcctttgaaaagtattttattctccttataggtacccatgatttcttacaatattacttaactccctggctaccagctgcatgtgcagacatcctttacttttcagatgtaatagctgagcgtgaataagatttcctgaagaaagtataatattttgaaattatattctaaagattaatgtgatagattgttcccctctatggaatgt

SEQ ID NO: 469212 - DNA, 1578 bp, Homo sapiens
cccgctgagccctcctcctgccttgtttgcaaaatctccccagacaacagctgcttcttaagcctaatgaccaaaggtggaaagcagccagacaaaaatcaaagaagtccaaagcagcccctccagcactttggaggaagccagcctgtgatctgggacgctgctgaaagcacagcaaccaaaagggaaatgagaacattatcaaccggcatgcactctggagctccaggcaaccacgtgcttctccttggagaagagcatggagcaggtgtggcaatgctaaagtcaaacctgctgttggttattgacggtgcccatggagggagcaggggctccttctccgaggacagctttgaagccccttcttctggccttcagcacctacctgactcccattttccttccacctacctttgggctataccttgctctcaaatacataataagaatatgaaaaatagtgattgtggtgctgtgttggtgggggaggcagctgtgcagtgtttgtcacttcaaaacaccgctcatctacaggacaggattggctgccacgtttcctgtcctcggaggagggagcaggggagtagaggagagaacaaggtctccttatcgctgttggtctggcagtttgctttgttccgtgcaggaaagaaagcgtggggaagatctcattttggtttctcagattagcactctatggatagaatttcttttcctaggtatgtgtgataagtgttattctttgccttcttttgctctgtcttggaaggctgtttcagagactgctagctagaattcattcctgatgacatgtatcctggtagattttctgaaaatcccattttctgttataaatgcctttcattagacatatacttaaacatcgttcattgtcaaatagttatcaaatgacatcagttccatgaaatggttacttgaaaaccaatgtaaaataatttgttgtacaatgaataccttgatcaggaaatcactcatcgtagttggtattaaataaatgtgagtgggtttactgacaggaaacgggaaagaaagaaggagggaagaaaggaaggaaggtgggaaggaggaaaaaggggaaggagggaaggaagaaaggagggagggatgaagagaaggaggaagaaagaggaaggaaggatggaaggaaggaaggagggaaggaaggaggaaaggagggagggaggggaaaagggcaggccaagtaaaggactttggcattagtaataaaaagtatgtaatgacaaaaagtaagggaataaaacccaaataaatgttaggcactgaaaacctagagaggtgaaggaaggatgctgtgagagaaaaagccttaaggaattattaaattcagaaaaatacagctgtatcatggaaggtcacaaaaaaaagaatatattatttattccccactgtgcacttagattgttataatcaagtctgaatttatttaaaggaaagaaaaccttgaggtttctgtgaaatcatgtaattctgaggaaatgatacaagaaatctttcatctttgaaaggaactaagtgggaagtgaattaaactttttt

SEQ ID NO: 469213 - DNA, 1069 bp, Homo sapiens
cagacctgggttatagatcaatgaatcctggtaagcgggtgttcgctggagcacccaagcaggactcctggccagtgtgtatgtgtccggtgccatgctggccagcctccagaccagatgctcaggacctgctctgaagaggttgcgaagtgatatggctgtttttcaaaaccagagtcagacggctattacgctgctcttgcagttgtgggtggatcagcctccactcagagaaacagaaacaggcttccctgaggtcatgcgacacatcctttgggacttggagaaggatatttatcctcacagtggggaaggcacagaaaacttgcagagagcccgcctggcccaggccttggcctcacctgtggccacccctgctttgcaccactgcctcctcaagggacaggtcccacgtgacagcgtggctggtatggtccctgtagaagtgcgagagaaagcaaggacacagcctactagcctgagaatgccaaaacagcttctgagtagagttgccccggagcccaagcctggggtgtggcatgtccctaagcatctcatgcatttcacgcttgtggccgtatgggtgtcctctggggctctttgcagagacctgcgtgcacctccccgggaagcagcccagggagtgccttgccacactgaggccaccgtgtgtgacaccgttgagtctcacatggagacattcattgtccacacaggagaggagcagggtgattacatcccagttccaacttgcggcccactccaggtgtcccaggagctccctggctctacccgaggcccccaggaaaccaggagtcaggctgcgggtgctcagcagcaaggactgcgaggcaagagttgcgccctgagtctgctccctggggaagcctgagtccaagtgagagaggggttggagggagaagcctgggggttgccccagcttgggaatttccaacactcctcacaaagacaatagtgagaagcaaacatgaaaatgtactaggaaaattatgatcagaaaagcatttggagacattaattgaaaaattgagtctttgaataactactt

SEQ ID NO: 469214 - DNA, 678 bp, Homo sapiens
catctgcctctcaagttctcctggccagcactgtgctaggttttatggttactacaaagatgaatgacagttgttccctccgtgttcacacctacactcttgcctcgcagtccttgctgctgagcacccgcagcctgactcctggtttcctgggggcctcgggtagagccagggagctcctgggacacctggaatctgttttggggggagatcccgctaagacaatagcgagagaaccagacagcctcacagccaatgcactctcctccaccgcccttgctgctacctccgaacaccatttcctaacttcaagtttgtttgatgctcttgtggcctgctgtgctctcctcctctgtcatctaaattttaccctctttcaaggaccagctgaaatttcccatccccgataaatccattcctggtttccccaacaccaggggaacttgctcttctctgtcattttgttgctctgagggaatcctagtgtacatcgtttagttacctgcttaataggcaggacactttgctcccaaatcactgtaaaagcttttataggctgcattcttgtcttagatttttttgtagcttccagagacctcagcatctagttttgttctattttcatttgggaagaaagttctgctgacaatagttaacacatttattcattccccagac

SEQ ID NO: 469215 - DNA, 722 bp, Homo sapiens
gcagcagtgtggaagattctgtgaggctgcaactcccctcatgccgacagcacctcggcttgaaagtttaccactcatctcttgctctttccctgggatttttgacactgaagatgtaaagaaaagccttctcagtgctcccgagtccttatgctgcatgaaagtgggaggggttcacccaccgtgggcagctctcaggcggtggagggtgagagtgatggacacagacatccgccttttccatgtgaccagccagttcctgtggcagaatggatacggcctctcagaaggtccccacgggctcaggcaccagctgctcatggtgcggccacttggatgtcctctctgggtggacgttctccctcttctgctttgcgccctccatcctctcattcctgcctcctgggaacagataccacataaacgagaactagctttgccaactgtcaacaaaattatactgggaaagccagaaggctgccatgcaagtcttcaaagaaccctgattccctacagcctcagagcagactgtgctgaaaattaggcaccaggtttaattgaactacaaagcagattgaatatgcagcagggacacagctgtcctacaccgaattcaaggccatggggacatttggcaatatctggagacatttttgattctcacctggggccttggggatggggtgctactggtacctgttgtagaaataagagatgctgct

SEQ ID NO: 469216 - DNA, 595 bp, Homo sapiens
gagggaaaagtacaaggtgtgctcacccctgaatgagtccccggggcaacccggatccacctgtccaggctcctctgagcacgtggggagcacgtggagagggagtgggggagtcgtgggggagcgtgggcagcgcttgggggagccgttggggacttggggagagcgtggagagccgtggggagggcgtggcggagctgtcggggagccgtgggggcgcgcgtggtcagcacttggggagcgcattgagagccgtggggagcactgagggaggatgcggtggccacggctgcgtggcacccccaggccatggccaggagaccctcgggcggcgcaggtgccggaagcagcgccatccgtgctatggacgggtccccccaattggcagcggtctcgggggaggccactggatatacagctctgggaacaaaaaacggaatcatcagcctatttacaactctggaatggatgagatggctgtgacgactggcagcagctgcgcctgagccctcagcacctgcagggtcccatgggagtataaaaatatggaacagccagcttcctagagtgagggcaccattctgtgtttgctgcc

SEQ ID NO: 469217 - DNA, 803 bp, Homo sapiens
tcccagaaaggactcgggtttgagtcccgcggcagtaagtgctggagatgatctcagtgagtctccactccaactctggcacagcccactgtggcaggtcttaagcttcagagaggtttaggagttggcctagtcgcagacagcaggtgggcaagatgggcatgactgcagaggttcttgccctgtcctcctatcgctgtggtcttagacctgcaggctctcgagaaggctccttttatacatctgctgtttacctcccgcagatgcttggagctccattggtcacttgccccatccctgctggagcagacctagaaattgtttgccagtgggggcagaatgagggaggggctttgaaactcagttgctacaagttagcgtttttccccatcgatgggcttgactatgaccagggaatcatacagctttggaacagaaaagaatcatctagttgtggtcaaatgtcacactttttgggagaaaaacctagagagccagtgactctggacggcacttcctcacttgaaagcatcacatcacaatcatttcggcctaaaacttattactcatctgtgttagctagagattgtagctgcgtaaatgtggcttatttcatccagaacagaaacattaaaacgattcgactcctgcaggacatcttaatagtgtgtgaaaggaagaattcatatttccagaactctgtacctgttacagctcaggcggtctatgctttcataaacatagtgacatattttatgcattgatcttaaaaccctattacaaattctattccatattttctt

SEQ ID NO: 469218 - DNA, 1458 bp, Homo sapiens
gctgccagcatccacacgcacctcctccgtagccatggtaatatttcccacatgccacaagtccctttcagtttctcatggcccatatgagatagtaacggtactcacttccccagactattgcgatgatggcacgcgatggggagcccggtcctcattgcactggggctctgacaccatgacccagccatgtggaccgccaccgtcccctaccaatgcccagctcgggctcttgcaaacctcccccaatcccatccttgctcactatgttcctctgtggtcccttccatcgactctaccacaccgagctattgcgggaagccccatggcttctttcttactgttcctcttcacccactgggtggctggtgatgatcccccgaggcaggggaaggcagtagtgtcagctcttactccagggtggtcagggcccttagtgtcctcatttcgtgcctgaaatctctagaggtgttcatcttgcatgtttgggattatatatatgtgtgcatgtatgtgtgtctatatatttacatctaatatgtatatgtgatttttaaaacttattttttattaaagttttgaccagtttggaagcccagaactataacgtgctacaggttatgagtatgtagaaaccatggaatacactctacatttgcatatatttcctatatttgtaccaaaaaaaccttaattacttacctgtattgcatgaaatttagagcaactgctccttccactcctcaaatatactgtgtacaataagagaatagtcagtaggctcaagattaccatgcccatttcagaaccagtaaggttgtggtttgatatctaaatggactgattaccttaaaaaataaaaaaaacaacgatttccatttattatatttttctccattttctctggaacctgactctttttaatatgcccttactgaacaggtaaacactagatatgctttgtagattgatctcctgagacaaggacatgatgtttcggagacgtggctgttgttattgtaaagcagttacgagaaatcacacgagcttgctggggaaagctgatatgtttatctgcagcagcattcatcagggacagataccagatccacatgtaattattttccctgaacattggcgagacattaccaaaatcagaattgagttggtgtgagttagtttggagactgatttcagttagtttgatacagatacacacagagagacagattttttatttttaaatgatattttaaaatcacagctggagcctatgggctccggtcccagagcaccacatcctcctccatggcagaactgctgtgtttgttctattaagatttgcttttaggatttccgaatttgtagtttacaagagtccatctaggaagatgaacaggttttataattcagtttatcctggtaagcacacatatatcattatgtgtggagcatatc

SEQ ID NO: 469219 - DNA, 540 bp, Homo sapiens
tgatttcagacttccagcctctggaactgcagtgttctgtttgatggatcagctgcaggtcacacatccatttccgtttagtggtgcagacggcctgcgtagttccgtgtctgtgggtctactctctggcactgctctgttaagtaacacagaaaaaggcccatccatctttaggggcagcagggagaacaaatgggtgcaatgggaagtggggtcccggagctcagaggcaataagagcagctgacgtgcatggggctgaggttccaggtagagctggattttactccaaaggtggacacctatggtcccagacctcagaaaaggccatcaaagtccacttgttcaaggtagatggcagccatgcaggatggaaggcagtgccggcatcggtgaggctgcttgggcgtcttctacagtcgcagtacggcaattggcttcctccagaatgagacccaagagaacaagaggcaggccttgaaactcatgtcatcatttctgtcctgccctgtttgttagaagtgaggctcaatggacctca

SEQ ID NO: 469220 - DNA, 897 bp, Homo sapiens
gagtcctatctggaaacgtaacaccctgcagctccatgctttctgaaaagctaaatgtcttgtattgtgataggtcagtttagagtcgtattccaaaccctgaacgtcaggggctgcaaagacaacatttcccggtccacaagcctcctcccctacgttggtttggttagcgttgctatagtaacctctagcctgttttatgacatgctggtgattaccgagcccatgatagtgaagaaaatatcaggttacaagggcagatgccactgtaaaacatcctgtgtgacgaacatccaatttcccagcagagagtgtggtttctgccactcgggaaggtggggtggagaaacatcacgtcacaaacaacaccgggcagtggttatcacacttgagcgtgcatgggaatcacctggagtacttgttgaaccacagattgctcagctccggcctttcagagtttctgattctgtaggcctgggtctggacctgaatacctgcattcctaacaagttcttgagttgtgctaatgctgctatccagggactagacgttgagaaccacttcactatgcatcaccggaaagaggaattatccacaattgcagaatctgtggatcttttctacaatgcccatgacctgtccactgaggccctgagttatcactgcccacgtcatagcaagaactggcagagacatttggttttcttgccatggttcccactcttgtccctggttcatcttttagcctacagcaccagctttgaggctaggagaaacattctaaaggaaaatgatacagcctcatctgtgctgtttgctgaatcttcctattctccccacatctgagtacctggaaggatcacaattcctgattcccatcatggagcagtgccatgc

SEQ ID NO: 469221 - DNA, 651 bp, Homo sapiens
aaaaagtcacactagctcaccagcaatggatccaaaccaagaagagatctctggtttacctgaaaaagaattcaggagcaaatggtactgggataattggctagctacatgtaggagaatgaaactgaatcctcgtctctcacctcatacaaaaatcaactccagatggattaaggacttaaatctaagaggtgaaactacaaaaattctagaagataacattggacaaccccttctagacattggcctaggcaaggatttcatgaccaataaccccaaagcaaatgcaataaaaacaaatataactagttgggacttaattaaactaaagagcttttgcacagcaaaaggaacagtcagcagagtttttgttcccaagggaggaatgctttcatccaagcccacatttactggttccattaaatgggaaggtggatgtggacaagtggacaaggcttgcactatctgggttatttatcatcagctttgtcaagctgggaactttggccctcagaatccctttcctcgcatggccctgcactagagttggccataagtggacttggcaagattgggaggcaaagtgaagccacagatgttgctctgtgtctaaagtgacctaaattatcattcataaacgtcatctccctc

SEQ ID NO: 469222 - DNA, 716 bp, Homo sapiens
aggaggagttaagtcacgtcttacatggatggcagcaggcagagagagagcttgtgcagggaaactcctctttataaaaccatcagatctcatgagacttattcactatcatgagaacagcacaggaaagacctgcccccaggaggagcaaatcatgtcttacatggttggcagcaggcaaagagagagggcttgtgcagggaaattcccccttataaaaccatcaaatcttccagccacacctggctgctgcaaggttgctgcagacctgcatagtggagtcttcttctccaagagtgctgactttcttcctgctgctccattttgtgggtctaaaggacctcaaacccttgcccagtcttcccagcagctgcagaggacagctgcagaggaaaaatacatgggaaagacctgtccccttgattcaattacctcccactgggtccttcccacaacacataggaattatgagagctacaattcaagatgacattttgacggcgggggacacagccaaagcatatcaaacaaccagacgctcacagtgctaaagaaattactttgtcttcagtagcttgctgacatcattaatattatagatttgcatatgctgtttactttgtaattatgaaaatatatttgtgagggaatgggatatagaatattttttactcaatgaaattttggtacataacctgaaattattaaatgtacaa

SEQ ID NO: 469223 - DNA, 2112 bp, Homo sapiens
caggaaaacaaaggaagatttatagagtgcccataaattccaggaattaatctcttaagattctaagacagcatctgaaacgggactcagtttctgactctcacaacgccgttggcagaaacccagaggaagggaaaggagcgggcctggaggagtgaggggctgcccgccctcctgagcggttgcgggaccacctgaggccctcggcggggctgttcaccatcgtctggccatggccaggctgctgtggcctctcctcctctgtgtgcttctgtctaaaggcgctgtgtcttcttctcgcgcgatgcggaagggcagcctgtggcggtgccgagcatgaaggactgcggcccgctgagctcacttcaccgcaaccgccgcctctcaggcaccgcatccgcagcaccaccctggtctgtccacactcccactaagccacagcttcgatctcccaaggagacctcaagacaagttgctgtctccatccatcctctcacatccccagtcattcgctcccattccactgggtccgccctctctccgcctccctacctgcagacctgggctctgtcaagactggttcatcaacttgtggtccttccacatcctaaacatctcgaaagtttatgtcgttttcttcagctcaatgaagttttctctctacaacttcaactaaatcttcctcaattactctcatcaatattcaacgtctccctggccatcgggatctgctctcccccaggctgaacctgctgaactcacatgctccctcagtgctgcacttctgcacctgcttgtgtgtacacccctttcgggctcattttaagtggtcttaaagactcaactccatgtcagctactgcaagatgtcctataaagctctacccataaacccacactgactggtctagatgcttcctttctgggctccttctactttatcactccaaatggtcatttttctgttttctctggctttgaagataggggcttttttgtgcattccatatttttatccccaaagtgtcccacactttgggacactttagtgtccagacattcacaaactattgctgcatgaataaaaaaaaaggaaggaagggaaggaaggagaaatgagaagaggtgggagaaaaaattttaataattacttaaatattatttcttaacataattaatatacaatgtttacttatatgtatacttaataaagtgagtaaacttaagtattatttaatatgattctaataatgattcacggatgtgatgatgctagtgaccatccccttaaacaaatacatatacacgagtgatgtatggcatacagcctgtttcattagctgtcaagtgaagggcatcattactcttcctgtaacctaagctagaccttcagaagttatcttcaattttcacctttgttaagccccatatttataattgttatatttttagattcaaaatatattttttcacaactagcccttcagttcattaaaattaccactgttttaacttcagctaccatcgtaaactaaactctacttagctgctaaaagtgtttcttaaagaggagtgatgttaccttcctcaagggcatctggcagtgtctggagaggtttttgttctcatgatggggaacggggtgctcctcctgcattcagtgaatagagactaggtatgctgataatattctataaatcactggtcagtctacgacgatggtgaattatcaggccacaaatatcaaatgccaagttgagaagctctgtgcacagcaatccagctcagaagtcagcattttctctaaagagccagatagcaactgcttcaggctttgtgggcctacagtctgtattgcaacactcaactctgctttgaaaatgatatgaaaacaaatgggtatggacgtgtaacaatgaaactttatttaaaaaacaggctgctgagtggatttggcccgtcagctgaagtttgccaacccctgatctagcttaaagaaaaatacaatcacgttattagcattgcaggaaatgttcaatgcctattagttacagcataaagtccaagttttataccctaaaatacaaaggttctacctttctctcattttctc

SEQ ID NO: 469224 - DNA, 629 bp, Homo sapiens
ctgggcagagaacagactatgacacactgaccgtggtctgtgccccaaggtatattttcaaaggtagaaagaccttgtacaatgattgtagatcccactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtaaattcttctgctcttaaaatcgtcgttctcgctgctgttcagtgcagtgtactgacactgacacta

SEQ ID NO: 469225 - DNA, 697 bp, Homo sapiens
tctttgctctgcgtttcacagtcacatcttccaacagatgccgatgcgcttgccttctggggcttttctcctttctctacaaggagagagggatgggagcagcttccatgaaagagaggaagctgggccacagggagagatgggcagagatgatgggaccagcctggagcttaaaatgcctaaaagtaaaataatgagcaaagatatgacagcttcactcactgaaatatcagcagttctgggtgtgtgtttctggctgtgtttatgctggacacaaggctcggggatgagttcaggctgcggtcagccccttaaccgttgtccagggccttctgtgcaagacacagccaccctgtctgtctccaccccccggctctcccaactagacgtttccaagaaacaaataattggccatacgatcattcactatgtgacaataaacaagttggttaaatggatgagttaattagaaatagcacatagtcaacagttgttgttacagacttattttcaataaatttaacttgtaatgaaaaccatttcttgtccaaagcacaagtcgaattttatacaattgtaacacatattcatctggtttgccactgtttcttctgtaagaacgaagataactgtattgctggagaaggtgtgcttttttcatactgattgataaaattttaatttagaaacttagtct

SEQ ID NO: 469226 - DNA, 576 bp, Homo sapiens
cagcagcagctgtttcattagtggcaataacagcaaaagtgcattcattgcctccgttcctaagattgtcaactgccatgcctggacatctgtttgaaatgacactagacctaaatggcatgtccagctctcactttgtagctgtgctgaagatggatggctactccaatatgaaaggaagaaaacagtacctgctcaatggtccaaggatgctcctaacctacctgacgccttctcctcattacagttcacgaggtgtgggtttgcctgatgcatcaggagaagtttcaccagatttgtctgaaatattaaagataattgaaatgggaaccaccatggcagaagctaggatacatcagactcagctgacatattgggaaacttatcttgcaactcatgcttatggatcgtgtgaccttgcggttgcacagcaagaaaaacagcttacagaacttacaaaatatgtgggggagagatatggttaatgctgcacagaccttacagagaagcagttaatattttttcttaactcttacttggggtgggtggggggcgctacttcatgcccattctagc

SEQ ID NO: 469227 - DNA, 738 bp, Homo sapiens
ggcataagacatcagagcactgccgcatctctgtattttgggaagggtcaagcttgtcctgcatgctacagcttgttcttcatgctacagcttgtctttcatgctactgcttgtcctgcatgctacagcttgtcctgcatgctacagcttgtcttgcatgctacagcttgtcctgcatgctacagtttgttctgcatgctacaacttgtcctgcatgctacagcttgtcctgcatgctacagtttgttctgcatgctacaacttgtcctgcatgctacagcttaggtaaaacccaggaaaatgtggggccccctaagactgtggcccccagggtttcctcactccatactagtctgcactcagcctctggcaagtcaacacattgccatttaaatattcctaccagtatagggctcctgtgcttccgctccagaccatcttcatcccctcagattctagagttgataggctttttcttacaaacttagttctctgataggtccaagaaacatcaccgattttcaatcagttcagatttgttcttgttgttaagacaggagtgacaattagaagctgatttgaaattagaaatcttacagatttatttttttcagtgacactttattgcttgtcttctaaaatctaatattatggttctaatcactgttaatattaagtaagcatttttaccaaagatagaataattttccactatagattctagtgatggtaaggttt

SEQ ID NO: 469228 - DNA, 613 bp, Homo sapiens
gccagagagaagatcatgaaaagcaaaaataagtatgttcaagataacactacagtgaatatgatccttcaatgtgacatggtggcagagaagagggatgacattttggggatcttatgtggagtaagtgatatcattaatgcttcctctgttgatggtgttctaagtggagagaaggatgtcatcatggtccccaagtcttccatgacagagaagagtgaccagtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattatctctactgagtctagatcgtggtatctcacatgatactcacaattaaatattgcaggaacagccctgaattgatgaaccaaattatgacaaagaaaagaagagtcagatctgagttacatttcaagcaaaatagctcataaaataacagtgtagtgactcaggtgcagtatctataagtacatgaaatgactccccttcagcatctaggagactggtatcacaggtagcatatgataaggttc

SEQ ID NO: 469229 - DNA, 886 bp, Homo sapiens
gtccaggtgggtgggcagggttactgctgattcttgatgcccacactcgcattctctctttccctcaaagtcgctgatcgtctataattagagctcagtgctgatgaagcatcaggctctgtaatgtgggacgcccaaaagggcaagccagggagggctgctcctttagatcacgttgagcagagacccacagcaagtcagcaagcgagccgtgtacatctgagaggcatgtgctgggtggaaacccggcaagagcacacggagcaggagcacgggccagcgctgaaggagcagcaaggtggccggtgtcagcagagcagagcgcagagggaaagtgactggagaagttgcaacggctgtgggctggggcttgagacagatcatggtgtggccataagcaggactttggcttttacttatgagagaaggaaagctgttggagcatttcagatacagaagagccgaagcactgaaaacaacagagaggagaatggagttacagagagtccttcttccacgtgtggaaccaaatgtgtaggctttcgttaatatctaaaatgcaaacagctgtgaaaaccaaagactacggcttctgtgccatctgaccctatttattatgatgattggtggtgtttcttgtcatcttcaaacttattccatggacagatgtaaagtgacagtattataacatcataaacttgatggcatatttccttagctcttgatgtagaagtagtaaatccaggatgcatgcaatataaatacatgcttcccttcttattttctctctatataatgctctgacaatttatgttatgtaagtttaaaatgctcttttttatgccaaattttagaaataaacagtttcaaaaaatgactcactttt

SEQ ID NO: 469230 - DNA, 609 bp, Homo sapiens
cccaagaccgttcccaggacagcggcatcctcctcatctgagaacttgttagaaatgtaaatgatcaggccccatcacagacctgctaaatcagaaactggaggtctatggcacagtgctaaacagaaaaatgcctgtcccattccaaatgcctcaatcatctctgttgagaaacatgatgaatatgatctaatagggaccttgccgttccttgaatacagtggttcattttctgcctattgtgagcagtgcaatgtcagagataacaagaggcccaggcagagttggctatgggaggatcccacacctggcaggagtggagccgccttgatgagcatccctgtcatactcagtcgagtgggctgggagcagctggtgatgtgtggtcaatgtgtgattcgcacagcagctggggcctgggccactcagactttttgctacaggagatttaagtaggcctttccatgtgcagtgcaatcctttttgtcatattttaaaaatactttaaagatatcacacgtattaaaatatctaagtattttaaagacaaaggcctgtaatatttacactgagaactgagatccagattgtgctcttatttgcatgtaa

SEQ ID NO: 469231 - DNA, 2341 bp, Homo sapiens
ctggaacttcctggttctaagtggtgatggcgaagtttctggagcacgcttcgtgggcacggagtgaggttgcaggttctactcccgggcagctgcagtggctgccagtggtgatggtgaagtctctggagcacccttcgtgggcatggggtgaggctgcgggttctactcctgggcggccgcagtggctgccagtggtgatggtgacgtttctggagcccccttcctgggcacggggtgaggctgcaggttctactcctgggcggccacggtggctgccagtggtgatggtgacgtttctggagcgcccttcgtgggcacggggtaaggctgcaggttctactcctgggtggccgcagtggctgccagtggtgatggtgacgtttctggagaccccttcgtgggcacagggtgaggctgcagaggttctactcctgggcggccgcagtggctgccagtggtgatggtgagatttctggagcgcccttcaagggcacggggtgaggctgcaggttctactgggtggccgctgcacccttgagttgcttcctcattggatgagaggcatggtcttccatagttttcttcaaactgttgatgcaggtcagtgctttgcaactgaaaggtcaagtttgtgctgatataccacctccctgtttcattttcaaggtcttttactgtcagcaagaaggaattataaaagtacctgtagcagagtgcttcagacaagcagaaagtgcacacacacaccaatcccaaaatttcatcaggtcactttcactggctgaaaaatcgttcctgctcacatttgatatttgtatagaaaacatagaagacttagaacaattctcttgactcccaaccctacaaaagagagagcgatcacaagagctccgagctgggaataaaacctgcacaagctcagctctgcatcgcccctcagttggggctgagctccctcctgggagcctcccgagcacatctcaggaaggtgcgggactgaacagcttctggggagaacactgggaataggagaagatactggggactggggcttaggacagaaaatactcaatcaaggacactgagttagttaatttatattttttaagtataggaaaaatgtttaggagcacaaatgattatgaaagttttaaactgcgataagaatcaccgtcatcataacctgctggtagccacagcatcaccttgtcttgtctctaataaacttgctcctcggtctcctacgctatcctctttctgttaccctcaggggatactgaacccccttcctgcagtggagctgctcacttttatgtaaaccaggccacagcaaattaggctctcaggccaactctggcccactgcctgttttgtaaataaagttttattggtgcacagctatgaccattcatttatatatgcctgcagctcctttggggctacataaatagggttaagaagctgttaagagagattatgagacaagtaaagctcaaaagcatgactacctagctctgtacagaaaacatttgccacctctgatgcagaccatattctgtgcaatggcaaggccagtgggcaggcgggacagatccggctgtgaattctgcccctgtcccttagcagctgtgcgacgctggaaactccattctttgagacgtggtttcctcaccgtaaagtctggaccataatatccacctcatgggcttgttggggaggctgtgagactccatatgtgaggtactcagcatggtgcctggtatttaatatgttctcagtaaagggaagctatgacaaagcagctgtgatttcagccccgctgcctgttctggctctaatgcccttcctccatcttcactccccatctctcctctccaatccacctttcctacatcttgctgcttttcatgtcctggtcctctgaggtttttgttctccttttctcctcctttgtgttacccctctccccctttgccttaaccatgaggctcattcacgtctctgaagaccctcattattcccaccagcatctacacactggggatccagtaccctattttttctggggagctgttccctgcttctcatgcttcccagtaacagccgccatcatcagaaaatgataaatctagaggaaccgaaatccagacctagggctctgtcctgccccttgagaggtcctcttcttgctcacggctgagggcagcagcctgcacaacccgcaccagtctcatcagaagctggccccattgcatcagctcagcacctggctgccacgctcaggtgtgactgccgacatcgcatcagcagcctgcaaagcatggggtcattggctatc

SEQ ID NO: 469232 - DNA, 883 bp, Homo sapiens
gtgtattcagctggacatgacaactttgggcagcactggacacccagatgctgactctagccaataccctgcagaggctggcagtggacagtgctgctctagaaggtgacctgtgtgtagcagtgatccagagtggggactgggagctgccatattggatagagcgggtgtggacattgtcaccatcacagaagcttttagtggacagtgctgctctagagggtgacctgtgtgtagcagtgatccagagtggggactgggagccgccatattggatagagcgggtgtggacattgtcaccatcacagaagcttttagtggacagtgctgctctagagggtgacctgtgtgtagcagtgatccagagtggggactgggagccgccatattggatagagcgggtgtggacattgtcaccatcacagaagcttttagtggacagtgctgctctagagggtgacctgaataaagttacaactggcaaactgtagaatgtgtgaagatagcaaaaatagcaaaatagagacagcaaaaatagagtttcaagttgttggttctgttacctcattgcagcaagttatatattgtaatcaaaactaagttttaaatataactgaaaacaaaaataatcttaattacttttagagtaaaatacgtgtttaaagatatttggggactcattcatttttggagtctttgaatatttattaaaaatttataatgctacagtggctacaggctcaggagctaaaataatgtgggctaccattttagccctgtgacttttaagatgtgtgacctcaaggagccgacttagcatctctgatcctcagtgttttcaataaggagccgatgagtcatccgtcagatcgggctcctgtgc

SEQ ID NO: 469233 - DNA, 632 bp, Homo sapiens
gctacttctccagcctgtgtggagtaggaggtggcaggctcttgatgacgcgttgcagatgcagccagggctctagtggaggtggcctgagtgcctgtcagggcagagggacttactgtcttcagggggtgcggcggctgccaggctgtgagccgcgagggagcacctctcctgcctgggctcagcccccttcttatggttgcctcctgtgtctccgctctcttcatttgagaatcatccctccagtttgcctttttcaactccagctttcccaccaggaccaaagggcagtaaccccacagcaccctgtctcagcagagggcactgcccctggggagcactttaggcctttgggggcactgttggcagagttcctggaggtcctagacatcctacctgggctgtcccctacaacgaggcagtgtgtccggcacctgcagtttccctgctccttcacagaggtgaaaaccctgttgccaggagcctcagcctaggactaactgccttttccatagcgttttccagagcatttttgcatagctttaacatacattaaaattcccagaagtgcacacgtgcttaaaatgagggaaagctgttcttcgctggcactttacctagagctggtcacc

SEQ ID NO: 469234 - DNA, 1849 bp, Homo sapiens
gaatggatgatcagatggatagatgatcggatgaatgaatgaatggatgatcagaggcatggataatcagatgaatggctggatggacgggtgacaggatggctggatgatcagttggatgaatgaccagatgcatggatgaatgattagatgaatagatggatagatggatggatggatggatgatcagatagaaagatggatgggtgattagattaatgaatgaatggatgatcagatggatggataatcagatgggtggatggatgggtgaccagaaggatggatgatcagatgcatgtatggatgattagatgaatggatggatgatcagatagaaggatggatagatagatggatggatgatcagatggcttaatggatagatggtcagatcgatggatggatggatggataatcagatggatgaatgaatggacggatggtcagatgaatggatggatggtcagatgaatggatggatgatctgatagatggatggatgatcagatggatggatggatgagtgaccagatggatgatcagatggaagaatgatcagatgcatggatggatgcttagatgaatggatggatggatggatgattaaatagatggatgaatggatggatggtcagatgggtggatgaccagatagaatgatgggtggatgatcagttggatagatggatggatgctcagatgaatgaatgaacaaatgatcagatggatggataatcagatggatggttgaatggatgaatgggtgaccaaatgtatggatgatcagatggatgaatgatcagatgcatggatggatgattagatgaatgaatggatggatgcatgatcagatggatggatgatcagatggatagatggatggatgatcagatgaattggtggaccaaatggacgaataatcagatggatggatgaatggatggatggtcagatggatggatggatgatcagatagaaggatggatgaatgataagattgattaatggatggatagatggatggatggtaagatgaatggatgaatgatcagatagagggatgtatggatgatctgatggatggatgaatggatggatatcagatggatgatcagatggatgggcagatggatggatggatggacaaatgaatggatgattggatggttggatgaatgggtgggtggaggagtggatgactgaaaatgaatggaaaggagacagcatcccacagagatatgaaaaacctgaggctgagtgtgacttacccaaggtcactcatgggcttctgaccacgcaccttccattcacaaccatgtccgatctcacagagcctgatatgatgggagcaaaattaagccagcagtgtagatgcagggtgtcagcagtgggcctggacagaaaccggctctgccctcacgtggagccgaccgacgggcttgttggctcatgggcagggctgacatctctcttccaaagactgtcctggaaaaacgtaactctcaacggaagtggtcactgcattgaccctaacccccgccaggcctgagttgctggggttcagtattactccagagggaatgtgtgtgcatgtgtgtgcctgtgattttaggcgttgacggcgaagctgggcttctgctggcctggccctgcggccgcctgtgccgtatccacgtagcctcccctctttgcctctctcagccactcagctcatcagttcttcatccataacaggtctcttctgcccctatttggtcagcatgaaatgcatattttcttgttttttaatttggaagcttggtttctcagctcacagctgctttccttcacagccagggctgcctgc

SEQ ID NO: 469235 - DNA, 621 bp, Homo sapiens
aatggattaggaacttgtgaggtcgtcgccatctagtgaggagatgctggaacgtccctgtgggctgctgtggccgactcaccgagccacgaagccggtagctcctcgcttttttaaaaaggaacacacaaacacctttgaggaaggcaatgccaagaaggcactggcaattgatggggcacgtggtcgtggaatcagttctgaagaacacagtgctgagtggcattgtggagcctggcacgggcctggcgagcactgcctaggtgggaccctcaccggcccggctgtgggccggtccaaacccatgggcatgctgagccactttctgctcttcttggaagttccagttcagataccaccaattgtgctccgttatggtgttcctggctgttatctgcttcaggcttattgtgtttgcagtgtgcacagatccggcagcgtccctactccagaggtgcatttgcgtgtaaagctcttaatcatttaatgaagcactgaggtgctggccatcccgtggctggcgtgggctgcgaggtgcaggtgaaggacctgccagcttccccttcgcctcccgccatgattgaaagtttcttgaggcctccccaaccatgcctcctgtac

SEQ ID NO: 469236 - DNA, 730 bp, Homo sapiens
tgcccctcacctcctcctggtacatccacatgtgtacccctcactttctccctcacctcctcccagcacatccacacacatgcccctcacctcctcccgtaggcatctgtcaactaaaggaaggaatatgaaaattgttccatatgtgggtcttacttttcagctcccaagttctcaagatctcatcttgaatgaggttcaggaaaatatgcttgatagtttgagccaagtcacgtggctcagtgtggtagtggcatcctgtaagatttcagggattggggaagctatgcacaccagtggaattgagcatgggagaaaagtgaaggccctggttgccaagcactgcccattggacttcctgtccccatgccttctccctgtgcccgtgagctctcccctccacatcagcccctgccatggcacacagaggaccagccctagaccctggcagccctttgctgtcatttgcacagttggtggtgacggtggacactgagctgactcttcaagccccgtgggaggacagaggactggtgctaaaaggagcaaagggctgagcatctctcgctcgctaaagtgagtacaaaagctagaacaaaaacgagaacccgaaaacaacacaaaacgtgaaagaaactaaataaaaatgtgtgaaaaatagaatgtcagctggatgaggacaaaaataaaatgactggaaaaatattccaagtaaatactgctgattgtc

SEQ ID NO: 469237 - DNA, 535 bp, Homo sapiens
ccttgctgaaatgccaagagggtcgcacatcgacggctcacctggggacaccaaggggctccaacgccaccttgcggtggggggtgggggtggtgctgacctcatctccccccaaaaaccagccacaggggtgagaacttgtggcctcaacctccgacctccagggagggaagaagcactggggttgagccccgtcagtcatgcctttgggatgaaactctgcatggaaaccctggaaagacagggctggagagctcctggctgcctcgaatgtcaccactcctcgaaacgcgggcccagcgtcttccagggcgctcctccggtctcactctttgagtcccccccacactctgggactctccagtcagctctggtccggctcatgcagacaccagttggtaaacaggaggtgctcaacgagtgttggctggtcatagagcgtgcctcatggatggccacagacctattgatcaggaccccaccctcatgaccttatctaaccccagttacctcccaagaccccatctccgaatcc

SEQ ID NO: 469238 - DNA, 992 bp, Homo sapiens
atatggcattaagttcatttgtctgttttcaattttagggccaggcagcaggtggcccagacgctgggctcccagggatacgggcctcagtctatgtccaggtggcaccacatcttcttcacctgtggctgttccgctttgcttaatgccacgattatggatgcctcccactcagagactgacctgcccgcttctgctagagcagaggggctccatttcctggctgtggggctgggagaagggacttggggctctaaatggtgtctcattggaattcgacgactccgtgtcctccacacccctcacgtcttgcctcaagagacacaggtgcccctggttcctgagctgctccgtggccctgggtgtctctgctggcttctcagggctcctctcatctggaggcacccatttcctggagctctgtctgcgtcagtggctggtacctgtctgtcctcatcatccagggctcctcaacagagggaggagggcaacttcagtagaagcagagtcacactgggcctgggggcctccaaggcccctggatcattttctgtttgtcacctttgaaaggaagtttgtaggaaacataggagaataagaaagcatgttcatctgacaattcagcaaatccttggctaaaataaccctagcttatccacaccatggaattctatgtagctattggaaatgaaggaacagggagaagaatattttatgagcaaattactatcttcatattctcaaatgaataaagcatgcttcagtaagattcagtaagattctatttttattacaaatgtgtgtgtatgtatatgtatatatatgtacatacatatgtatatatacacatatgtatgtgtatatatacatacactatatatagtggatatatagagtgtatatatggtgtgtatgtatatatatagtgtatatatatagtgtatatatatagtgtacatatatagtgtgtatatatatagtgtacatatata

SEQ ID NO: 469239 - DNA, 1154 bp, Homo sapiens
gaaagcagcgaatgaagctctagatgctgaaaacggcacagaatgaattatgccctagagtgcccggaaggacatacagccccgcaggcaccgtgattttagcactgtgggccctgggttggacttgggactgcagaactgtaagtccacgggcagcactgaggatgcaggcaaccggggcccacacctccacgctgtgcatagatggtgcttgccaaatttggcccaccgcctacttttgtagacgacgttttatgggaacacagacacccccgtccaaagacaataagatgaggagagaagaatcttttcaacaacgagaactgggaatgctggaggcacatatgcaaaagaaagcagtggacttcaacacactgtccccaaaactcacccagaatggaccatagacctggatgcaggtgttaacactaaacaacccttcaagaaaacatgggaatgacacttcatgaggttgcgtcagatgacggtttcttcttagatacagcacaaaagtcacaaatgacaaagaaaaaaataatacgctggacttcaccaaaatgaaaaacttttatgctgcaaattatatcatcaagaaagtggaaagaaaactcacagaatggcagaaaatatttgcaaatcacatttctgataaaagacttgtatctagaatacataaagaaatcttacaactcaaaagtaaaaggacatataaccaaatttaaaaattgacaaaggatctaagtagactttttttttttaagaaataagtgaatggacagagtgagaatgagtactaatgggtatggaatatatatatatatatatatatatatatatatatatatatatatatatatatatacatatttttttttttttttggcagagtctcactctgttacccaggctggagtacagagagctctaagccaacatggggggtgggggctgcctccctgttgcaaaggccttatgtcaagactctggggaggctgggggatgttggaggagcccagctgattcccgcagctattgtgccttcccagcccagggcaggcatgtgtgaatttcagtgcgtccagctggcttcccttttcctggacgccttcttccctccctggggttcaccgaccgtgattatgtctagagtatat

SEQ ID NO: 469240 - DNA, 933 bp, Homo sapiens
tattgtctatggctgcgaagattcagtgttgttcctttcatgatggaagggcccaatgtactcaacctgctaacgggtggtatctgcctaccctgaaaagtggtgccacattggtctctgttgttgggaaagattgtccatataattattaaatgcctgccggcagtggacatcttgtggtggacataggttctgagaagttcacacacgtgtttctcactttgacccctgatagagatctgcctacttgctgcagtgctggggtagtgtgcaggtccacccacgaacctacacttgcaagaactggtttctaccggaccctaatagcaagcccagagctgcttttggaaaggagatttgccaacagaagaggggataacctaactcaaatcttcagagatttgtgcaatgattctcctattagaacttgccagatgggtccctacagtttctcagacaatgcaggacaatgcaaaagacttggccttgtcctgaataaggtgattgtataatttacaatccaaacctggattttgaaagtgaaaggaagtgctactgataattctgccagaacaacaggtgtacctgggccttggcaacgaagcaactcatcaaaggcacattgccgttgctgctacatgaaggcagtttcttatttttctttatggatgcactggaataaaatatttttcaagttgacagctgcaaactggttgcataccagctgatttattctagtaaaggtaaatgtgtaattgcacctgccactgtcatcaacacctcactaaatctgcgcgatttactgttgctctccaaggcccatgtggctgttgtacttgctaaacaggcaaacgacttgcaagtattttttttctcagtatgtaccttgtgttttcattctcttaacagtgttttccaaagagatgttcaaaa

SEQ ID NO: 469241 - DNA, 1078 bp, Homo sapiens
ccgagccatggagacgtgggtgaaccagtcctacacagatggcttcttcctcttaggcatcttctcccacagtactgctgaccttgtcctcttctccgtggttatggcggtcttcacagtggccctctgtgggaatgtcctcctcatcttcctcatctacatggaccctcaccttcacacccccatgtacttcttcctcagccagctctccctcatggacctcatgttggtctgtaccaatgtgccaaagatggcagccaacttcctgtctggcaggaagtccatctcctttgtgggctgtggcatacaaattggcctctttgtctgtcttgtgggatctgaggggctcttgctgggactcatggcttatgaccgctatgtggccattagccacccacttcactatcccatcctcatgaatcagagggtctgtctccagattactgggagctcctgggcctttgggataatcgatggcttgatccagatggtggtagtaatgaatttcccctactgtggcttgaggaaggtgaaccatttcttctgtgagatgctatccttgttgaagctggcctgtgtagacacatccctgtttgagaaggtgatatttgcttgctgtgtcttcatgcttctcttcccattctccatcatcgtggcctcctatgctcgcattctagggactgtgctgcaaatgcactctgctcaggcctggaaaaaggccctggccacctgctcctcccacctgacagctgtcaccctcttctatggggcagccatgttcatctacctgaggcctaggcactaccgggcccccagccatgacaaggtggcctctatcttctacacggtccttactcccatgctcaaccccctcatttacagcttgaggaacagggaggtgatgggggcactgaggaaggggctggaccgctgcaggatcggcagccagcactgaacccagggcatccagtgcctggctctgccatctcttagctccagggatgtcgggttaataattctctcattttcagtcttggtttcctcatgaattatgatgattgtgacaccctcagacttg

SEQ ID NO: 469242 - DNA, 801 bp, Homo sapiens
cagctccgcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccctccttcccactgccctgtccgcagtgccgcgagcccgcgcgccccagtcagctgcggcccaaccggcagctggcggcggtggccacgctcctgcggcgcttcagcctgcccgcggccgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaagatactgggccgcctgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctc

SEQ ID NO: 469243 - DNA, 883 bp, Homo sapiens
ttatgaaggtttatgacaatttcaaactaaaataagccatgtaatgctaggagtggagggacataagcacccctgtggctaccactattatgactgcactgggttaaacctgaagtcagcactgcatttggtctcacccaaggcctacactcgtggtgagctcccccaggccctgagttggtccagaagtgccttccaggagtcagaggaggcagtggactctcctctggcccaaggcaggtccaaaaatgccatccagccgtcaagtcctggaattagggaccccaagagcctgtttggttctctaacccctgtagctgtgctggaacctaaggattggcaatgggcacctcgctggatcaggagcacagctgacaccctgctggatctggagggatggaagtcagcggagggtctgcgacagcggccaacagcactggtggatggttataatgcaataatgcacactaagaagtttatattcaatgtgcatggtgttattgatagagagcagagtatgcagggcaatgttcagtactctggctttaggtacacacaacgagagaaaagctcctaccgggaaaccaatggaaatcattaccaaggggctttcaataacccattgacatttagaaaagcaaaatctgagggcaggtcagagaccttcacagcagcccttcccatcacaggcccagaggttagaagggaaaaattttgtcctgggcctggctcaggacccagctgctttgttcagaactcagttccctgtgtcccagccactgcagctccagacatggctaaaagaggccaaggtacagctccagacattgcttcagaggatgcaatccccaagccttgacaactgccacgtggtgtcgggtct

SEQ ID NO: 469244 - DNA, 600 bp, Homo sapiens
aggatcctgtaacacctctacaaaagaaataaggaacactcttcaccaaacgaataggaagcaaaaatgagggaagacacaggattcgggaaatgggacaagcaggcaagagaaatctgagaataatgaatatgaaagaatctgacaaaaaccaggcccatgcaggtctgaaatccagaggatttaaaagctccaaaatgatctcctttgactccaggtctcacatccaggtcaccctgatgcaagaggtgagttcccacggtcttgggcagctccgccatgtggctttgcagggtagagtctccctcccagatgctttcacaggctggcatttagtgtctgcagcttttccaggggcatggtgcaagctgttggtggatctaccattttggggtctggaggacggtggccctcttatcacagctccactaggtggtgccccaatagggactctgtgtgggggctctgaccccacgtttcccttccacactaccctagcagaggttctccatgagtgccccatccctaaagtaaacttctgcctagggatccaggcgtttctatacatcttctgaaatctaggtgaaggttcccaaaccc

SEQ ID NO: 469245 - DNA, 2647 bp, Homo sapiens
ctcctcaagagcagccagagtggacgccgtggccgaggaggcgctgagagcatgggagggctgctagcacattgtcacctctcatcttcacatggtcttccttctttcactgtcagtgtacaaatttcctcttttcataaggacaccaatcatattgaattagggtccacacttaatctcatgttaatttcctctggcagctgtccccaaggggaccccagtgagacaagtcagaaatggctttccggaggacccacagggcttttacaattgcctcctctaccccgtatttcacttggctctccaaattgtctcacctccagtttggcactcacagtatttggctgtctcctcggtcctgcaggaaccatctgcttccttcaaagggtctgtggattctcttgcctttcctggtttatttctgcagtagttcttggagcagaagttcacaatgtgagtctccacatactgctctgtctgtcccagtgggagctacgatttagtcctgcctcttatctgccttttttttgctactaaattcttattttccattcctattggtatattattgtaagactgatttctatgttaagattttgattaaaacaaaacatcaaaacagtttggagagttatatagatttcattttgttctgtttccttttttctattttacatttgttctgattatatttactgaaatgtaattttatgtttgttgaatctaataataaaaaatttgtttctattttgtgtgtataatgtttaatctcattttattttttataacatttttattttcataattgtatcactccacaaaagactggggaaaaataacctttcagctcagacagttggaaaagcactgccattagctctttttgtggtgtggtattatatatatttgtcttatttattttttgctatatcactgccattttcatactctaaacttctagcattgcacgctgcatgttccatgcttttcggaaaagagtaatgagtaaataaacttccaaggcacttgaagtaagcaatgaattcacaacaatggttacatatggtggccttgaggttcagtaacttcaggtagcaagaaagaatcacaaatttgtgatgtacccaggatgagggataatttggagttcacaggcaaatgggaaatgcacatgacatttacagtcaaaatttggctttttcagaattacgctagctaaacaaaacatggcttcagattcaacttttcctgcattttcaggacctctggttaaaacaaaaggctttaagtaaacagttggagacaaaataagctaattaaaatgtcttcttacttttcctaaaattgcctttaattgtatctctttctacatttttagtatctatcaatctatccacctatcttcctctaaatttatccaaatatctgatatctgttaactacaatcggtctctttagctgttgttctgaacttccaggtccgtataagactcagtatccaattagtatttcaaacaccacagactaaaactgaactaatcttacttttctacaagtcagttcccaaacatgaatttcacatttttattagtgccacaatctgttattcatatttctaaacctgtagtcatctctgacttttgttactatcttttcatatactctattggtaatatcacaacatgcccagcagttacatatttttttctttattctgacctgcttgtataatttctgactcaaatgtcctcagccatatttatatatgcaaatcaaaacaatatcttaaagcccagctaaaacgtcataacttttctagtttcccttgattctctcagcataaagtagtctctccctccactttactactttaacactccattttaaacatcttttgcttagagaacaactttactgtataatgtcattttttattttggaggcagaggatgtcatttatgtctttctgtatataccatactatcatgaaaacactgtcatttgtatatggcaaaaccaaagtttgcggaaggaagtttttgcaaagatttctcaaattacgtttctcagtaattttaatgttatacaaagatacatactataagaggagaggagagtacatatttaatactttttcacttagactactaaacaaatataaaggattatattgtcattgaaaatgttgaaaattgcattccgaacaataaatgcttttatttgctgcaaaataaagtatttttaagtcatatggaaaaagttcatcatgtaaggagtcatgatgaaaaagaagcaattattgcagagcaataaataaatggttaaactgacgcagtttcacacaatattatttctttctcctgtgttataattctctccctttgtatcacatactttttacaaaaccaaataaactgtcataatcttgcgtgaataatttgcctagctgttgtcctatcttttctgtccctttacataaggtttttctgtccctctatacattttcctgggaattacaagataaacacaattttaagctttttcaattgtgaatattcctcccatagtttctttttacacttggacttcctgacagagaaaaatatcatttttaggaatgagtctgatgatcatatcattttagcaa

SEQ ID NO: 469246 - DNA, 684 bp, Homo sapiens
agtgttttattagtttagtggacctatggctttgagcaaatcactgggcccacaaggtttcatacttgtggaacagctttcctatataggcaaggtactcggtacagcagtatcaggaaaaggatatgcactgaaatgtgtcctgacagctaaggcacagacgtattcttcctcatactgttgggtttcctggacctccatgtctgaaaccatcaccagcagaagtccttcaaatgtaattgcaaagtcagagacctacagggaaatggggatcaaaagctctcatcactccagatgctacaaagccttcccttccagatgctaccgattttactccccaggtcatctgcaagttgaggagcaaggaagccagtcgtggctcagtccaagtcccaaaacctcaaaagcagggaagccgatagcgcagcctccagtctgtggccaaaggcctgagagcccctggcaaatcactggtgcctgtgtgactccactgtgagaggacttttggatacttgtacctagtttcttgtaaagtttgctgcattcaccttttacttttgtggatttatctttgtatctttttgctgcattgaataatagacatgaatataactatatgttgagttcattgagccttcctagcaaattgccagtcctgggataagtcttagggaccactgacat

SEQ ID NO: 469247 - DNA, 746 bp, Homo sapiens
aagtggttctgagttggtccatgggtcagagctattcggcaactgctggacaataacaatggcagaaagcaattctccgcggcataggttccacacagttgaatctctttcagtggatctagatgttatgatcattaacacagtcataacagagagtcagagattaagggagcaaaagataacatttggaaaacagtcagatgacaccgtggatcctatggccatgatttcattcaaagaaataagcaaattgtcctctgacagtgatgttttagcaggaagaatagcatcttctaaagcaaaatggccggtagccacagtagccagagccagagccacatccacagccatagccagttccataaccacagccatacccacagccgtagccagttccatagccacagccagagccagagccatagccacagctgtagccagagccatagccacagccatagctggagccatagccacagccataaccagagccatagccacagccatagctggagccatagccacagccataaccagagccatagccacagccatagctggagccatagccacaggagttgccacctttatataattgccaaagcatatcattcattccctgacttagccaacaaatatttaaacaatcattatgtgccagtcactgttgatcatcaataatattttgcttaaaatgagccaattattttggagactcgagtttcatttcaggaacatcattttaa

SEQ ID NO: 469248 - DNA, 2822 bp, Homo sapiens
gtgagcagccgccactccttcggcgttggctcttgcgccggggtcgttgtttcgtgacaaccacccaggtagccgtttctgagacggcagatgcggccgctttagccctgagcgggctccgcgcctccctggacggtctctgccaaaatggcggcctggactgcctcgcactggccagtgaaggggatcctgaagaacaaggcctctacagcttcctctatggtggcctcggctgaacagcccagcgggagtgtcgaggaggagctgagcaaaaaatcccagaagtgggaagaaatgaacatcctggcgacatatcatccagcggacaaagactatggtttaatgaaaatagatgaaccaagcactccttactgtcgtaagatgggtgatggtgaagatgcgtgtagtgatacagaaaccactgaagccgtggcaccagatatcttagctaagaaattagctgttgctgaaggcttgaacccaaagtatcgggttcaggaacaagaaagcagtggagaggaggctaggacctctcacctgaagaacgagaaaaaaggcgacaatttgaaatgaaaaggaagcttcactacaatgaaggactgaatatcaaactagctagagaattaatttgaaaagacctacatgatgacaaagatgaagaaatgttaaagactgcagatggagaaagcatgaagacggaacaatcaaatcaaagctctacagcaagtgaccaacggcaaaacacattcagtaagttcatagaagagctttgttcaacactgcaactgtttgctagatataaaccctgttactataatacattgcttcttgatctccacaatttatgatttaagtatcaaaatcataccagttattatatattaccaagaattaaatgatatccttagaaactgattagactgaaaatgcctaattggtatatatatcttgtgcctagtactttaccacaaatacagtgtaatatcatcagtccaaaactgcattacttttgtaaaaacactggttaatttgtgtaagatattatatagcatttttaaaggataaaaaatatctttggggaggagaactaagttattttcatcactctaaatggggcgatacctcttataagtttgttggtttgcttttttttaaaatcaaaagacaattgaacaacaggatgtataggctgataaatattcaggccgaatagtattttaacacttgtcttcaacttgatttgtctgtttaattgaaaaggattataagagttactcttgcattttctgtcctactacctttaaagttactgttgagtttctttgtatttacaaggaaaggactgaactttttctcatcaaaactagccttttttctcacaaataaattatcagtttaaacttgcaaaaaaaaaaaattaagccaaggtagaatgtagttgtggtctgaggaaattaatgttctaaaagttgtagaatgataacagggtgtgaaaagatactgttaagtcaacttaaacatgtcctgataattgaccactggattcaggtgagcagagatgacaacagcatgtgatgtttcttcagagtagaggaagcaaagtctgattgaagtttgttggagagaggatgggaagagaaagagttcagacagtaggtacagttacactttcaatgagttttgttgaatagaacagtcaagtcaggcattagaggaagaggcagagtcaatggacttttattttttttgttgctttgtttctaagcccgtagaaactgcaatgtttctatgcaaatgaaaatgcccaaataataaggaaaacattgatcatacaggaacatgacagggaagttgccggagtaattcgctttgcaaacaagaggtaatgggatctgttgcacaagtgtagagctgagacttatataggagcatatagcttatttgttgtgggaagaggataggagtataggaaggttgatagactcgatgatgggtccatgcaggcattttcttcatttactttctactttctcagtgaaataatagccatgaatatgtatctggaagaaaaatgctctagttccatagagtggggaataattggaacagttacgcagaataatgggagagcaaattgaataaggagatagagtggtatcaccctacagccttaaggaatcccttgagttcagtggtcaggatattaaaatgagatcattcaacactgttgtgaggttttctcctttaagttcacttattcgatgatgacttagaacaggtgaccagtgaaaaaccagtgaaaacagtaaacatttttttcaggaaaataaaacaggggtgttgataatggtattgaggctttatgaacaatggaaagagattataatgagtggtcataagatattatgtgatcaattttagagtaagtgtatatagcaatgagaagaatgtatatcctgtttgcaagatgaggagttctgtatatatcgatcagaaagatagtcttcaagctctgagattcttttctccacttcatctattctgctattgatacatgtcattgcactatgaatttccaatgttatgtttttcagctccatcagatttattcacattttggtgttaatcaacactttaaaatttctgaatagtattctgctttatgggtatacaatttgtttattcatttacctgttgatggatatttggaatgtttccagtttggtgctttacaaataaagctatacaaatttgtgtataaatcttcatgtgaacataaatatctaggaatgaaatgtttagaatatatgcaagtttaagtt

SEQ ID NO: 469249 - DNA, 1057 bp, Homo sapiens
ctaagggtccttctgctgtgtgctgtctagggacttggtgccctacatcccaattgctccagctgtgactaaaatgggtcaagatacagctagggccttggcttcagaggctgcaagccccaagccttggcagcttccacatggtgttgagcctgtgggtgcacagaagtcaagaattgagggcattgatgctgaagtgagaaaaggagagagaggtattgagggaggtggagctgcctgttcacagctcaacaccgatggccttctattgagaataatgagtccaggagagagagactcagaaattaaaaaatacttgaaggtgagaaagatggcctctgtaatacagttgccaagtgagaataaggtagaaattcatccagaagtgaaaactcagctagtaagatgtttgaaaataaagaaacaaacaaaattgactgtggaacagcaaacacaaagggattttggagacttagaaacaggcagtctctagctagtcctagggagatacagatagtaaactagccaaatgaagcaggagaattaaagttagaagcttcatgagagttcagccactagaaagattttgtggaaatccaggagaaacattaaataccagtgtgaatatcgggaacattgtaaattttacttgtaaagtgttctgctaaaaacgaacaaagcaaaatgcagtgtcagtgttactactgttcttttctaaaactcatagttgtttctcaaagtagtgttttacaagattatgttccacaagtgacattggatgtgtttgtgggaaaacagttttatggttatatatatatatggaaaatactgtgctaacagatttaaataaaacagaacttgcagaaaactgttaactatctatgaggtatctaaagcagtcaaatttacagacacagaaagtggaatggtggacatcagggtctgggagaagggagaaaaggagttactttatgggtagggctttagatttgcaagatgcaaacgttctagggctattttgtaacattttaatacttgatactacaaaatgtttaac

SEQ ID NO: 469250 - DNA, 3079 bp, Homo sapiens
cccttgcctggcatagacagtgggagctgagaccaaagaagtccatttacaatggtgacaaagaataacttcaatgctcaaacgtttgtgaagatcatagaagtttcacactgtgattcaaaaaagacaactactgctcctgctgttgtttccatgcctgcatgtggggccgcagacaccaccacagatctgaaaaagttttcttttcattgtaaccatcatctccatgggtggagtgtgggaatgggtggtgatgcagtagataacagaaatgctaggggcacaggtcctggcaacccggactggtttccctggatacaagagcttccctgcttggagggactgagtcatcaaatgtgtttgaatttgttcagcctcaaaaaggatgaatgttccctgaaaaatatgagaggttctatttttagaaaaatgagcatacatatgttggtttataaaacatatatgatcagattttatccagttttagttattttacagtgatcattaggaatttgtagtaacacctctttcagctataaaaaagtatctgaaacagatcttgtttaataaattgttttaagatattgcttactatctataagaagtcatccaagaatatcaacacattctatttatctgtctttgtaataagtgaatataagtctggacctaaaggagtgttataattgctatgttcagggtatcacaatgggaatcatgtcttttcattctttctatcactcatagcacatataacggtttcttacaaataatttttgtgttctttcaggtgaagctcctttctccagatcctaaattaagcaaagtaaaaagcgaactgaatataatctttaccatagcaacttatgtacctactcactaattctacatcttgagatattttaatattgactggcgtatatcaaaagtattttcaagtttgcaaatgtaaagatacttcactaagagtatattaacctggaagttcccaggtaggaccagctaaaaattgagaaagaatagagaaaatgtcagaggcagagaaattggttgtggtcaaaaatctggcttctgagcgaagtgaccgacatcctaaatcagtgtgtaaaatatcatagaaaaaataagcttgacctgatttgctgtgatgtcttcctagggaatctgaactttaggggctgagtggatgtgatatcaacagagacttctaagaaaagacaacacttaggtggttaacaatactgttgacacttaaggtggtggtgtcaaccaccttcttagcagttctttgttaagaactgtgaatcagaccacacttgctggggagagtgtccaggaactaatgttcacgtcttgaggaaagacgataaatagagcagataatgttatttcaaagcaagcactagtttgacttagaaatggtctgagcttcagtgagggaaatgaaagacaatttgaaaattgtagtgattgcagttaggatagtgtggcttggttgacactacaggacaccaagtccctactcaagcacacagaatacagggtgtttataatcatcttgctgtgggtgaaacctggaaatgtcacataagctaagtgctttacttcatctgaaatataccatgaaagtatttcaaaaccttgatgtatagaaaaacacatcaatctcacacagagactacatctcttacctgagagagatgagacagcatgtgtctgtgaaaaaaaaatggacctagggaaccatgttgtttatcgcaacatctcctgctttgcctatcagctttggttgtaagtatctttgtaattataagtaaagcttgatattctggaaagatgcctgatttctgagattctaacttgacaatttgatgcattatgttagttcaagataacatactggctaccagctgaaataaaagcttgtaagtcacacaacgaagcatacatagctttttaatttccttataatcattctgtggcttatttttacttttatctccaatttcattactggggaagttagatttcccatgtcctacttctcttataatagcaaataagtattatatcatatttttatattatattaccaagtgaggtttttaatcaattatgtaatgtaaaaattgcagtcatttggctttatagaatggaaagaaatattacgtatatctaagttataaataggagcataaaacatatttaacattatctatgaaatccaagatggactgtcccctacctacctcttcatcattcttcctcatgcttggtgctatgttcttggagtgcactggtctcattgcacttctcatgctcatgttccttccatccacaaattctttgcaaatgaaatactctatatctgtaatgtccccttttcttatactgtttaatttttcagactagttcaagcattattacatatgcaaaaccttggaccacccaaattaattttgagcataaactattactgttatgcactctcatgggactatgcaacatgatttcatagcccatattgcagttttgcttactaactaatttattcagtacatattattgaaaactttctatgtatcatatactgttctaagctttggggatacactagtaggcaaattaaacacaataattttatgtatatatttattattatttgatccatgcttgtctttctcattagattgtttcctaagagtcattggatctttatttaaaaggaaagattgcatcagcttttggtcacccttgttaccagcctaaattaacatgtgtttaacaaattaatatattaatttaattatatataaatatatataatagaaatggcctcataatcaacttaattatcttgtttagtgttactcaggcctgccagagcaaattttttctcttgacaaattaaatgtgaccatgtatcttagtgttttcaagtttatttgaacaatccagttggctagagcaagagatcacaagatattctactctttcacttttcagatagcaaaattgtgaattgaaagaagacaaaataaaagccaaagtaagcagaacaaaataaataataataatt

SEQ ID NO: 469251 - DNA, 612 bp, Homo sapiens
ggccaggctcgatggctcaggtccttcttatagactcactgaatattgaaatcgtgtgttgggcagctgcagtaaaacatgactcagtgcccacttctcaagtttctgtgtcctgccctaaacaactgtagctcatgttgtctgctggaccaggagagagtggggcctgtgcacattcaggtacccaagacaggccacagcaccattgctctgggactgaggtgcattctgaaccacaaactcccatggctgctggtacctcccattactgcctacctggattttcttgcaggggcagcccacagtataggcttcattgccctacctgagtggtttgttgggcagcctgggagcagttcacttccccaccaaagaggattgcccgagtggcctgagagctgcctctacaaccccatcaaggtcaggacttgcacccaacccaaccctatctattcctgccatcttggtgggagaacaccaggcaataatattgaaccccattccccatccattgccagggacactctgatacttccccccatcaactaaagtcacatagaattccactgccatcagcacatatgcttgtcacttgcaagtgccaactactga

SEQ ID NO: 469252 - DNA, 637 bp, Homo sapiens
aaggcattctaagtcacaggatgagataggaggacggcacaagatgcaggtcataaagaacttgctaacaaaacaggttgcattttctgagggtgtaggctgctctcctattggagtgtcaagcattgatctccactcaacactcctgagcctctggatgcagccccggggtgccaggacctgccagtggttcatcctccagatgttacgattgtgttctgggtgtggtgggggatccaaagggctctcagattgtaggactgcactcagatggagcagactacacagctgggcagtgaagattgcactgtgtacatgctcctatggggtggcctggcagggtcccgaggaaggactggcgggcaagggaacctgtaggacaaatgtgtcccagtcttgtggggaagtggaccctgctatctccccagtatttagctgggacctcagcctgtcagagagaaataggcagccctgagcgttggggtcttatgaccaggctctgtgggagctgacacagctggcaccgccctccccaacccctgaaaagttcctggctctgtgcccactgcagttccgtctttaatctccaaggagatccccctggcagctcatacatctgaatgcctacaagttgtac

SEQ ID NO: 469253 - DNA, 728 bp, Homo sapiens
ctcaaggttcacatatatgccagactcgttgaatggttttgaccaaaatgctgttaataatatggacaatgaaatccagggagaggtggtctcagatggagatgagggacttgttgataactggagtaaaagtgactcttgctgtgttttagcaaagagactggtagcattttgccctggcgctagagatttgtggaactttaaacttgagggagatgatttagggtatctggcagaagaaatttcaaaacagcaaagcattcaagaagagacttgggtgccattaagaacattcagttttaaaagggtaacagagcataaaagttcaaaaaatttgcagcctgacaatgtgatagaaaacggcagtgtggaagggaaatgttgggttgaagcccccacaagagtccccactgtggcactgcctagtggagctgtgagaaaagggccaccatcctccagaccccagaatgctagatctaccaccagcttgcactgtgtgcctggaaaagctgcagacacttaatgccagcccatgaaagcagccaggagggaggctgtaaacttgtgtcatgggggtattaataatatatattatatagcctacacatatatgcattttatgtatgtaaattacatttatataatattctatgtaggtatacataatactacccaattaaatatacaaataatgtcctcatgtctgcagtacattgagatattttagc

SEQ ID NO: 469254 - DNA, 629 bp, Homo sapiens
actttccaaccagtcccaatgagatgaaccaggtacctcagttgggaatgcagaaatcaccctttgacttacgcaagtcaatatatgcgatacaccacataaacagaattaaaataaaaaatcacatgatcatctcaatagatgcagaaaaagcatcccacaaaatccagcatcactttatgcttaaaactctcagcaaagtcggcatacaagggacatatctcaacgtaataaaagccatctatgacaaacccacaatcaacataatactgaatggggaaaagttgacagcattccctctgagaactggaacaagacaaggatgtccactctcaccacttctcttcaacatagtactatgggtcatggggctgtacagagaagcagctctacagtatttgaacttacaccctaagcttattctggctggaagcagtagcactttaatttggaagataccaggctcctacaagatttaaaattactggagcatttcaaaattttataagctttccagtaaggttgtggctgtgattctgggcttgtaaagtaaagcacaatttaaagttaatttaaataatttaagtactgcagtcttgaggggaattgttttgtctttcaaactggaa

SEQ ID NO: 469255 - DNA, 1977 bp, Homo sapiens
caaggtgatattgcctcacaccagttaggagggctaattagttggaccaggtatgacgtttcaaggaagctggccaccccaccctaatattcttattatgcaaatgcagtctttgcttggctggtcccatgttgcccgctccttactgtatgtgtggctggcaaagagaagggaagatggagctgccatattggacatggctagctccagggatgaagccgacttgatcgtggtggataaactttttgatatgctgctggattcagtttgccagtattttattgaggattttcacatcgatcttccttgcattgggttagaacatgctcctttagctcggaggagagaactcgagcactgttctgggagatccactgccctcttcagtgctggtaggcgggaatgtttaaatctgctgaagctgtgcccaccgccgccccttcccccaggtgctctgtcccagggaaatgggagttttatctataagcccctgtctggggctgctgcttttctttcagagatgccctgcccagagaggaggaatccagagaggaggtttagggtatgatatttatggaattgtgaggggacaatggcctggcattcattttaggagtatatttcagatagatcttttattttattgcctaagagaataatacttaaaatccttaataacaatattaattatatattgctaaaatttatttgcatatgatcagagtgatctgtatgatattaaggttttaaaatattttagagactcatcttttggctgaaaaataagtttttacatgtttcataaatacttgaaaaatgttcactgactgttagagtcaagatttaaacatatccattagattaagaatgttaattatgtgcttcaaatgtgtcgcatctttctctgtcctttcttttatgatcgttgggagaataattgccaaaagctttcactatgctaccaagcatatttttcttattatgtcaccttttctgaactcttagtttgggttaagtttcttataaatgccataaaattctaactatgttctattagctaaccttctttaagtataaagtttagtgtactaatttcttggcttaaactccatatttataaatgcttatgactcaacaaaactttatcttgaagtatgcctttcctcagaattttaggtttatatatccaattgccttcctaatattacaaattagaattcacataggtatctcagcatgtacattttagaagcatactttggatcttctccatccaaaatttcagtaattttcaagtaatgtaaatggcagaatgaaacaaaacaaaacaaaacaaaacaaatgtgattgccttattgaggtggttgaggtggttgaggtggttagagagtaggtaacaaagcctccattatctcaggctggaaagctgtcaactcataaagtggcaactcttattttaagatagcaaagtagtaaaatgtttgtttaaactgttactagctgttccttcgtggtgcaaacatcatttgaagctgtagcaccaggaaaaattataggaaacattcagaccatagcaacctattgactgtttttcaaataattttattagaaatatacggatttatgccagagcaagccggttggcaaagaagaagaaaggaaattactattaataaagattgtgctcattgtctatgtccaacagtatttattgaggtatacttgacgaataatacttgtgcatatttaagtgctatcccacttgtctatttttgcatttgttgcctaggtttttggtgttatatccaaaaatatcattacccagatcaatgataagaaattttttctctaggttttcttcccttaattttacagtttcaagtcttatatttagtttttaattgagttgatttttgtatattgtgtgatatagtgtaaaatttcattcatttttatgtaaatacctagttttcccaa

SEQ ID NO: 469256 - DNA, 532 bp, Homo sapiens
tctctctccgcgccatgctgccagatcacagctcctcgccagcaatggaacaaagctggatagagaatgactttgacaagctgacagaagtaggcttcagaaagtcgataataacaaacttctctgagctaaaggaggatgttcgaacccattgcaaggaagctaaaaaccttgaaaaaagattagatgaatgtctaactagaattaacagtgtagagaagaccttaaatgacctgatggagctgaaaaccatggcacgagaactatgtgacgcatgcacaagcttcaatagtcgatttgatcaagtggaagaaagggtatcagtgattgaagatcaaattaatgaaatcaagaagagaagtttagagaaaaaagagaaatgcaaagaacaccaccaagatactcctcgagaaaagcaaccccaagacatataattgtcagattcaccaagattgaaatgaaggaaaaaatgttaagagcagccagagagaaaggtcgggttacccacaaagggaagcccatcagactaacc

SEQ ID NO: 469257 - DNA, 1386 bp, Homo sapiens
cccagagcatgtatcggaagatatgtgttctctgaacacatcttgtagtcatcctggagcacagaggggggtgtccactccagcagtgaagagcaaggaacgagggcagaggtcaggtggcatgggagagagataccccagcctacaggaagtggaagctaggctggaagtggccccaaacagcatggattctggggggagaaagtgtggtaagaagggaagcaagctggttgctgcaaagtttgatgcagggccggctccatctggtcacataacacggtccactccacacagcccatttaatacattaagaagggataaggagaaggctgtgcctggaaaagctgtcatcaccttcattgatgagccaagagcttctattcatggaacacttagaatatacctattttattttagtaacagatttcctaatatcgaatgatctaggcattgattctagcagattatgtctatgggtattttatttaagattttgcatcagtattaataaatgaccatggtctatgggtttgcttttttgtgtgctatgtttgcagagtgtttgtagtttacaagagatttttgcaaacttctatttatgacaatatggtagattatatatctgaaaaaaaaaccttctcattacagaacatatacaaaactgctgaataaaacgaggcaaccaacattttaaatatatggttaataaggttttatatctgttgtggtgtcattttttggaaattttctattgtcataaacaattatacattatctctcggttcccaaacttatttgcagacttgaagtactcttctgtgaataactcaaagtctgtgtgtctatgatcatttcctattatctttgtaaatgttgcatatttctgcttaatacttattttattaaattagtctctcatgagtgtagagtagtgttttcttgaggctacaggatatggaataacatgatgagtctgaaaaataatacgatatgtggtgatatactcttgtgttctaaaattttctcaattttaatttcaaatgtgagttcatcaatagctcctaaattgtactcacattttttctgcttattcatattccatttcaacacttatgaaataaactattgttatgagggttagctaacatttcataaattttccccaaatgttccttttggttcttttcataaatttattctttattatttttcttttatctatgcattgcttttttatacaactacccaaatattttattttctttgctaattataggggctaaaacaaacttgttaagttagattgaattgaatgaaatagatatacacatactaatacagtatttttttcctcacaaaaccagttgaattaactgggctgtcttc

SEQ ID NO: 469258 - DNA, 766 bp, Homo sapiens
ggccagagccagagccagagccagagccacagtctgaaaagaagccaactctgagccagggatgaaggaagatgaggaaccccaggacccagagatatgccaaaccaggaaatggaaatgcaaagacaatacctaagcaggggcaggacctggggacagaatgtgcccagatgcatggggaggagctgacacagttctctagagctaagcgaaatccaagaaaggcaatgggaatctttcaccggcatctaccacaagaaattaaccacatgaaatgtgaggaagtcatgatccaggacacaggaaatttacagggcacttggaaggaggaattcaatagagctggagaactagaagcaataaagacaaaacgccttgaatatgggaagtggagaggaagtcttagcagtccccgcagccagcaagcttctggggacagtgtgacaagcattccctcctgctgccgcacagtgcggctgaaccctctggccttccgaggtcaccgtgggtcctctgagagagcctttgatttaacatgtaagggaattcccactggctgattaaatatttttatattttatcatcttcctgcagctaacagcttttggcatgcagggtatttttatgaacgttataagtaaatattatggggtcagtcacagagatgaacatggatttgcaagcctagggctggaagacattaggcctcacatttaaaacaatgtgggtatggaaaaaattaaaatatcgagaacttgaaaacact

SEQ ID NO: 469259 - DNA, 476 bp, Homo sapiens
ccgaataggattgccaccactatgttgaataaaagtgggaatccttgtcttgtttcagttcttagaggaaaaaccaaaagctttattttttcccctgttcatggggatagaggccaccaggtagggcagttatcagtccttggaggggtgcatgccaggaacggcagttctgctggttgtgagagtggcactgccagcggtcctgggagtgtgcctgctggcttccctgctcttggggaggcctccctgctgtgctgtactgcttgttccttgaggtatagagcactgtgtgggctcaggtgctggggttacagctgtaccactgggtccagttgtggatgtggcattgctgcctattgtatgagtgtgatgggaagagggaagtgctccagagaagtggagatgcagaggctcttgggtcccagggaaggatgcactgtagcagtgactttgttctcaaagtaataccatgctct

SEQ ID NO: 469260 - DNA, 639 bp, Homo sapiens
ttttccatacaagagcagcaactgagtgggaattttttttttctgaggctttgagactatggaactcacagggatagccgaagttgtgccaagcgctgctgctgtagtagtgaccacatcagatgtgactcctgttgtcatgaaagttacagtagagcaggaggcaactttaaacaagtcatcgcaatgtcaattcatgtcttctaaattagcaagtccgcataaagtgtttcagtggacaccttcaatgatgagcgacgaagcccccagtcctggtagtttcggcagctctctgatgcccttcagtagggttttcattacaggcaggagtagtgtttggctgcaaactccttacagccaaggacttctgacagcaaacccagggcttttcccaggattgtcacagctaagcgtccgctcaggggatcctgagctaatttgcactgatgacagtggaaagcaggcaaattcatgtagaggactttatctctctgtgggcatgtttcctctgttttagactttaaaaagccctgagctcaaagcctgaagccttgtccaactcaaattgccttctctgaggtgagaagatttttgcagggtgggagaaagggggacttttttttccctatcctgaaatgt

SEQ ID NO: 469261 - DNA, 589 bp, Homo sapiens
gccaattccctgtaacacgtaactgttcattttatctaaggtatgccgagcctcttgtacatggtgcatttcgatggcagagtcgagcttaacttcatgattcattatttcactcggaagaatgaagaagccggtagggctagagcagaaagagctgcaggaaaggctgcagagaaaagctcagaaatgcaagaaatggtggtgggagcaatggataaagctgatgaaagcagttgtgttccagatacactggacattgatggttctctgggggaacctatgtggagggtcagaaaaggagccaagacaaatcgatggtccatgaagctaagaggctggagtctgaatagaggagagattaaagagctatgcccctgcctacttaaacatttacagtttatagctatgaaaggaaaacagcaaagaagactgaaaaggaacagctagaaaagcagtgtgaaaactggtcaagtcctggaaatgaagaaaagaaaattattcacaggatccacacagttaagtgctgcaggaggtcaagtaatatgataactgagaattaaccattgggtcggtcaatgtggaggtcatc

SEQ ID NO: 469262 - DNA, 717 bp, Homo sapiens
acctggatcctggtggcctgccagctgttacccatcacatcacaaacattaccatcttatatggtactctccttaagacaaaatgtgagtctggggcttcattcccgaagtcagcaagaccacgaacccacagggaggggcaaacaccttttaaagagttgtaacactcaccgcgaggtccgtggcttcattcttgaagtcggtgaggccaagaagaaactccggacacatctgaagaaaccaagtccggacacaatgggttctaagaagtcagtgacaatttttaaattggagagcagcgagagaagcacgtgcagtaagcctgactgcaaggctgttaatgctgaaaagaaaggaagagcaagcaaattattacgtgcagagagcccagaaagctcctctttgctggaagtcagacctgaaaacaggaaagagatgaccgaactgagcatgcccagttctttctcccaactcctccgtcagatattgggtcaatttgttacttagtatgtgcaaatcttctatactttattaactttttgtccgctggttgacatttggttctctgattgtggctttatctactttcccttttaattcagtgatttttttccttatatattttgaggctatgtttttagaaacataaatctagaattgttatatattcttggtgagttgcccattttatcatgataaagtgtttttcttcatgtc

SEQ ID NO: 469263 - DNA, 788 bp, Homo sapiens
gtaatgatgatagtagtagtagtgatgatgatgatgatgatgatgcgatgatggcagcttgctccatgtcaagtactgctcaagtgccttatgcagagtaacacacttacccctcacatcaaccctctgagtccccagttgtcctctgtctctagaacctgcggttgctgcaaggttgcctccagctggaaggagcatcccttaatgtccaatcaccctctttcccacttgatggaagatttctactgatttatttatgcatttctactttatgaccttctttagtctaggtggaattaactttacccttgcttgggacaataagccttggaaatttaataggatatatttcagaaacactgttctcaatgtctacagggggcgagatatggtgccaaccacaagacacatattattagatttgctcctgctaaaaactaataataaactcattttacagtctgtgtttgagggctttttcctgttgaatgagcgtcttctctgtactcctctgatgcaagtcaaagccacaaccatgggccagtgctggatttcagagaaatgtgatgtaggtgtttatggcaatgctggtaataaccatgactcatcttccaagacagacctactatgtggggtagaggagaagagtggtttagagtcagagacctgagttagaatattgtctgtatgacttaatgagtagtatgacctttcttagtttcttaatttggaaaatagtgaacataatatctcctttatagcttattgtgaaggttatgtgtatagta

SEQ ID NO: 469264 - DNA, 729 bp, Homo sapiens
gagaaacttgtgtttcaaatactgatctgaaaatgtccagcatctggttttccccactggcactccctgctcaatgctaccaccaccatgttcagacagccactcctgatgtcgttgttgattgcacaccaatctgcagatattgtgggttgtaatgaacagcaaggcagaagagaccaccaggggaatgacggttgcaggagggcccctggagtctctaccctgaaagctgagcttgccaagtatgaatgtggcccttgtcctgagggatggcgcacaaggcaagttcctaaacagtcctgtgtaaacagccatgaccttggaggattctccttgcacgttgctagccatgagagtacaggagcctgcctctggaacccagggaaattgcctccggtgaacacagcttttacacaagcccagctttactgtgcatcaagaacagttgtttccaatcagccagagattccaggacccctgcctggggccgccttcactcagcaggtttacgaaggctgaagatggtaaacacaggttaggcaatatgggtgggcattatatagtcatggtttttgattagagcttttattagcttttgatattaatatgatataattatataatatgtatttatataattttttatatatttatttatatatttattatataatttatatattttttataatcagttatataatacatatttataatgtatagtaaata

SEQ ID NO: 469265 - DNA, 530 bp, Homo sapiens
tgaagctcatcagacccaagccatgggcgggcctagaagagtcaccacgaattcccactcccgccagagaaaatggcagcacagcccccagccttcaggtgctccctggcctgagggcgaggccttactggggaccctgcccccttccgcccaggactctatcttcctcctgctgccattcatggtcctggggcttggttccaaccctgctccgagatcagagtgggtgtggggagtggagagaggccaggcagtgagagcagacacccctgagcctgcagggacaggtgctgcgggtgctgcagctgcagctacacctggaagggcagatcctacttgttcccagctctcccaagagtacagggaggctcggatccattgctgcattttgggcggctgcagccctgcccaggagggtggggcttctgcctgctcggtggagtagagcaggaggcctggatctgcagggaagcaaaagttacagccaaaaccgtaaatcaatacatggaggttatacactagtttagccc

SEQ ID NO: 469266 - DNA, 2160 bp, Homo sapiens
tcacacttcaacatgagatttgagcgaggacaaatatccaaactatgtcaattagtaatgtttcagagtctttgtgtggaactgaacgcagtttgtaaggctggttgggaagtggtggaagagaaaatggttattattagggataaaagtgctcctacattttttcctacacttgatcctgaaaaagtggagtcattgagtttggagatttcaagagactcattaatcatgttaagaattaagtttcatttagtacatgctgagaaattggggataatagaagagtcaagggccattaggcatgagactctgggcaggttgagttccttaaagagtttggctagtttgaatataacggtaccactggcctgcttgtttcattttccagaggactgcggcttctgcggctccaagccagcgggtcctgtgaaggcgagcagacgcggagaaaggacgcgggagtgagagaggctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtaccagaacttatg

SEQ ID NO: 469267 - DNA, 713 bp, Homo sapiens
gcacagcacctactcacttcagagtttaggcttcagtaccatttatgtccctgtttctgcttcacctctgccatgagtaaaaagctccctgaggcctcccaagaagaaaagcagatgccagtggcatccttttatagcctgcagatctgttttggatttcttcatagttcaatcttggatggtgagttctcccaggccccaggcaggtccagagatgctgtctgggagccagggattgcagtaaaaaccttacaagaagtctaccttgtgtcttattctactgtgactaggctggcacccaaaccacaagacaaaatccttcacactcttccctcccctttccacaagcagaggggcctctccctatggcctctgccaccactgacccatggcgaattctgtcagaccaccactagtgttcacttaaggcccaagggctcttcagtcagctgtgacaaatgttgccaggcctggaactcacccctcagggtagtgaaatcccctctggcacagtgcaggtccagaaatgctatccaagagcctggacctggggaccccaagagcccgttggtgctctacaccatggccaagctgatacctgaggctggcatgtccgagtctcactcaaggtccacagcatactgcctgtgcatcgctgttggttactcagggcccatgggctctttagtcagcaggtgatgaaacctgcaaga

SEQ ID NO: 469268 - DNA, 908 bp, Homo sapiens
gattggaatggaatggaatgcaatggaatggaatggattcaactggaaaggaatcaaatggaacggaatggaatggaatggaatggaatggaatggaatggaatggaatggaatggagtggaatggaatggaatcaatggaatggaatggaatggaatggacaggaatggaatggaacggaatggaatggaatggaatggaagagaatggaatggaatcaacccgagtggaaaggaatggaatggaaaggaatggaatggaatggaaaagaatggaatgcaatggaatgcaatggtatggaacggagtcaacccgagtggaatggagtgcaatggaatcgattgcaatggaatggaatggaatggaatggaatggaatggaatggaatggaatggaataaaaaccggtggaaatgaatggaatggaatggaataaacccgagtgcaatggattggaatggaatggaatggaatggaatggaatggaagggaatggaatgaaatggaatggattggaatgaaatgaacacgagtggaatggaatggaatggaatggaatggaatggaatagaatggaatggaatcaacccgagtggaaaggaatggaatggaaaggaatggaatggaatggaatggaatggactagaatggaatcgaatggaatggaatgtaatggaatagaatggactggaaaggaatggaatggaaggaagtcaacacgattggaatggaattgaaagcaatggaagggaatggaatcaactggaaaggaatgaaatggaatggaatggaatggaatggaatggaatggaatggaatggaattaacccgaggggaatggaatggaatggattggaaagaacacgagtggaatggaatggaatggaatggaatggaatggaacgggac

SEQ ID NO: 469269 - DNA, 946 bp, Homo sapiens
tggaatcaacccgagtggaatggaatggaatggaatgaaacgacgtggaatggaatggaatggagtgaaatcaacccgagtggaatgcaatggaatggaatggaatgcaatggaatggaatggaatggaatggaatggaatggaatcaaaccgagtagaatggaaaggaatgcaatggagtggaaaggaatgcaatggaatggaatggaatggaatggaatcaaccggattggaatggaatggaatggaatggactggaataaacacgagtggaatggaatggaatggaatggaatggaatggaatagaatggaatcaactcgagtggaaaggaatggaatggaaaggaatggaatcgaaaggaaaggaatggaatgcaatggaatgcaatggtatggaatggagtcaacccgagtggaagggaatggaatggaatggaataaaatggaatggaatggaatgcaaaggaatggagtggaatggaataaacaccagtggaatggaatgcaatggaatgcagtggaatggaataaacaccagtggaatggaatggaatggaaaggaatggaatggaatggaatggacaggaatggaatgaaatggaatggaatggaatggaatggaatggaatggacaggaatggaatggaatggaatgaaatggaatggaatgcaatggaatggaatggaatggaatggacaggaatgtaatgtaatgtaatttaatgtaatggaatggaatggactagaatggaatggaatggaatgaaattaacacgattgaaatggaatggaatgcaatggaatggaatggaatcaaccggaaaggaatgaaatgtaatggaatggtatggaatggaatggaatggaatggaatcaacccaagtggaatggaacggaagggaatggaatggaaaggaatggaaagcaatggattggaatcaacc

SEQ ID NO: 469270 - DNA, 1319 bp, Homo sapiens
gactggaatggattggaatagagtggaatggaaaggaacggcatggaatgcaatggaatcaattagaatggaatggaatgggatggaatggacaggaatggaatggaaaggaatggaatggaatggaatggaatggaatggaatggaatcaacccgattggactggaatggaatgcaatggaatggaatggaatcaactagaaaggaaacaaatggaacggaatggaatggaatggaatggaatagaatagaatggaatcaactcgagtggaaaggaaaggaaaggaatggaatggaatggaaaggaaaggcatggaatgcaatggaattcaatggtatggaatggagtcaacccgagtggaatgtattggaatggaatggaattaaatggaatggaatggaattcaatggaatggagtggaatggaataaacaccagtggaatggaatgcaatttaatggattggaatggaatggaatggaatggaatggacaggaatggaatggaatggaaagaaatcaacctgattggaatggagtggaaggcaatggaatggaatggaatcaattggaaaggtatgaaatggaatggaatggaatggaatggaatggaatggaatggaatggaatggaatggaatcaactcgagtggaatgcaatggaatgaaatggaatggaatggaatgtaatggaatcaaaccgagtggaatggattggaatggaatggaatggaatggaacggcatggaatgaaatggaatcaactagaatggaatagaatggaatggattggaatggaatcgaacggaatcaacctgagtggaatgggatggaatggaatggaatgaatggaatggaatggaatggatactattggaatgtaatggaaatgaaacaacccgagtggaatggaatgcaatggattgcaatggaatggaagggaatggaatggaattcaatgtaatggaaaaaaaccgagtggaatgtactggaatggaaaggactggaatataatggaatggattgaaatcaacccgattccaatgcaacggcatgtaatggaatggaatggaatggaatggaatggaatggaatggaaaggaatggaatcaagtggaatggaatggaatggattggaatttaatgaaatggaatgtaatggaatggaatcaacccgagtggagtggaatgcaatggaatggaaatgaatgaaatggaatggaacagaacggcaaggaatgaacccgagtgaaatggaatggaatggaatggaatggaataaacacgagtggaatggaatggaatggaatggaatcaaccc

SEQ ID NO: 469271 - DNA, 1500 bp, Homo sapiens
ggccgaataggaacagctcgagtctacagctcccagcatgagcgacgcagaagacgggtgatttccgcatttccttttgaggtactgggttcatctcactagggagtgccagagagtgggtgcaggacagtgggtgaagtgcactgtgcactagctgaagcagggcgagtcattgcctcactcgggaagtgcaaggggtcagggagttagttccctttcctggtcaaagaacggtgtgacagacggcacctggaaaatcgggccactcccaccctaacactgtgcttttccgacgggcttaggaaacggcaccccaggagattatatccggcacctggctcggagggtcctacgcacacggagtctcgctgattgctaacacagcagtctgagatcaaactgcaaggcagcagcaaggctgggggaggggcaccggctattgcccaggctctcttaggtaaacaaagcagccaggaagctcgaactgggtggagcccaccacagctcaaggaggccgtcctgcctctgcaggctccacctctgggggcagggcacagacaaacaaaaagacagcagtaacctctgcagacttaaatgtccctgtctgacagctttgaggagagcagtggttctcccagcatgcagctggagatctgagaatgggcagactgcctcctgaagtgggtccctgacccctggcccccaagcagcctaattgggaggcgccccccagtaggggcagactgacacctcacacgaccgggtactcctctgagacaaaacttccagaggaacgatcagacagcagcattcgcggatcacgaaaatccacggttttgcagacaccactgctgatacccaggcaaacagggtctggaatgggcctctagcaaactccaacagacctgaagctgagggtcatgtcttttagaaggaaaactaacaaacagaaaggacatccacaccaaaaacccatctgtacatcaccatgatcaaagaccaaacgtagataaaaccacaaagatggggaaaaaacagaacagaaaaactggaaactctaaaaagcagagcgcctctcctcctccaaaggaatgcagttcctcaacagcaacggaacaaagctggatggagaatgactttgacgagctgagagaagaaggcttcagacgatcaaattactctgagcttccccaatccagcaaagcaagccaacattcagattcaggaaatacagagaacgccacaaagatactcctcgaggacagcaactccaagacacataattccaaactaagcttcataagtgaaggagaaataaaatactttacagacaagcaaatgctgagcgattttgtcaccaccaggcctgccctaaaagagctcctgaaggaagcactaaacatggaaaggcaaaatcggtaccagccactgcaaaaacatgccaaattgtaaagaacatcaagactaggaagaaactgcgtcaattaacgagcaaaataa

SEQ ID NO: 469272 - DNA, 5176 bp, Homo sapiens
tggaatggaatggaaagaatggaatgcaatggtatgggatggagtcaacccgagtggaatggaatggaattgaatggaatgaaatggaatggaatggaatgcaatggaatggagcggaatggaataaacaccagtggaatggaatggaatgcaatggaatgcaatggtatggaatggagtcaacccgagtggaatggaatggaatggaatggaatgaaatggaatggaatggcatggaatggattggagtggaatggaataaacaccagtggaatggaatggaatggaatggaatggaaaggaatggaagagaatggaatggaatcaacccgagtggaaaggaatggaatggaaaggaatggaatggaatggaaaggaatggaatacaatggaatgcaatggtatggaatggagtcaacccgagtggaatggaatgcaatggaatcgaatgcaatggaatggaatggaacggaatggaataaacaccagtggaatggaatggaatggaatggaatcaaccccagtgcaatggaatggaaaggaatggaatggaatgaaatgaacacgagtggaatggaatggaatggaatggaatggaatggaagagaatggaatggaatcaacccgagtggaaaggaatggaatggaaaggaatggaatggcatagaatggaatggacaggaatggaatggaatggaatggaatggaatgaaatggaatgaacacgagtggaatggaatggaatggaatggaatggaatggaaatggaatggaatggaatggaaaggaatggaatggaatggaatggaatcaacccgagcggaatgcaatggaatggaatggaatcgaatggaatggaatggaatcaacccgagtggaatggattggaatggagtggaatggaatggaatggcatggaatgcaatggaatcaactagaatggaatggaatggaatggattggaatggaatcgaacggtatcaacctgagtggaatggaatgaatggaatggattggtatggaatggacagtaatggaatggaatggaatggaatggaatggaatggaatggagtggaacggactagaatggaatggaatcaactcgagtggaaagcaatggaatggaaaggaatggaatggaatggaatggaatggactagaatggaatggaatggaatggaatggaatagaatggaatggactggaaaggaatggaatggaaggaaatcaacctgattggaatggaattgaaagcaatggaagggaatggaatcaactggaaaggaatgaaatggaatggaatggaatggaatggaatggaatggaattaacccgaggggaatggaatggaatggaatggaatggaatggaatggaatggaatggaatggaatggaatcaacccgagtggaatgcaatggaatggaatggaatggaatggaatcaacccgagactggaatgtaatggaatggattggaatcaacccgattacaatccaacggaatggaatggaatggaatggaatgtaaaggaatggaatggaatggaaaggaatggaaagaactggaatggaatggaatttaatggaatggaatggaatcaacccgagtggagtggaatggaatggaaaggaaatgaatggaatggaatggaatggaatggaacggaacgaaatggaattggaatggaatggaatggaatggaatggaatagagtggaatggaatcaactcgagtggaaaggaatggaatggaaaggaatggaatggaaaggaaaggaatggaatgcaatggaatgcaatggtatggaatggagtcaacccgagtggaatggaatggaatggaatagaatgaaatggaatggaatggaatgcaatggaatgcaatggtatggaatggagtcaacccgagtggaatgcaatgaatggaatggaatggaatggaatggaatggaatggaatgaacaggaatggaatggaatggaatggaatggagtggaatggactagaatggaatggaatggaatgaattcaacccgattggaattgaatggaatgcaatggaatggaatggaatggaatcaactggaaaggaatcaaatggaacggaatggaatggaatcgtatggaatggaatggaatggaatggaatggaatggaatggaatggaatggaagggaatggaatggaatcaaccccagtggaatggaatggaatggaatggattataatggaatggaatggaatcataccgggtggaatggaattgaattgaaaggagtggaatggaatggaatggaattcaatgtaatggaaacaaaccgaaacgtaatggattggaatgaaatcaacccgattggaatggaatggaatgcaatggaatgtaatggaataaactggaaaggaatcaaatcgaacggaatggaatggaatggaatggaatggaatggaatggaatcaaccccagtggaatggaatggaatggaatggattataatggaatggaatggaatcaatccgggtggaatggaatggaatggaatggattataatggaatggaatggaatcaatccgggtggaatggaatggaatggaatggaatggaattcaatgtaatggaaacaaaccgagtggaatgtaatggaagggaaaggactggaatgaaatggaatggattggaatcaaccctattccaatgcaacggaatgcaatggaatggaatggaatggaagggaatggaatggaatggaatgcaaaggaatggaatgaactggaatgaaatggaatggaatggaataatgcaatggaatggagtggaatcaacccgagtggaatggaatggaatggactgtaatgacatggaatggaatggaatagagtggaaccaaaccgagtggaatggaatggaatggaatggaaacgaatggaatggaatcaacccgagtggaatggactggaatggaatggaatggaatcaacccgagtggaatggaatggaatggaatggaatcaacccgagtgcaatggaatggaatggaaaggaatggaatggaatggaatggaatagaatggaatggaatcaatccgagtggaaaagaatgaaatggaaaggaatggaatggaatggaaagaatggaatgcaatggtatgggatggagtcaacccgagtggaatggaatggaattgaatggaatgaaatggaatggaatggaatgcaatggaatggagtggaatggaataaacaccagtggaatggaatggaatgcaatggaatggaatggtatggaatggagtcaacccgagtggaatggaatggaatggaatggaatgaaatggaatggaatggcatggaatggattggagtggaatggaataaacaccagtggaatggaatggaatggaatggaatggaaaggaatggaagagaatggaatggaatcaacccgagtggaaaggaatggaatggaaaggaatggaatggaatggaaaggaatggaatacaatggaatgcaatgaatgcaatggaatggaatggaacggaatggaataaacaccagtggaatggaatgaaatggaatggaatcaaccccagtgcaatggaatggaaaggaatggaatggaatgaaatgaacacgagtggaatggaatggaatggaatggaatggaatggaatggaagagaatggaatggaatcaacccgatggaatggaacggaagggaatggaatggaaaggaatggaaagcaatggattggaatgaaccgaatggaatggaatggaatggaaaggaatggaatggaatggaatggaatcaactcgagtggaatgaaatgtaatggaatggaatggaatggaatggaatggaatggaatggaatggaatggaatcaaccggagtagaatggaatggaatggaatggaaaggaatggaatggaatggaatggaatggaatggaatcaaccggagtggaatggaatggaatggaatggaatggaatggaatggaatagaatggaatcaattcgagtgcaattgtaatggaatggaatggaatggaatgaatggaatggaatggaatggaatggaaactactggaatggaatggaaaggaaacaacccgagtggaatggaaggcaatggaatggaatggaatggaatggaattgaatggaatggaatggaatggaatggaatggaaagaacccgattcgaatggaatggaagggaatggagtgaaatggaatggaagggaatggagtgaaatggaatggacggaatggaatggaatggaatggaatgcaatggaacggaatggaatggaatgcaatggaatggaatcaacccgagtggaatggaacggaagggaatggaatggaaaggaatggaaagcaatggattggaatgaaccgaatggaatggaatggaatggaaacgaatctaatggaatggaatcaactcgaagtggaatggaatggaatggaatggaatggaatgaactcgagtggaatggaatggaatggaatggaatggaatggaatagaatggaatcaactcgagtggaaaggaatggaatggaaaggaatggaatcgaatggaaaggaatggaatgcaatggaatgcaatggtatggaatggagtcaacccgagtggaagggaatggaatggaatggaataaaatggaatggaatggaatgcaaaggaatggagtggaatggaataaacaccagtggaatggaatgcaatggaatgcagtggaatggaataaacaccagtggaatggaatggaatggaaaggaatggaatggaatggaatggaatggaatggaatggacaggaatggaatgaaatggaatggaatggaatggaatggaatggaatggacaggaatggaatggaatggaatgaaatggaatggaatgcaatggaatggaatggaatggaatggacaggaatgtaataatggaatggaatggaatgaaattaacacgattgaaatggaatggaatgcaatggaatggaatggaatcaaccggaaaggaatgaaatgtaatggaatggtatggaatggaatggaatggaatggaatcaacccaagtggaatggaacggaagggaatggaatggaaaggaatggaaagcaatggattggaatcaaccgaatgaaatggaatggaatgga

SEQ ID NO: 469273 - DNA, 1244 bp, Homo sapiens
ggagagtacatgctgattggcttattctcaggatcataaacatgcctagggcatctcaggtaataggagttatttgtaaggaagcaagaactgaggttgctgtaaacccgtacggattcgccgctggtaactcagatacattccactgggacagctggaaccaggtcacatgtggtcaggactctttcccctcttgtctccatccacgggttgacttcaccatctcagactcatttcctcctgagtatggagtatgggacactcagcgacagcagttttcaagcttacattattccagttttatcactttccatggttgcaacttgaaaaattgggagaagtcctccagtcggctcagctcgtgtgaagtgtccttctttgggccaattaccagttacagcatagtgaaacttcaagaactaggtttttctggaccatcccagtgcgcatgaatcagatttaaaaagaaagaaacatacaagaaatacataaatcatactatatgacgatagcccagaagattgcatggaggatctttgtgtttcctgtagaagaaaagaaaaatggaatttccatctcttgcatcagcacttgacagctggagttattgttgaccaggcatcaagaaaggagggatatgcatcagaaatcattttgcctgaaataagcacaactccatggaggacaatgacacattttctctggtgatcttgtaattggggatgatgtaaacatgagtctaatctgcattttgtctaagaaattcttcatcatgagcatcttccaataaaacgtggttccttacaacatgagtttgcatgacaacttcttaccacttacttcatgtcacacttatataatggagactcatgtctcaatgaacgctttccagataaacagaagcacttctccaagagtaataaacacctgccatacaggttgctaagagctcaaataaagataaatttgttggcttgacccaaacgttctctggatctcaaattaatctaatgttatcagacatttggcactttctctatctcaaccaaaaagaccagtctttgatcatggtctcatcactctttttcaagaagtaattgttatttttcttcctggtgttcacgtgctgcttcagtagggtacatcatgatctccaaacgtagcacccaaactcgaacagaatataattcccagtcaaattgaatgtttgcttcttggaattactgttaatgaatataacacaa

SEQ ID NO: 469274 - DNA, 1612 bp, Homo sapiens
ttgatgggtgccacgggccagcatggcacacgtatacctattggcacctggaacaccagtgagacagagccgtttacttccccggaaagggggctaaagccggggagccaagcagtctggctcagcgggtcccacccccacggagcccaacaagctaagatccactggcttgaaattctccttgccagcacagcagtctggggtcaacctgggacgctcgagcttggtcgggggaggggcgtccaccattgctgaggcttgataacctgtgcagggggagcctctggtggggccatggtctcaaccaggatatccgggagactaagacgtctgctgagcactcccggtgtaccttgggaccaccacagaaagcaaaagagttggaactggttccaggccaaccggccaaccaacgctcccaaacccgaagggtcaggggttgtcacagagcccttttccggacagcctgacacctgtgtctttagtccggtggccgtgctaatcgcctttaagtggccaacagatgagaaggatgagcccattgaaataccatcggaagacgatgggacggtgctgctgtccatggttacagcccagtttccaggggtgtgtgggcttcgctacagaaatccagtgtctcagtgtatgagaggtgtccggttggtagaaggaattcttcatgcccccgatgctggctgggaaatctggtatgagctgcggcagttcttctgtcagtacggggaagtggtggatgtcgtcatcctcaagccattcaggacgtttgcctttgttacatttgcagatgatcaggttgcacagtctttttgtggagaggacttgatcattaaaggaatcagcattcatatatccaatgccgaacctaagcacaacagcaatagacagaaagaagtggaagatttggtggtaatccaggtggctttgggaatcagggtgaatgtggtaatagtagagggggtggagctattttgggaaacaatcaaggtagtaatatgggtggtgggataaacttgggtgcattcagcataaatccaaccatgatggctgcagcccaggcagtgctacaaagcagttggggtatgatatgcatgttagccagccagcagaaccagtcaggcccatcgggtaataaccaaagccaaggcaacatgcagagggagccaaaccaggccttcggttctggaaataactcctatagtggttctaattctggtgcagcaattggttggggatcagcatcaaatgcagggtcgggcagtggttttaatggaggctttggctcaagcatggattctaagtcttctggctggggaatgtagacagtggggttgtggttggttgatatagaatggtgggaattcaaatttttctaaactcatgataagtatattgtaaaaatacatatgtactaagaattttcaaaattggtttgttcagtgtggagtatattcagcagtaaggaggtatacctaatgtaaatgacaagttaatgggtgcagcacaccaacatggcacatgtatacatatgtaacaaacctgcatgttgtgcacatgtgccctagaacttaaagtatacatatacatatgaagagct

SEQ ID NO: 469275 - DNA, 718 bp, Homo sapiens
ataaggggtttgagcaacagcagtggccagagaagccacacccctgtcacacgtcttgcaagggggatcagggaaccctctctcctttgctatctgaatgatcaacttgtcttctattgtcaatgacaccttccctgctctgtatctttactcactgagtgttcttcatcttctccctagtgagggtttttgcatttctaaaaaccatacagccccacctggacctgccaaccaggaactgactcagcctgtgctattcggctataattcatctttggggaaaagggattccagatgtaaaggtcaaaccactcggaagctgcgttggcatctaacagagagattctgtgtcctgggacatctaccaaaccctccagtgaaagttattggtggagaaagaaagagaggcgttaaatgggaagaaggaatgaagactttactgtgtaaatcggagctggttcctctcgctaaaggcaagggctgctcagttctgggccctctccagtgtctccctgcgtcctccccatacagagtcaggcaccccttcctcttcgagacaaacctggaggaaaagaaaatgcactattcggagttgcaggcggtgatataacatccctcagaggctcattctgacaactcacaaagacttgtgtgaaaaagaaattcctttgataactgcttgtctggagatgactgacacctttcaaaggaaatgagg

SEQ ID NO: 469276 - DNA, 1424 bp, Homo sapiens
gtcctcctcctcagcctactcaacatgaagacgatggggatgaagacgtttaagatccactttaatgcaacgaataaggagtctgcagggccggtagttcagaggcttctgtatgcaggcctattgtggtggtgtcctagtaacaaagcagggtcacaaactggaaagatgagcactctctctgctgcttccagaacacagtgtgcagctcaaggcagcaccgaagggaggcaccaggtgccaacagaccacctgtggatacgccgtctagggctccccaaacaattgctgggggtggtaaagcccattactctcagcggagacctagcagaacttatgaagacaacagagaaatctgttgaagtaactaaagcatctttagagaatgagaactatagatattttgacatattactattttataaggttatctccacatctaattcatcaacatcatattctaccttcaaaacagattttaaatctgttgactttgttgctgcgaacaccgctcaatcctagttctaccctctgcttctgttccaatctaggactaccagtaattaactccctgtttctacaatgtactaaatagcagtccaagtggtcttttaaagcacaaatggaatcctgtggcttccaggattaaacccgtttcagttctttggagtgctaattgccacctgctatgtggaagaggacacccgtgacagctccatcttccttctagtaccctagcagtaaatggtgttcagtgcaaatttttacacgtatgctaaaatgaccacaataattctttaattgtgtttggagttttacagagggtatgtattttcctatataattatatttatttttgttcatgttaggatctgagctagttttaataaatatagatgatacacatgaaaggtacaaagcaaatagtgtgtgttttcagatggtccgtgttttaattttagttttagagagatagaccatacacacagaatatttaatattattcatacagtttaaaagtaacaaaacaaaatacaataatacagcaaaatatcaattttgaatgtccttgtaaatacctccataatctcatccctttcttctcccctttacaagataactattttgagaaacaacttcaggcttgctattaggccctacacatgacatcagcaacttattataactatcataatgtatttgttgtctgattcagtaatacgctgtagcatgtgtgtagcagcattctatcaagtgtaggtggtatatgtactccagtcaatcatagattcagtctttctacacagtcctgtatttctcagagctttgttcattccttttctttctttgttctctaatcttgtctgcctgccttatttcagcaagatggtcttcaaactctgatattctttctcttgcttgat

SEQ ID NO: 469277 - DNA, 2400 bp, Homo sapiens
agctgagaggagagttaaggctctctggtcattatatccctgaccctacctgcaacttaccctcccgttactcccaggtatgggtaaaagtccaggttccacctctggtttctattcatacctgatggctggtggaggaggactgctcattactgccgggtgggggtgggagttccagctcttcactaggtctccaacgttaccttctcaactaggagggatacgtgtgcctcattactgctccccacatggggtgtatgtccctttattgctaggagagtcaggaccctcatctggaggtctgttggaattttctggaggtccactccagaccctgtttgcctgggtatcagcagtggtggctgcagaacagtggatattggtgaaccgcaaatgctgctgcctgatcattcctctggaagtttcgtatcagaggagtacccggccgtttgaggtgtcagtccacccctactgcttctttgctggaggcgaacgtttggatcaaggacaagcttcaacacctacccctcctcaggatgcacagtgcatagttagtaaagccaaaaatgaaattgatgttctctttcataaaatgccattcttgttctttactccctaaataactaaagtaaagaactttactccctaaagaactaatttattattaaaatattcagaatctcatctatagatttggaaggattgcaaatatcaaggatccaataactaacatattaacagatcattaaagcagctggtagaaatggagagaaaacaattgtagaagccaaatttggaggtcaagaatgtgaccaagtttctatatggcacattttcctgataattgactgttgttcttaccatattgccctaaaatgcttcctgtgactgataattgacattatggtggcatgtgaggggcttagagaaaatgtcacactgttccagggcttaatcttgctactgggccttcctatagtatcccattctccacacttgtaggaataaacaacaaccatacaggttatcctgggagttgcctaggaatgttgagaaaatacagaaataaaatctattaaaaccataaggaactttggacctggaaaatgatgtcttgattttgtgcattggcatcatggcaaaattaaacttagcatcatgtagccaaaggaaatattaatgagaagtcgttacctaataatacttgcaaagtcttgataggtattgaagggggaatggaggggagagcatggtccttgtccagggcataatagcaataaaagggctagcaaagcatgcttttagagaatattttgtattagcatgaggttaattacctctttcaggacattgacagaaagaacattaataagaacagagaagcagagaagccttggaaatcatgcttttatctgaatggaggaagaaataaaaggagaggtaaaatgaaatcttgccacactgcatgctccctcttctctttgttcctgtccatttctaatattaaaataagaacctttcttaactaagtatgcttcaatcacattgcagaatcttttcatgtttatcctgaatctgaagacgtgggagaattagaaatgattcactaaaaactggatccagtccagcacacccaaagcagagtgttttagagtctttccagattgagagtggatagagtgtagccatttattactttttattatggaaggcagtaatctgtaaggtccatcctgactaaaataggttctttttctccctttaaatagaatgccaaatagaattggcagtgcttccttgaaagttaattcaaatgtacgtaactattttaagggctatattgatattacatatactttctgaacaggatagctagaccacataataatgttgcagtatttataaaagtactttagtataatagcgtatgtttatggaacactacttttagtcaggcactgttctaagccttaatacgtattaactcatttaatcctcgtaacaaccctttgttgttattatcattcctcttgtataaaatataaaactaagcacagagaagttaaggttgccccaaattacacagcaattatgtactagaggccaggatttagcacgagcagtttgattccagaacccagtctcttccatgcccttctgctgctctggacacacattacctgtatctaacttataacattccttcttctattgtaatagatttcttgatcaatggatttcccatttatagtcggtaattgtgattgcagtactgcttattctattctttttcctgcctgggggataaattcatttcaaattataacataataaaatgtacatatagtaaatatggctggaatataccaggaaacaagcagttttgccatcaattatgta

SEQ ID NO: 469278 - DNA, 2014 bp, Homo sapiens
tgatttacatttggctccttgttacttatgtccctcccacaacacatgggaattatgggagctacaattcaagatgagatttgggtggattctgccaactggcttcatttccagaagattttagagtgtcaatgttcagctcacaactcctggactgagtgctctaactatggaggacttgtaacaggctctgactttgttctctggctccctgaggttagaaatacactgtactgttggtgccaagggcccctgctggcaactgtgcacccagtcttgctgttggtggtgttggtacagagttggggagctggcgggttcaggtctgtgtgcgctttctgtgtcccgcagattcccccacaccaaaccctctgggctccatatcagctggcttgctgcccctatcacttctctaagcagctctccctgccaagtcaagtgtccatggtgatcgagcggtctcctcctgctgtagttccagaggcctgtggcaagagcggaagggccagtcacaaagacagaggacatgagcagagaagcgtgactggggaaaagacatgttttggacttcatgaattttgactatctctgagagagctgagtgagggtatgtgattggacgtccgatgcacaggtatggctttcagagagagaaacacagttatgcactacataatgacattttagtcaatgactaaaatgcagagatgactgtggtcccctaagagcatagtggagatgaaaaatttctgtcacctagtgatgtcatagctgttataatgttgtagcataacatattcccttttgtatatttagacatgtttacatacacaaataccattatattagttgcctacggcattcagcacagtaacatgctatgcaggtttgtagcctagaagcaataggctagaccatatagcctagatgtgtagtaggctatcccatctagttttgtgtaagtacattctatgaggttttcatgatgacaaaatcatctaagaaggcatttgtcagaagactcatattcataattaattataatagacctccaagcagctaccagtgattgttctccagcagaaaatagggggaaacacttctgtcatccaaaaaaaaaagcatgaagaagttaattatttcttccctattgtacggaattatgttcacagtttttagttaccattgtcacgctgtgggtatcacaggctgcactaagagaactgactcggagcccagtctactagggcttaaatctagccttgtgatttacatgttgtgtgacatcgcagagatcacataacttcacctgcaacattggaaatagtaacacctaccacacaggattgctgagggaatttaatgaattaatacttgtaactattaaaacctttctcaaaataagttttgaataagtgttaaagaagattagcagttctaacttctaagacctctttaagagtcatgacttcctgaagatagctatttttggattgaaaataacatctggaagataaggtgatagattttgttcatctgtattatagagcccatgtaaatatatatcttatgaatatactttttttttttagcaaatttcattccagaaacatgttgttgagtggtaggaatccagatattccagtaaaattgagtgtaggaatgactagactaatatttaaaaatgacacttgagagctaaatatttttataaaagagctacatctagtgggaagatggacacagaattacaaacatatcctttaaaattcaaaacaaaaatgaaggggatatggaaagaacagataagaaatttatttgtagacatgccctatattggcagccttcaaagagtctaagacaatgtttaaatgacggtatggtgggaaccctcttcagtaatagaaatgttgagattttggactgtggatctgatgagaatttgaattttttttcttccagtgtcagtttagggtcctgaaacttgtttcatgataatacactcttaaagatt

SEQ ID NO: 469279 - DNA, 1018 bp, Homo sapiens
gcttccacattttcagaagcgaaaattccactgaagacaggttaagtggaagaggcatctttgaacagctgtaggactgggtgctgggctggtagaatgacagcagattcaggtccttccaagtccattagaggcactcaagtcatggctccaccgggtcccatcctggagatcacacttgttggcaagattccccagtccccaggagaggaatacaaggaagctgtgaagcaaccatttggtggagagatttgcgtgactaaaagagagctgagtgctaacaggcaagacaatgggacaaaggccttgaaggcatttcagaaacatttcaggctccctttcccatcgcaggagggctcagaagaaaaccggaagatgtgggaaagtttggaacttcctagagacttgttgaatggctttaaccaaaatactgataatgatatggacaatgaaatccaggctgaggtggcctcagatggagatgaggaacttgttggaaactggagtaaagatgactcttgttatgttttggtgaagagactggtggcattttgcccctgccctagagatctgcggaagtttgaacttgagagagatcatttagggtatctggcagaagatatttctaagcagcacaaattcaagaggtgacttgggtgctgctaaaggcattcagttttaaaagagaaacacagcataaaagtttggaaagtttgcagcctgacagtgcgatagaaagaaaatcccattttctgaggagaaactcaagccagctgcagaaatttgcataagcaacaggagctgaatgtgaatcaccaagacaatcgggaaaatgtctccagggcatgtcagagacctttgcgctatggtaagcaccggggctatatgaagacttgttatcaaggagttcaaaattttcttggggagattgacaggtgaacaagtaattacagtctaatgtaaaaaaaaaaaatagttacatgaaaaaaaataaatagtttttgatgggagaacaggc

SEQ ID NO: 469280 - DNA, 1196 bp, Homo sapiens
cagcacagcagcaggggccgtgcgcgtcacggataagaacctcttcccttcccttgtccaagtgtgcactcacaattgctccatctatacacttccatctggcattgctgctgcctgtgaagtatgtggtttcctggttccctgtgggtacccacagccactctatttccagtctggctgctttgacggcatggggtttgcagctggagttccaggtcacttccgatacaatactgatgtcaggctgtgccttgctagacgggagtcagaactgaaaccaaagaaactagattctgttgttcttgcatttgtacaaatcttctgtgccttaaaggctgcagagattggcataaataaaaagaagccaagtgataatatcaaagacaatgggcaaaaggccttgaagccacttcagagaccttcacagcagcccctacctcatagtcccagaggccaaggggggaagaatggtttcatgggctggaccaagggccctgctaccctgtgcaacctcaggaaagtgctcctgcatcctggctgctccagctccagccatgactcaaagggaccaagactccagaatggtagattcactggcagcttgcatctctcacctggaaaagctccaggcattcaacgccagcctatgagagcagctgtggccactgtaccctgcaaagccacaggggcaaagctgccaaaggttattggaacccactgcttgcccaagtgtgctctgaataagggaccactaacccgaaaacaaatcaaagaagaagaaagagatgcagaaaaaatggaagatgttatgggagtatataaagcatactgattatttgaacttatctttccactggtttttaactttatggccaatttcttgtaagtagtttttaaatagtgacagatgttatttaataatcaaaattatctgcgtggtataacacaaagagagattctagtgtaaattatgaacattatttaataacatcaatattgggtcattaattatataccacattgattcaaaatgttaataatggggtaaatgtgtgtatttgttggaacaatgagagttgatacatatagaggctctgtactttctgccaaatttctctgtaaaactaaataaagttgctctaaaaataaagtctactaatttaaaaaaattctgttagaagttacaaaaataaaga

SEQ ID NO: 469281 - DNA, 918 bp, Homo sapiens
cagccttgttgctcacacaaagcctaacctctgttagagcagtacagaagggaaatgtggagttgaagtccaacacagagtccctactggggcaccgcctagtggagctgtgagcagagggtcacagtcctccagaccgtagactggtagatctactggcagcttgcactgtgcaaccggaaaagccacagacactcaatgccagtctgtgaaagcagccagaagggaggctgtatcctgcaaagccacaggggcagagctgcccaagaccatgggaacctacctcttgctttagcatggcctggattaacatctttctggtgaatccagaagggactgtactgaagagacccctgacccaaggaaatagactgcagcaccagttggctgactttgggaaagtagtggggtacccaagtaaagaatgggattgggaacagctgcagccacccagccatggctctggacccaggcatctctgtgttcttggggacccaggaagcccctgccccctcaggcttaaaagtgcctgctcccactccctggcctctcccagctcctggcacccgctctggggcaaagcaaagttgtggctgagcctggccactgttgtgatccagctgggtgtgtgtgcactcaggatggtgctgacatgccagccccctgctgccttggtcttctctagactttggatcctgacaaacacaggaggaaggctgaggaggggctgagggcagctcagtgcagacctgaagaaaactataaaagtgacactgtacctgtttctgtgcctacgcctgatgaaactgacagcttccgctacctgtttcttagaacaatcactcttgaaaaccagccaccatgctgtgaggaagaccaagcaatcctgtggagaagcccacatagaggagaactggc

SEQ ID NO: 469282 - DNA, 1909 bp, Homo sapiens
agagacttgtcgaatagctttgacaaaaatgctgatagtgatatgaacaataaggtccaggctgagatggtctctgacagagatgaggaacttgttgggaactggagcaaaggtgactcttgttatgctttagcaaagagactggtggtattttgcccctgccctagagatttgtggaactttgaacttcagagagatgatttagggtatctagtggaagaaatttctaaggagcaaagcattcaagaggtgacttgggtattgttaataaaggtattcagttttataaaggaagcagagcataaaagtttggataatttgaagcctgacaatgtgatagaaaagaaaagcccattttctggggagaaattcaagccagctccagaaatttgcataagtagcaagaagcctaatgttaatcctcaagaccatgaggaaactgtctcaaggccatatcagagaccttcactgcagcccctcccatcgcaggcctggaggccctggaggaaaaagtggtttcatgggcagggcccagggtctccatgctgtgtgcagcctaggaacttggtgccctgtatcccagctgctccagccatggctgaaaggggccaatgtacagctcaggctgtggcttcagaggatggaagccccaagccttggcaacttccatatggtgttgagcctgtgggtgcacagaactcaagaattgaggtttgggagcctccacctagattgcagagggtgtttggaaactcctggatgcccaggcagaagtttgctgcagggatgggaccttcatggcaaacctctgctagggcagtgcagaagggaaatgtgggagtccctactagggcaccaccacagcaccacctagtggagctgtgggcagtgggtcacggtcctccagatcccagaatggtagacccaccgacagcttgcgccgtgcaactggaaaagccacagacactcaatgccagcgcatgaaagcagccaggagggaggctgtaccctgcgaagtcataggggcagagctgcccaagaccatgggaacccacctcttgcatcagcgtgacctggatagttttatacttttatgtttatatttaattctttgatctatttttggtttatttttgcatatggcattaggtaaaagtccaaattcggggaggggggagggatagcattgggagatatacctaatgctagatgacacgttagtgggtgcagcgcaccagcatggcacatgtatacatatgtaactaacctgcacaatgtgcacatgtaccctaaaacttaaagtataattaaaaaaaaaattaaaaaaataaataaataaataaataaattaacataaaaaaaaaaaaagaaaaaaaaaaagtccaaattcattcttttgcatgtggatatccagttttcccagcaccatttgttgaaaagtctgtcctttcccccattgaatagttgtggcacccttgtcagaaatcactggaccatatagatgataatttatttatttgggggctctctattctattccattggtttatatgcctgttcttatgctagtaccacaatgttttgaatacggtagctttgtattccttacattgcaaagctaggttgttatttgaaatttctttcttttaacgtaagcatttttagaaataaatttcccctttagcagtgcttttgttgtcttacaaaagttgtggtatgtttttacttttattcatctctaactattttataatttccttcaggactttttctttgatccattggtttacaatctttcctcattttctttctgtatattatatggctatgtatgtacacatatgtttattgcgcactattcacaatagcaaagacttggaaccaaaccaaatgcccatcaatgtgactc

SEQ ID NO: 469283 - DNA, 1187 bp, Homo sapiens
tgggggtgccagagaaagccttgtccctgccgtggcccagcagcctcctgcttctgagacccccaccgggggatccaagattccttgagtagtgacatgataatctacactgtaggttattccaatgacccagataattttgaatatcagcaaatattgcacatttttcccaatgaatgtcctcatcaggacgctatttcttatgctgtcattatccagagatgccttcttcataggaatcacgctgctctcaagtgtatacatggtcattcttttgtccaggcatcagaggcactcccagcactttcacagcagcagccttatattaaggacttctctagtgaaaatggccaccaagaccatcctgatgctggtgaattcctttgtgctgatgtactcagtggacttcatcctctcatcatccacaatgctgttatgggtaattggccctgtcacctatggtgtccacaagtttgtggtcaatgcctatgccactgtcagtcctctggtgctaatcagatctgataaaagaatcatcaatattctgcaaaagtttcaatggaagtgccatctatttttaacaagttggtgataaaattttctaaaaattatttctttgtaatcaattaaattatacaaaaagcacataattttctttctgatttaaataaaacatgtgaattgtacttttataatatctcaatatcttttaattttttggtgccaagaactgtgtgctttcctcagttcaatgtccactatgattttgtattctcaaggtctgtctctcaccccttcattttaattttacctttatacaggaaaatgttattttcttcttgagtacactcttatgcggctcctattggcaagcaaatctcttagttttaatttttgaaattattttaatttttcttatttattgaagatatttagctatattcaaattctagcttgaataaaaaaaatttttaagcataattttaaaatttgtttttaattgaaaataacattgtgtaagtttattatgtatgttttgaattacatatagattataaaatgattaaatctagctaattaacaaatgcatgatctaaaagttattgttttttgtggtgaaaacagttaacatcaactaccttttcatttttcaggactgcaatatatcataattaagtatggctgcc

SEQ ID NO: 469284 - DNA, 519 bp, Homo sapiens
gcgagcgtggttctcatggtaggggctgaaggaccctcccatcctagtgacagggccacagcatgtccaaggaggccccagaggaggtcccgggagtcctgggagagcctggttagcctccctgaagggaggaagtggggttttgtgagagggatggtgcagcagcccccacacctgctactccgtgtggccggggaggtatggagcgggtccccggggccaggtggagcccctcacacctgtgtcctcaaggacccacaccaggacaatggccataggcgggcacctgcagccgccctggccagcagtgagacgggcagagagcccagccagatagcccggttcctgccccctcccgcctgcccgcacagagagggctgcatgcaggtcagcagcaagcagggaggctttgggggtgctgggggctgctttgaaaggcacccctgagctaagacttggctgttgggaaggaatcacctccctccctccagccgtaaaaagaactggacatcagcttcc

SEQ ID NO: 469285 - DNA, 1657 bp, Homo sapiens
aggtttgttacacagcctggaagagcaggaactgtgtctccttcactttccccagcacctatctcagagccgggcccgcagtaggggctcatgcatttgttggctggcgttaacgtgaaccagcacgtcggctgtggatgaataactttccaggtcccaaaattgtccacttgcttctctttcaccgttgggctgagaacgtagctactaataaacccggagtgggagggggtatcagtaacagagacaagtgtgtgattgaaatggaagacagctggagagaagagaacagaaataggcaggacgtgcacggccagcaggaagttgctgtgattcccgcaaagcatgtcttttcattcgtgaagaggggattagaaaggacaaggacaccagatgtcatcaagtcccatcctttgacctctgtaggaattccctgtgcatatttctgggttctttggagaaatggtcgattcaacatcagggataagtttggaacatcttgtcatatcagccagcaaagaaactgtcaaagacggtaaaagcatgccaaaaagacttaggaaccagagcctattggccagaggtaagacaattaccaaaacaaacaaacaaacaaacaaacaaacaaaaacaggaagaatccagaatctaatcaggacctaactactaactacaaacttataggaaatacactctaggatagtaaattttgtgtgtcaacttgactgggccatggtgtgcccagatatttggtcagacattattctggatgtttctgtgagggcgtttttagatgagattaatatttaaattggtagactaagtaaagcagattcctccctttttggatcattgtagacctcatcctacagttgaaggcctgaatagaacaaaaaggttgacccaccctaactaagagagaattcttcccatctgacagccttccagagggagcatcaacgtttttcctgtctttgaaccagaactgaaacatcagctcttcctgagttttgagcctgctggcctgtggactgaaccacaccatcagctctgctgtttctcagtttttcagattacactctcttggggctccaggtggttggctgcagatcttgggacctgtttgcctccataattatgtgacccaattctttgtaataaatccttctttctctctctttcttctattgattctgtttctctggagaaacttggctaagccacacctccacagggataaaatcaacaaaaagcagagtataggacattttataggccaacagaaagtattactcatcaacaaataaattgccccccccaaaaaaaacaatagagggaggggtaatttatagattaaaagatatttaaaaggcatattcaccaaatgcaatggaagagccttagtttggattcctatttgaacaaaccaagttttaaaaaaagtatgagactatcagggatatttggaacatttcctggatacttgatgatgttatggaaatattgttgattttttttggatgcaatgacatttacagggctatgcttttaaaagtccttaaattttagagatatatactggaatatttatgaataaaataatttcagtatctggaatctgcttcaaaataattcatcaagagtaggagtatgggtt

SEQ ID NO: 469286 - DNA, 4254 bp, Homo sapiens
tggaaaggaaacgattggaatggaatggaatggaatggcttgaaatggataagaaatgaaaagaatgtaatggaatcgaatggaatggagttgaatgtattggagtcgagtagaacagaattgaatggaatggcatcaaatggaatggaaacgaaaggaatggaattgaatggactcaaatgttatggaatcaaagggaatggactcaaagagaatggactcaaaagaaatggtcttgaatggaacttgttcgaatataatttaatcgaatggaatgcaatagtatggaatggaatggaatcgaatcgatcggaacgaaatcgaatgcaatggaatagaatagactcgaatgtaatggattcctatgtaattgattcgaatggaatggaatcaaatggaatgcaatccaatggaatggaatgcaatgcaatggaatggaatcgaatggaatgcagtggaagggaatggagtggaatgaagtggaatggaatggaatggaatggaattgaaaggaatggaatggaatcgaatggaatggactggaatggaatggattcgaatggaatcgaatggaacaatatggaatgtggaatggaatcgaatggaatggaatcgaatggagtgaaatggaatggaatggacgcgaaaggaatggactggaacaaaatgaaatcgaacgaatggaaagcaatggaatggaacgcactggattcgagtgcaatggaatcgattggaatggaatcaaatggaatgatttggcatggaatggactcaaatggaatggactggaacaaaatgcaatggaatagggattcgaacggaatgcaatggaatgggaatggaatggacttgaatggaatagagtcgaatggaatggagtcgaatggaatgaatggaatgcaatggaatggaatagaatggaatgcaatggaatgcaacggagtggaaatgagtggaatggaatcgaatggaatggaatcgaatggaatggactggaatggaatggactcaaatggaatggatggaatggaatggaatggaatggaattgaaaggaatggaatggaatcgaatggaatggactggaatggaatggattcgaatggaatcgaatggaacaatatggaatggtaccgaatggaatggaatggaatggaatggaatggaatggaatggaacagaatggaatggaactgaaaggaatggaacggaatggaatggaatggaacggaatggaatggaatggaatggaatggactcaaatggaatgaaaccgagtggaatggaatcaaatggaatggaattgaatggaaatgaaaaatcaaatggaatggcatcgaatggaatggactcgaatggaatgtgctcgaatggaatggaatcgaatggattgatatcaaatggaatggaatggaagggaatggaatggaagggaattgtaccaaatgtaatagacttgaatggaatggaatcatatagaatggactcaaaagcaatagagttgaatagaacggaatgcaatgaaatggaacgatgtggaatcgagtggaatggaatcgaatggagtgaaatggaatggaatggacgcgaaaggaatggactggaacaaaataatggaatggatcgttatggaaagacatcgaatggaatggaattgactcgaatggaatggactggaagggaatggactcgaatggaatggactggaatggaatggattgaacggaatggactggagaggaatggactcgaatggaaaggaaacgagtggaatggaatggaatggaatggcttgaaatggataagaaatgaaaagaatcatggaatggaatcgaatggaatggaatcgaatggattggaacgaaatcgaatggaacggaatagaatagactcgaatgtaatggattgctatgtaattgattcgaatggaatggaatcgaatggaatgcaatccaaaggaatggaatgcaatgcaatggaatggaatcgaatgaaatgcagtggaagggaatggagtggaatcaagtggaatggaatggaatggaatggaattgaaaggaatggaatggaatcgaatggaatggactggaatggatggattcaaatggaatcgaatggaacaatatggaatgatatcgaatggaatggaatggaacggaatggaatggaatggaatggaatggaacggaatggaatggaatggaatggaatggaagggaatggaatggaacagaatggaatggaactgaaaggaatggaacggaatggaatggaatggaatggaatggaatggaatggaatggactcaaatggaatgaaaccgagtggaatggaatcaaatggaatggaattgaatggaaatgaaagtaatagaatggaatggagtggaatggaatgcagtggacacaaatggaatggactggaatggaatggacacgaatggaatggactggaaatggaatgcaatgaaatggaacgaagtggaatcgagtggaatggaatcgaatggaatggaatcgaatggagtgaaatggaatggaatggacgcgaaaggaatggcctggaacaaaatgaaatcgaacgaattgaatgtaatggcatcgaatggaatggaatggaatcaaatagaatggacttgaatggaatagagtggaatggaatggcaccgaatggaatggaatggaatggaatggaatggaaaggaatggaatgttcacaaatttattggactcaaatggaatggagtcaaatagaatggacacgaaaggaatggtctcgattggaatttattcgaaaacaatggaatcgaatggaatgcaataatggaatccaatggaatgtacaagaatggaatggaaacaaagggaatggaattgaatggaacagaccagaattgaatggactggaacagaagtatggaatggaatcgaatggaatggaatcgaatggattggaacgaaatcgaatggaacagaatagaatagactcgaatggaatggtaccgaatggaatggaatggaatagaatggaatggaatggaatggaacagaatggaatggaactgaaaggaatggaacggaatggaatggaatggaatggaatggaatggaatggaatggattcaaatggaatgaaaccgagtggaatggaatcaaatggaatggaattgaatggaaatgaaaaatcaaatggaatggcatcgaatggaatggactcgaatggaatgtgctcgaatggaatggaatcgaatggattgatatcaaatggaatggaatggaagggaatggaatggaagggaattgtaccaaatgtaaaagacttgaatggaatggaatcatatagaatggactcaaaaaatggaatggatcgttatggaaagacatcgaatggaatggaattgactcgaatggaatggactggaagggaatggactcgaatggaatggactggaatggaatggattgaacggaatggactggagaggaatggactcgaatggaaaggaaacgagtggaatggaatggaatggaatggcttgaaatggataagaaatgaaaagaatcatggaatggaatcgaatggaatggaatcgaatggattggaacgaaatcgaatggaacggaatagaatagactcgaatgtaatggattgctatgtaactgattcgaatggaatggaatcgaatggaatgcaatccaaaggaatggaatgcaatgcaatggaatggaatcgaatgaaatgcagtggaagggaatggagtggaatcaagtggaatggaatggaatggaatggaattgaaaggaatggaatggaatcgaatggaatggactggaatggatggattcaaatggaatcgaatggaacaatatggaatgttaccgaatggaatggaatggaatggaatggaacggaatggaatggaatggaacggaatggaatggaacagaatggaatggaaatgaaaggaatggaatggaatggaatggaatggaatggactggaatggaatggacacgaatggaatggactggatggaatggaatcgaatggaatggaatcgaatggagtgaaatggaatggaatggacgcgaaaggaatggactggaacaaaatgaaatcgaacgaatggaatggactggaatggaatggattgaacggaatgcactggagaggaatggactcgaatggaaaggactggagtggactttactcgaatggaatggaaacgaatggaatggaatggaagtaatttaaa

SEQ ID NO: 469287 - DNA, 618 bp, Homo sapiens
cagtcttgtgaggtgtggatgcagtcctgcaacttcaccttcaggagaagtgcatacagatcatgcagaaggtacctccaagtttatctccacttttctttcattgcacaagctttccacaccatatcccgctgccaaggaaaaagaactccaatgtgcaaggaaccgctggggcacaaactgtggccattctggccagctcccggaggctcttgtgtcctctggcaagaatccctgaacatggcttggactccagtgtgggccctctagtgctcccagacagccatactgagaaggagcagcaggaatatactgataaatactcaacatataaagttggacctggtttaaatagtcaattatctgatggcatcaacctttgttttgatccagtcagttggaaacactatttctgtaggatctatgatgggacacttcagatcccattgaggactgtagtgaaaaaactaatatcccatgataaaaactagaaacaagctacctgtgaaagtgctttgcaatgtgtggattcatctgacagagttaaaactttgttttgattgagctagttagaaatactctttttgtagaatctatgaagggatatttcaaagacca

SEQ ID NO: 469288 - DNA, 787 bp, Homo sapiens
gttctaaatcctgaaaactggtaaacaaagcacagtgcaaatgtgcccatgttgtcacctctaaagccggctcctgagcccccgccattctcctggggaagcaggaaagcactcctccgctaaccgccttcctcttagggacgaactccctggagactttcttccttcacctacatcgggttttcccaacacgcaataaacaagtgcagggactatcctcagaacataatggtgagtacagtcacatagcaaggatggttaaagccctaagaagagatggaaccacttggactgcatggcagttggggcccaggaccaagctgtggggagctccagcattcaggggccgcagaggggacccagcaagtggaacacacagaggaggcatggcaagagacccaggcgggaagccaggaggaatgctgttcctttcatcagaggatgcagcattcaaggtaccatcttgggagcagaaaccaggcccttaccagacaccaagcctgccagcacattgatcttggattttccagcccccagaactataagaaataaatttcttttcttcaaaattatccagtctttgttattctgttacagcagcacaaaagagactacgacaaagaagaagggtaagaaaagttgggtgggagaggtattgaaatttggcagtgttgctgggcaagctgcactgaggaggtgaattgaaggaaagtctttggttaagtgagggatgagttatatggatatcgaggatagagttttgcaggcagaaggaaagcagcaagtg

SEQ ID NO: 469289 - DNA, 1298 bp, Homo sapiens
taagaagctgtgttgcagtctgggaacccagggagttttccacatgaccataccgctggcttccacacctggagcagctttccacatgaccgtaccgctggcctccacagctggggcagtttccactctaccctaccgccagcctccactcctagagcactttctacactaccctaccgccagcctccacacctggagcagtttctactctaccctaccgccagcctccacacctggagcagtttctacactaccctaccgccagcctccacacctggaacagtttctactctaccctaccgccagcctccacacctggagcagtttctactctaccctaccgccagcctccacacctggagcagtttctacactaccctactgccagcctccacacctggagcagtttccactctaccctactaccagcctccacacctggagcagtttctacactcccctactgccagcctccacacctggggcagtttctaccctaccctactgccagcctccacacctggagcagtttccactctaccctactgccagcctccacacctggagcactttctacactaccctacggccggcctccacacctctgacatatttgactatttgtttatgaaaggccaccagctaactgcatcctgatggaaaacaatttgtaagttactaggcactgagaggataatgaccttcaggagaggaattctagggtggtattcagccaaaggacagcagaaggaaggtatgccatggagagaccaccataaataattaaaatgtagcgcacgtggtgcgaaatgtactcaaagctctatggggacacagtaagaaatgaaagtacctattaaaaatttaaaagtactgactattatgaatataaatggcatttcaaatactatgggcttcaaaatgttctatcctatgcgataagaaatgaaagcctctcagtccaaaagttaggttttgaagggagatttgtacatgttttgatggacacttagtgtcatgatgaaaaataaattgtctctatttttcctttccaatgtcaataattttgtatgattatatgccttctgaaattgctgttgttctattgcattttcaaggtccacttaagtactcaaatctactcacagttatatccctgggtggcagtttaaaaaatgtaaaatattacatagcaaaacaaagtctgtctttaaagaaagacggcatttttatctccatttaaaggaaagttatagagcttttacccatctcaaaagcccagaaaggttaaataacta

SEQ ID NO: 469290 - DNA, 1495 bp, Homo sapiens
cgggaaggcagctaaggctcagtgagaaatggagcgcagcgccggtgggctggcactgctgggggacccagtacaccctccacagccgctggcctgggtgctaagtccctcattgctcggtgccagcaggtcgggctggctgctccgagtgcggggcccgccaagcccacgcccacccggaactccagctggcccgcaagcgccgcccgcagccccagttcccgctcgcgcttctccctccacacctccctgcaagctgaaggagtgggctccagccttggccagaaagtggctcccacagtgcagtggggggctgaagggctcctcaaatgccgccaaagtgggagcccaggcaggggaggtgccgagagcaagcgagggctctgaggactgccagcacgctgtcacctctcactatgaaaatgctttgaaatgcaacaggaggagatgtgaagacacaaagaacaagtgtgtagtgacacatggctatcagaacacactaaagaatccacactgcttcccctctatctagaaaaggaaggctctaagtcacctcctcagcaggaggaggtatttattcttactaaatataagatagttattacacctacagtttctatcctatttagagtttatttgaactttgaattgtgacaaatatttaatgtttctggtcacttcttttgagtttgagcgaagtacagggcaaagaatgtattcaactcagacaaaaaagcctgacattttgtcagcctagctctgccactataaatgttgagtcctgcatctctctcagctatggttcccaataagagaattgaactcgaataagattctaaagactagacttcagcagtctttgagatttttaaacttataaagaaaattttgtgaaagtgggcattatctggacagggtctgtaaccttcataaaattcttcaaaaaattcctttttttaaaagtaacttcatatccactgtgtcagattctctttcagatatctttgcattataacagtcacttttgaaaagtggattaaaggctttgaagcctctaaactgggctggaaatttaggaggtcatatggcttagcacactacaacatatagacattcaaaaatattttatgaatgcatacaaaatgttattaaatatactgagaatctggcagtaaatatggtaggagacaaatagttttcatatcattttgtggtattataaacctttcattataagcatcttataagctttctttaaaggcttttgaagggagatttttagctgaataaataaactgacttcaagatttttttaaaaaaaatgacatgtaattggaaacctggtaactccatggaatttggtttcagagtgttgctttcatttttcatatttttgtgtatatttttgagagtaaatatataggatggacttcagttttctaacatcatgaatgtgagttgaaatttatagtcttggcagatgtttcacacatga

SEQ ID NO: 469291 - DNA, 521 bp, Homo sapiens
tttcctatttgcagttacttcaaaccccaccatgctcacagattcatttccaggaaactgtgtccccatccccatcctaaacatcgtaaacactccagctgacactgggcattggaggtcaagaccaccctttgcacttgtaaagggcaacttccctgagagagaaggattctcccatcgatttcaggatatatatcccccccctgcgccctgcctaccaatgccaactgtggtgggggcttccgacaaccaaaatgcccccactcgcttccaaatactccccaagaaggtcagagcgctgcccctttggctgactcagtcccaaatcaaaggctttactgggtgtctgagagcatatgtcacctggaacctcatcacattgagaagtcagcttcagcagagactggagaatctagttttgagctttcctgcctcttcctgttagaagaggataggaaaaattttgaattagagaatccagagtccatcatattgccattgtacttataattttttgatgc

SEQ ID NO: 469292 - DNA, 544 bp, Homo sapiens
tgaatggtatgggtatctgaagatgtttggtgagtgtgctaaggagtggactggattgtcactgccaccagtgcagccggcttttattcccttatccggccccacccacatcctgctgattggtccattttacagagagttgattggtccattttacagagagctgattggttccgagctcttcccccgtaggaaggcagctgagaccggcgagaatttaagggcagcacgggcaggtggcagtgctgggggacctggcacacccttcacagctgctgggccgggtgctaaggcccttactgcccgccggtctgccgctctgcgtgcgggacctgctgagcctgtgcccactcggaactttcgctggcctgcgagtgccatggacagccccagttcctgcctgtgccttttcctccacacatcccgcaagcagggggagccagctccggccttggccagcccggagaggggctcccacagtgcatttttgtgggttcctccataagaaacatagaactttatgttatttaatatttttataata

SEQ ID NO: 469293 - DNA, 1376 bp, Homo sapiens
agtgctggacctggacctcaggtccagctatgttagaaggcattgtgatgtccaatgaaaagtggattttatatgacaaccggtgatgaccagctcagtggttggactgagaagttccaaagcccttcccatagccaaatttgcaccaaaaaaaaggtcatgttcactttttggtggtctgctgctggtctaatttaccacaactgtctgaatcctggtgaaaccattatacctgagaagtatgcacagcaaatcatcggcactggtcaacataaagggcctggttcttctccacaacaatgcctgaccacatgttgcacaaccaatgcttcaaaagttgaacgaattgggctacaaagctttgccttttctgccatattcaccttacctccctccaaccaactaccacttcttcaagcatgtcgacaactttttgcagggaaaattctcccacaaccagcaggatgcagaaaatgctttccaagagtttgtcgaattccgaagcacatatttttatgctacaggaataagcaaactaattttttgttggcaaaaatgtgttgattataatgactcctattttgattaataaagatgtgtttgagcctagttataatgatttaaaattcacagcccaaaaccacaattacttttgcaccaacctaaataatatttctggcatctagtgatatttcaatacacgggtacaatgtgtaatgatccaattaaggacttctcgtatttcaattataatctattcttaataactctagaatactaataaagataaatagagaagaataatagcaggcaaaggtaccatactggatagtttttctcattggatgtagcaacaatgaaactgctaagattttcatttcttcagttgagctaaatcaagctgtcagattagggctttctatcctctgttttttcctcccattaagtctttcacaagaacaaaatgtgtttcttgcttgcttcccctgtaacagggcttacttcattattttcaaaggacttttttgtttgcaggtcagattagggctttccatcctctgttttttcctcccattaagcctttcacaagaacaaaatgtgtttcttgcttgcttcccctgtaatagggaggagagattcctctgcctcatgtgcattttcttcagataaatgagataaagagtaacgataattggtatctaaagaaactgaaataaagtttacttaaagttatcctggcttaatatatgtatatgtgatatcaaatatgctatttttttaaatataattttatttgataatatgcatataaaatatccatgtaattgactgtttctacttctcttacccagatgtgagtcagtacagaaaaaaaa

SEQ ID NO: 469294 - DNA, 1197 bp, Homo sapiens
ccgaggccccgcggcgcagcaggctccgcaccacgtccaggtggtccgcgcccacagcggcggcgcaccctccacggtctcgccatcgaagtgcaccgagccaccggcctccacgctcgcgccgcaccggtccaccaggtactccaccacgtccaggtggccgtagcaggcggcgatgagcagcggcgtccccccgccggccacctagccagtcagctcgtccagttcctcccggctccggccgctgagcagcttctggagcagctgcagcctgccgtcacgggcggcgttgtacacggcggtgcggaggtctttggttcgggcctccgccaggccgtgagccggccgcagcgggagggggagacagaggatcagagcccagacaggcgggagccaaccttcaccgtctccctcgccgccatcttagggtgcaaaggatatggtgcagcaagtgaaagagagtgcgggcatggactgggagtctgaaagacatcccatgttgaaagctacccagggctccaagtattcacagacacagagtgtgcattctgtctccagtgtcaaccaccaagattctgtgctaggaatcatgctttcaggagggcttcgaggagaaattctccacaagccttttatgtttccttgtccatgtaatcaagctaggtttgtcaaaccaattaggccagttcaagacccctggaaatggagactaacagatttcctgcagcagctcaatggtgtcaatcacccaacttctttctgttctgccaccacagcacattccattttcattctatgtaattcctcacagttaaaagatcacacacaactaacacaacttaaataattatgtctttgaacaataaaaaccaaagaaagaaaaaatttcatatatttggccatcattttcattagagagctgccaagggactttctgactttctcactttgccttatgctgaccaactggagtctatttatcatggaacccatccacagcctttgtaatgaccatttaccttgtaccatcaaaagccaaagaaaatcgcacaatctagcatacctgttctgtcagaatcccttctatattagtttcctagggcttctataacaaaatacaataaattgggtggcatagaacatgaggaatttattgtctcacagttctggagactagaagtccaaaatcaaggtgtc

SEQ ID NO: 469295 - DNA, 1000 bp, Homo sapiens
acacggaacgcgcccagggccaccgggaggcggccggcgcgggtcagagcgtcccccagcctcaggcaccggccgcggtcgggctgcgccagccgggccagcatggagcggaagagcccgactgctttctggtactcgctcgcgcggaaggcctcgtcgccctcctccaagcgctgggcgattggcttcccgcagcagcagcccggacactggggcggcggcgggaccggctcagtgctgatccccgcggggctgcgaccgtgcgggcctggagcgaaggcgcggagcaggggcgatgagctgctgctgggaactggccggcgggagcgccgccacagccttcgcctgcagaaccaaaaaaacggttttaaaaatcttttttttttttttaattatactttaagttttagggtacatgtgcacattgtgcaggttagttacatatgtatacatgtgccatgcgggtgcgctgcacccactaactcgtcatctagcattaggtatatctcccaatgctatccctcccccctcccccctccccaccacattcctcagagtgtgatattccccttcctgtgtccatgtgatctcattgttcaattcccacctatgagtgagaatatgcggtgatttacatgtgatttttcccattattttgatttctttgttgaatttctctggtacatttctgaattgtgtctctgctttctcagtgttcaggctcttcttaaaacagccattttgaattctttgcctgccagatcgttcatctgtatgtctttaagttcagttgctgacaccttgttttgtccatttggagaggcaacttttcctaagctatcattattatatgtagatatacatctgtgtacacattaatgatttagatatttatttgagtcttctcagtttgggtgtgtttgtgactacttttaagtgggcttattaagaaattttgagcggacttatcatcgtattccattttagcgttagagagagc

SEQ ID NO: 469296 - DNA, 774 bp, Homo sapiens
cgtcgcctcagcgcctaattcaggcagtcagcgccgcagctgcagcagggcagaaacctatgccctcggcgcagtccccttggctgcacagttcccagtgcccgcgacccagaactctgggtgcaggcaaaggaagagcctgcagcagccacctgcacagggtgcgggcagcagccttggaggcaaccccagaccatgctcctacaccagccaggcggatcccagggccagacgccgcccagaggctaattcaggtggtcaggccccagctgcaggagggtgggaaccggccgctcagccatttcctgggtgctgccctgtacccagtacctgcacaccccgctctgggctccggcaagaaagaactgactctaggctgcagtggtaacctgcacaaggcgcgcagcagcagctgtggcaaactccgaccctgccagtgccaccagcagtgcggacccttgggccagaagcctccacagcgcctaagtcagggtgttggtccccagctgcaggagggcaggaactggcactcagccccacctcagaggctgcatggtgcccagagccagggcccagctcttctagcgcaggttgtggaggggccaggggccacccaggctggagggcagtgagtattaaagtgccagtgtggactgaggcaccaaagaatcacattattatgtcatataacttgccttatttgtagtgacccatgggcttggaaacagaaccatttgcagctgtcagggaagtgcacagtgcctgacctttccc

SEQ ID NO: 469297 - DNA, 1505 bp, Homo sapiens
gattgtggatatattttaggtagaattttatgtctggctttcactttagcctggtccctacctcaagcataagtcttggcagcttacatgtggctttgggcctccaggtacacagaaatcaagaattgaggtatgagaacctccacatagatttcagagaatttgtggaaatgtctggatgtccaggcagaggtgtgctgcaggggcagagtcctcatggaaaacttctgttagcacagagtggaagggaattgtggagtcaagcaccctctggggcactgcctggtggagctgtgagaagagggccaccatcgtccagactccagaatggtagatccactgacaacatgcaccatgcacctggaaaagctgcagacactcaatgccagctcatgaaagcagccagaaagggagctgtaccctgtaaagacacagaggcagagctgcccaaggtcatgggtgcctacctcttgcatcagtgagacctcgatgtgagacatgaagacaaaggggatcattttggagctttaagatttgactgctctgctggattttggatttctatggggcctgtagcctcttcattttgccaatttttcccatctggaatggctgtatttatgcaatgcctgtatctccattgtatctaggaagtaactaacttgcttttgattttacaggctcataggcagaagggacttgccttgtcttagatgagactttggactgtggacttttgagttaatgctgaaatgagttaagattttggaggactgttgggaaagcatgattggttttgaaatgtgaggatatgagatttgggaggggccatgggtggaatgatatgatttgcctgtgtccccactcagatctcatccagaattttagctctcacaatccccatgtgttgtgggaggaacccagtgggagagaatacatagtatgcaaaatacttcacacttcacacatataatttttaattgaattgttaaaaaaataagcacaattgcctctgtttcaccaatgattaaattaagatgaccataatctatggaagctgcccaaagaaaaacagtaatggagtcagatataaatgaatcagactccaaatcccaatcactttttcataaagtgtttataattcatttttagagaaatatgagttgatgtatggatttttaaaattcattgatcagtcaataagcaaatactttgctatcaactgtgacatgctaagcatattaggtgaatagtacaaaatgttgagcaagatgcccttggtcccttccttcgagagattacattcccataggagggtggtaaattcagaaatacatcaatataaatagagtatataggcactacataggtaagttgtgtgtacaaatattggcattgttttaaattgcaaataattagcgaattgatctgaaattagccaaacggtttgaaaattaatatacaaactaatagaccaagattctccaggacacttactatattac

SEQ ID NO: 469298 - DNA, 5103 bp, Homo sapiens
cagcccaactcactcagaaacaccatgagacacttttgggtgacccttctgaagacagacaccgaaagcattgaagagaaaaacagctctcaggataaacattcagaccctcgtagcagtgttccggaatcctatgtgagggacaaaaactcagaacccagcagcagtgttctggaattctgtgtgagcgacaaacattcagaacttcgtagcagtgttctggaattctatgtgagggacaaacactcaaaacccagaagcagtgttctggaatccaatgtgaggtacaaacactcagaacccagcagcagtgttctggaatcctatgtgagggaaaaacagtctgaactcagcagcagaagcagtgttctggaaccttatgtgagggacaaacactcagaacccagcagcagtgttctggaatcctatgtgatggacaaacacccagaacccatccactgtcttctggaatcctatctgagggacaaacattcagacactcgtagaagtgttctggaatcctatgtgagggacaaacactcagcaaccaggagaagtgctctgaaatcctttgtaagggacaaacaaacagaatccagtagcagggttccagaatcctttctgagggaaaaacattcagaccctcttagcagtgttctggaatcctatgtgcgggacattcagaccctcatagcagtgttctggaaaccaatggacaaacactcagaaatgagctacagtgttctagaattctatgtaaggaacaaaccctcagtaccgagcggcagtgttctggaatcctatgtgagggacaaacactcagaacaaagcagcagtgttctggaatcctctgtgaaagacaaacactcagatcccagcagcagtgttctgataccctatgtgagggacaaacactcagaacccagccactgtgctctgaaatcctatctgaaggacaaacattcggagcctcgtagaattgttctggaatcctatgtgagggacaaacactcagaaacttatagcagtgttctggaatcctttgtgatggacaagcaaacagagcccagcagcagtgttctggaatcctatttgacagacaaacactcagaactcagaagcagtgttctggaatcctttgtgagggacaaacattcagaacctagtagcagtgttctggaattgtatgtgagggacaaacactcagaacccagcagctgtgttctggaatcctattgttctggaatcctgtgtgagggacaaacactcagatccagcagcagtgttctaaaatcctttgtgatggacaaaaattcagaccgtcgtagccgttttctggaatccaaagtgagggacaaacactcagaacccagcagcagtgttctggaatcctatgtgagggacaaacattcagaacccagcagcagtgttctggaatactctgtgagggaaaaacattcagaccctcgtagcaatgttctggaatcctatatgaggggcaaacactcagaacccagcaacagtgttctggagtcctttgtgagggaaaaactttcagaccctcgaagcagtgttctggaatcctatgtgagggacaaacactcagaacccagcagcagtgttctggaatcctgtgtgagtgtcaaacattcagaacccagcagcattgttctggaatcctgtttgagcgacaaacattcagaacttcgtacctgtgttctggaatgctatgtgagggacaaacacagaaccgagcagcagtgttctggaatcctatgtgagggagaaacactcggaacccagcagcagtgttctggaatcctatggacaaatattcagacactcagcagtgttctggaatcctatgtgagggaaaaacattcagatcgtcgtagcattgttgtggaattctatatatgggacaaacactcagaacccagcagcagtgctctggaatcctatgtgagggaaaaacacccagaacccagcaggattgttctggaatgctatgtgtgggacaaacactcagaacccagcagcagtgctctggaatcctatgtgagggaaaaacacccagaacccagcaggattgttctggaatgctatgtgtgggacaaacactcagaacccagcagcagagaacccagcagcagtgttctagaatcctttgagagggaaaaacattcagacccttggagcagtgttctggaatcctatgtgatggacaaacactcagaacccagcagcaatattctggattcctttgtgatggacaaacattctgaccctagtagcagtgttctgcaatcctatgtgggggacaaacactcagaacccagcagctgtgttctggaatcccatgtgagggataaactctcagaacccagcagcagtgttctaagtgttctggaatcctatgtgagggaaaaactctcagaaacctgcagcagtgcactggagtcccttgtgagggacaaacaaacacaactgagcagcagtgttctggaatcctttgagaggcaaaaatattcagaccctcgtagcagtgttctggaatcctatgtgagggacaaacactcagaacccagcagcagtattctggaatcctatgtgggggacaaacacaacccagccacagacagcagtgttctggaatcctatgtgtgggacaaacactcagaacccagcagcaatgttctggaatcctttgtgagggtcaaacactcagactctcagagcagtgttctggaatcctatgtgagggacaagcattcagaccctcatagcaccattctggaatgctctgtgaggaacaaatattcagaccctcatagcagtgttctggaatcatatgtgagggacaaacattcagacaatcacagcagtgttccggaaaccaatgtgagggccaaacactcagaacccagcagcagtgttctggaatatttggtaagggacgaacattcagacaatcttagcagtgttctggaatccaaagtgatggagaaacactcagaaacgagctgcagtgttctagaattctatgtgagggacaaacactcagaacccagcagcagtgttctggaatccttagtgaatgacaaacgctcagatcccagaagtagtgttttagactggtttgtgagatacaaacattcagaccctcaaagcagtgttgtggaatcctatttgagggacaaacactcatcacacagccactgtgttctggaatcctatctgaaggacaaacattcggagcctcttagaagtgttctggaatcctatgtgagggacaaacattcagaaaccagcagcagtgctctggaatcctttgtgagggacaaacaaacagagccaagcagctgtgttctggaatccgatttgatggacaaacactcagaacccagcagcagtgttctggaatcctttgtgagggacaaacactcagaacccagcagcagtgttctagaatcctatgtgaaggacaaacactcagagcccagcagcagtgttctgcaatcctttgtgagggtcaaacactcagacgctcagaacaatcccgatagccctgttctgcaatgctctgtgagggtcaaacattcagaacctcgtagcagtgttctgaaatactatgtgaggtacaaagcctcagaactcagcagtagtgttctggaatcctatgtgagtgacaaacactcagaaaccagcagcaatgttctagaatcctttgtgagggacaaacatttagactctcaaagcagtgttctgttatcctatgtgagggacactcagatccagcagcattgttctagaatcttttgtgatggacaaacattaagggacaaacaaacagaaaccagcagcagtgttctggaagcctttgtgagggaagaacattcagaccctcgtagcagtgttctggaatcctacgtgcgggacaatcactcagaagccagcagcactgttctggaatcctatgtgaaggacaaatattcagaacccagaatcaatggattcctaaagtctcgtagcagtactctggaatcctatatgaggtacaaacacgaaaaacccagcagcagtgttctggaatcctatgtgagggacaaacactcagaacctagcaacagtgatctggaatcctatatgagggacaaacattcagaccctcgtagcagtgttttggaatcctttgtgagggacaaacaatcaggacccagcagctttgttctggaatcctatgggatagacgaacactcagaacccagcatcagtgttctggaatcctttgtgagggacaagcaatcaggacacagcagctctgttctggaatcctatgtgagggacaaacgttcagaccctcgtattagtgttctggaatcctatgggagggacctacaaacagaacccagtgacagtgttctacaatcctttgttagggaaaaacattcagaccctcaacccagcagcagtgttctggaatcctttgggagggataaacattcagacccccttagcagtgttctggaatcctatgtgagggacaaacactcagaacccagcagcagtgttctggaatcctatctgaaggaaaacattcggaacctcttagaagttttctggaatcctatgagcagtgttctggaatcctatgtgaaggaccaacagtcagaacccagtagcagtgttctggaatcctatgtgagggacaagaattcagacactcgtagcagtgatacagaatgctttctgaaggaaaaacatgcagaccctcatagcagtgttctgaaatcttatgtgagggacaaacactcagaagccagcagcagtgttctggaatcctttgtggacaatccctcagatcccagcagcagttttctggaaacctatgtgaggaacaaacactcagaacccagcagcagtgttctggaatccaatgtgagggacaaacactcagaaaccagcagcagtgttctggaatcctatgtgagggacaaacactcagaacccagcagaatttttctgaaatcctttgtgagagacaaactttcatagccctgtagctgtgttctggaatcctatatgtggaacaaacactcagag

SEQ ID NO: 469299 - DNA, 1951 bp, Homo sapiens
tgaagagattgtgctgattcctttaaaggcatattcccaagatgcagccagacctggtcacctgtctggagcaaaggaaaaagccatggagtatgaagcacccaggtcttactatacctgagagaattcatactaaagagagaccctacaagtgtgaagaatgtgacaaagcctttaaacaatcttcaagactgaataaacataagaaaatttatactggagatacaacctacaaatttgaagaaagtggcaaagctttttactattcctcaggccttactcaacataacatagttcatactggagacaaaccctacaaatgtaaagattgtggcaaaatttttaagtggtcttcgaaacttactatacatcagagaattcatagtggagagaaaccctacaaatgtgaagaatgtggcaaagcctttaagcaatcttcaaaactgaatgaacatatgaaagctcatactggagagaaattctacaaatgtgaagaatgtggcaaagcttttaagcaaccttcaggccttactctacataagagaattcatactggagagaacccttacaaattcgaagaatgtggtaaagccttttattggtttttaagctttactaaacatatgataattcataggggagagaaaccctacaaatgtcaagaatgtggcaaagcttttaagtggtcttcaaaccttactatacacaagagaattcatacgggagagaaaccctgcaaatgtgaagaatgtggcaaagcttgtaagcagtctttggggcttacgattcaaaagagaattcatactgaagagaaaccctacaaatgtgaagaatgtgagaaacactacaaatgtcaagaatgtggcaaagcttttaagaagtctttagaccttaatgtacataagataattcatagtggagagaaaccctacagatatgaagaatgtggcaaattcatactgaagagactgtacaaatgtgaagaatgtggcaaagcttttaagtggtcctctgagcttactatacatcagagaattcgtactgaagagaagccctataaatgtgaagaatgtgtcagagtctttaaacactcctcaaaactgaatgaacataagagaaatcatactggagagaaaccctacaaatgtgaagcatgtggcaaagctttttaagcagtcttcaggcctcactatacataagagaattcatactggagaggaatccagaaatgtgaagaatgttgcaaagccttttaccggtccttaagctttactaaacataagagagttcatactggagagatacactacaaatgtcaagaatgtggcaaaactttttcttgttgctcaagtttactcgacataagagagttcatactgaagagaaatcccacaaatgtaaagaatgtgggaaagcctttaaccagtcctttagccttactaaacttaggagaattcatactggaaaaaaatcaaacaaatcggaagactgtggcaaaatcttttaagtattgctcaaatatatccagccataattcatactaaagattatgcctatgaacctaaaaaagtttggcaaggcttatgaatacacctcaaactttcctaagcattggagaaatatcaagtggtttaatcatatgaaacacagcaagagctgccctttttgtgccttccctatcattaccaccagcaccagaaactccagttgccccaagctcaaaataaaagccctaagatactttattgttagtgtatagaaatgttactgaattttttatgttgattttgtatcctgcaagtttaataaatttgtttattctaataattttttgtgaagtcctaggtttttctatgcttaagagtatatcatctgcaaggaaaatataatttatcttcttcattttatttaagactgctttgattttgttgaataatttttctgtcttggt

SEQ ID NO: 469300 - DNA, 850 bp, Homo sapiens
gggcaggaagcgtcgcggtcgctcccggagcggggccgtctcccccgcgtcccccttagcctggctggggacaggcgctgggacccggctcgcggtcagggcggcctgggatcggcccccgcggcccctgcccagcgtcctgcgctgggaacttcgaggcgcctggggggctcgaaatggcagtggaggagaccccgcgagtgtccaggcgcccagggcccctccgcattgtcacgggggccctcacaccccggcaggtgtcaccccctggacgggcttctgccgacgatcccttgggcacctcctcttccccatcctgtggggccggctccgccctcccaggtcccaacttcaccgggctgtgcaggggcccaggcgtccccgatttcaccgggctgtgcagcggtcccggtgtccccgatttcaccgggctgtgtaggggcccaggggccttggtggcctctgactcacatggcctgttcatggcaacccccgctttgggaaagctacatcatgagggtcgctcctggcgtcctaaagtgaacctctccgagctttcagccaacgacctgcgccaggttgtcctcaggtctgtgcccctcccggacctttctgcagagatgaagcaggtgcccggacaaggtgtcagctggagaacacgccacacgtaaacaaaagacatgtatgaaaaaccacacaggagccaggacgtgtaacaagttctgaacagtagcagcaaagggatgagttgaacactgaggggtgagtgtttgtggggtggtctcgaaggcctgtgccctgatgaacaccaaggggtgagtgtgtttgtggggtgggagtcaaggctgtg

SEQ ID NO: 469301 - DNA, 1099 bp, Homo sapiens
gaccagatggcctgtgacgtgcaaacccctgccacccccacacttgtcacatgggttgccctgagggctggggagctgcaggcgaatatgtacaaaacatatgccagccgccagcactccggcacagactctatgatgaaacaaagctgaggaacatactctaagtatcatagaccatgagatttgaacacccaaacatcaatggtttgcctgctgcaggtaatcgccgccgtgtgggccacagagcagggcggggctgggtgcagagccggaaccccgtggggcagagcccgggccccagaggctcctacgcccttgaaaccctgaatggaggtcttctgagccggctggatgtggttctgcccgtacggaagctctgccacacgtgtatgagctgtgggtggaaacgctggaccagagcgctcaggcagagcctctccgcggtgctgcaacgctgtgccagagcggtccggctgtgggtggaaacgctggaccagagcgctcaggcagagcctctccacggtgctgctctcaggccgcaggccctgggctatggtccgcggcacgcaggcaggaccatcgtgagctctcactgtgttaccccagaggagatgctggaccaggaacccatggagggcgcagcacaagatttcctcctctatcacgagaggcacaccgtcccgcatagggctgctgttaggcccatgggagccaatgtctgtgaagatgcgggggcggtgctgggctcgcagcaggtgctagggaaacgcgccattgctgctgacttcctgagggatgagaatgacggctgcaaaacaacagcaacgaagcacacctcctaagttgagaaggcttgtctggcattacacgctgaagcctgtgaatactgagtgtttccatttcaggcagtattttaaggccatacagttacggccaaagcaacgaggagctgagaaatggtgatttaccctgcagacggttttgagcggcgtggttgagattcgtgaggctttaggttattttcctgagttcagaatcaggagtccttgtttcgtgtctgactccacagccctgatttcctgggcttctctgtccaccc

SEQ ID NO: 469302 - DNA, 3307 bp, Homo sapiens
gctggccaccggcaatcgccggcatgcctcagcttgtagacgcatcgccccagtctctgcctgcaccctccaagggccgattctgtactctcaaaacgctgagatccctggagcttgcagaaaagctgagcatcacagaccgtcccaaccacctcctttctggtactgaccaaaacccagtaatgatcgcgtggagggtggatgctggggacaggcacaggccctgctggtcccagagaagccgcctccatgctgtcagccccagaatgactcaaacaagcccgtcacaccttcggcaaggaccagggaccccaccctctcgttcctatggagcctaccacccgtggtgcctgaggctgtgtctgtcctgcgtggagcctggcgtggcctgcatgggggtgtgggtcctcctccctgaggctgtgttggtgaccagtaacccgtgctgaccgcgggtgaccagtaaccggtgctgaccgcgggtgaccagtaaccggtgctgaccgtgggtgactagtaaccggtactgacctttgacccactcatgtctgtttcttctgcccctttttatccgtcccatagacggtggcatttctcagggctttgtcttcaacccccttcccttgccactcaacctgcctccctggggccctcacccaggcatgtggtttctgcttcttccagcgctgacagtgcccttcccggagtgctggctgtgggcggagcctgtgcgcccgtgcgtttgtgcctcgcctgtttggtcctcaggcagtgtggcgggcagggcatgaaacagcccctgaccgagcaccctctgggccctgttctgtttccccccaaggtactcctgtcatctgtggatttttctgtttttttgataaagcattctgaaataaatcaaagccaccatagaatttcagataccatcatcacacttttcaatacgaacaataattcatctaatactctgcttcacattcctccaattatcctagaaatactgtttttcctgttcatttgctctgtttttctggaatggctttttgtgcccctgtgactatttgagtctgtgacaccaggtgaccccaccctaatgtgtgctaagaatttgatgtagaaaataaaataatattcaaagcaaagggatataaccttatgccagtggttctcaattggggacaattttgtctctggggatacttggcaatgtctggagacatcttacattgtcacggtgcaagggagctcctggtatttaattgtagaggctgtgaggtgctgccaaacgtgccacaaagtacagggcaggcctcgcaaagcaaagactcatccagcccacgatgtcaattgtgcagaggctgggaaactggcctagaagtgtcacaggacactggccacaagcccacacaaaggaggacctctctctacttttgttgtttctactgtttgttgaacatttactaaatgccagtcagtatcctacacactctggatacaacacctcatttaatcccaaaacaactctgagagccatgtattccataccattacccccattttatagatgagaaaattggagcccagagaggggccaggaaacacgagtgttccttttgtgtgaagtgtcttgccagcctcatttccctgggatgcctccatcctgtgacagccactgccctcatcacactgacacgattcctccgagctgcccaagggcagtgtccctcgtatcacagttgtgctttattcttaaaccttgtttctgttcagtttgaatttccttttccttgttaccagtttccagttctttggtgcactctgcctttgccagccaatcccctctgttgagaatgcatctctgcacaatgccgtaggggtgtccctgggagatgaggaggtggtacaactgcatgctttgctgtctgtgcaggagctcagtcacagacacagctgtgacttatgactgaggagctagcactgaagtttgtattccatgcaattatttgtagctcatataccatggtaagtgaaatttgggaaactggtgttatttaactaaactgagataactgaaatttctacacgggacaattgtgcaaggaaggtgctacaaggcacatgattacacagtccacaaatgtatgcatgtgtgtgtgtgccacgagagagactggaattaagtttcatttcctaggatgcagttgctatgtttttttggcttgctttggtttttttttaatcatatacattctttctgtttgcactttttttttaaaacaacaagcatgagttagttccatagtttaaaaaaatcttgtaaataagcatatgtagacgatgaagatttttttcaaaatttttaaactgaattattgaaataaaaaagagatcagggttaactctcagttaaccagaaaatttaaataagcagatgattctgtgtgtcattctgtatctattcaatgagaaatagaaaagatgtttgtgtgtgtgtgtgtctctgtatctgctaacacagaacctgcacttcggcaccatgcccgggtgttgcagaggcagaggaaagtttgaaaggcactcctctaacatgatctagaaaaaatgaagtcgaactgggaggggaaactgctaaaacatgatggtaaaatattgataattgccagatggaagtttgcatgagttttcttgtattgttctctcttctaattgtgtaaaggataggagttaaaaataaacccgtagtattaccttgtttggttcttatttacctattactgccaatagtcaatttccctaataaaaaagtaaattcttctcttgcatgtgaaatcacagtttattcaggtatgaatcctctctggtaaatccgaattttattgtatgtttaacctgataaatgaaggatttgttaaacactcaatgaattgactagggaaaaaatgaagtattcagcccctttaaaaaactgacaaagatctagtgtttatgttataataataataataatgcaagaaggctttcctcctattttacttcttcattctgaaaacacttctttagtgcttaccttgcaaggtgctttttacacagtttacaaacattagtccataggattcattcactcctcaaacttaccctgtgagtcaggccacctagaaacacacaggtccgaggagagcacagcatgtctgagcttgctcccagattccctctgtctgctcatatcacagagacctgaagccagggagcctgcagccctgaaggggccgctcagtgggtacaaagcccttcccacctccaggccctc

SEQ ID NO: 469303 - DNA, 691 bp, Homo sapiens
agcaggtgcaccatttatcttggtgtcctgctctccgtgagatgctggcctgcaggcgtctggctggctggctcacagatggctcttctccaaggcaggagcaatggctgtgggtacacccatgtccttgggagacaatggaggctgtggggctcatggcctctgtggagacgacgcagggacccctgcgttctgggtacctggacctgaggaaggagccctcggtctggggtggatggagccagtctctggggatccattggctgagattcccaccccattttgatggtaatttcaatggggggtcccatcacccttttggccagcacggcacctgcccagcacctcctagcaccgccagcaccactcacggcgggatacgacttcccttcaccaaccccaccctgtccactcgttatcctaggacgtgcggcccctactcacccctgggcccctctgtgcccagggcccacaatgctagagagaccttcgggggggggggggcatcaccttattggctgaaggaaaaggagcgagataacggccccctgccccggctgctgcgggtctagatgtggccacccgccttgtctcgcctccggtggttggagaggagcaggggtggacagtgtcagggatgccagcacagccttggcctggaagccagtggacttcttgatccttcatctgg

SEQ ID NO: 469304 - DNA, 826 bp, Homo sapiens
gcagtgctgtatgttggtttttggggtggaagacagaccctactcctgtctgggttcccacattttcctaatgacctgcgaatccccatggatcccagatctgggctgtgctgtccctgatgtttcttctcccacaatgcgcgcccttgggaccgtggctgccctgtctgcacttggagcaagcaccgtgtacactgttggtgctcagtcaatgcctatgaaatggacccaggtcacggcctccaatacagctacacagaatgggactggagacctgaaatgctgcctgtgcctcgtggcttctgtcagaggggtcattaccaaggaaatggagaggggctcggttcttgaccctaggaagtcatgtgaacacaacagcctgacctcctgggagctctgggaagtccaggtgtctgaaccttgcttgatctggagatataagagggagaggctcctggggcccaggggtgttgatggcttgatgggtgagaagcgcaagtggggagagtttgagaagtgaagacgctccctgcatggtaggacagtggacgaagctcgcgtattcaacctggccgctgtcttcatggagcaaagggactgattcctttttaagcataagtagatgtccaagatggcatctggcaacagattctttcttctctgtgcactaagagtggagatttctttgatctcaaaaagaggaattagaaagtagcaaacattcataccttctcttggcaagatataaaatgttgcagacatacaccataagatgtaaaatacattctgtaaaatataaaatgtgtgcattacttacttttgtaca

SEQ ID NO: 469305 - DNA, 1348 bp, Homo sapiens
tctccatagacagactggggaattttgtaagggtcagtgagacaggatggcacccttgctgctccaggatctagctaatcacagcaaagggttggcgtatcccagtggcaacccagcccccccaactgccgccgtccttgcccgggctgatcacgacaagggttggcatatcccagtggcaacccgggcccctccactgctgccatccctgcccgggctaatcacgacaagggttggcacatcccagcggcagcccggcgcccccccaccccgccccactgctgccgtccttgcccgggctaatcacgacaagcggttggcatatcccagtggcaatccgggcccccccactgccgccgtccctgcctgggctaatcacagcaaagggttgatgtcactggaatgcactcttatgttcatgctgatttatctatccaagtggtcggccattgttatcatcgggttcctttcttggtggacatggactccatggaagcctgagctgccaggggcttccctggggcagcactgcttcgcgtaggctcacgagaaacttccagggttcctgggaaatgaatgaaaataaacaaacaaattccttgcattcaacgcagcgtaagaaaaatcacatcctgttccccagtagctgaggaaagccggctcacgagagtatacagggagaagaggccagcattgtgtggctgccagcaaagctcacttgtatgtcaaatgcagcgcttttcttagcccattatgtattttttttttcttgaacactcctgtgtctactgggatctcctgtttttattgttttgggatgagattttaaaaacaccatttaatgtagcctgtgtgctcttgttcattaaaccaaaaagaaaccctggatcacggcacaggagactctcctccccgttctctagggatgcgccctcatggggaaaccctcttttctcattatttttgatggtgtgctctaacaagacgatctggaggaaactccatgttcacaggacacattcctgcaacgtggcttgaagggcccacaccagggtttggctcatccatgtcgcaaactagaggggaggagggtgctggctatttcccatctgcagtctcagtttccccaccagaggactggagggagtacttgggtgggctgtgatgcaatcccggcacgaaccccccagcactggcattggagtcggaggtttgggcatagtcgccaacatcgcacttacttccatgccagcaccaagtctgcggctccccaggccactctcacttctgaccacaagttcaaggctcccacagcctctctggggtccgtagttcactagaacgactc

SEQ ID NO: 469306 - DNA, 1578 bp, Homo sapiens
gcatcctccaggcttccatgtcctcgcattgtgcattcaccttagaaacgtcacactgggcgacagtgctccagatcctagaaatgtcaaagcgttccagcaggaccctctctgcagggtgtgtctgtgcccagaagcctcctgtgggccctgactcagggcagcacccgctgcctccaggtgaggggcttctggcccagggcggcctggggatgggtgctggtgtctggggaaactcgtggctgcacgatgcttcgcagttctcaggaaatgtggacggcagggccttcctcactccagcagcggcggggaccagcgtgcattggataaaaaagaccagaaatccccgcaaaatcagtacaagatgcagtcagtcgactccagccttcaaggaggaggcgtcctcaggtgtctcaggcactgactcccggcacctgcagcagcaccggacatgtggccagagggacagccagctcaggcacacgccagccgcaatcgggctgctctgtggtgatagcagcacctgcagagagaagaccgaaggcagtgagagtcaaaaagagggcagtgagagcagaggaaagcggcagaggaagaaaagcctgaaggcttggtgcaccagaaggctgtgcgttcctgcctgtggagggtttcgctcccgcatcttgctgatgccctcttcctgcgtctgcatgtcctacccccacgggctgtccttcggggctcaggtccactgagcaagtgtaaggatggcctctcttttgaaagcagcctctctaggcagcacactaattactcctggggagcaattttcccatgaccaattccataacaggtcaacccctccctcatccttcttttaaccaatacggtaattcaatatcctgttaggaaggccaatcccctccccactgcatggtgccattgtggtcactgatttacctagagggtgtcactgcagatattttctgacagccacattcctagtttttctcctctaactcccacaaagactcgactgcggatgattctaaggcagttgtcatattccttctcagagggttgtgaatgctcacctagttacgtattcattctggggaatgcctgatgtaccattccaaatatccatgtcccttctttctaaacatccatttaccttccaaatatccatgtcccttctttctaaacatccatttaccttccaaatatccatgtcccttctttctaaacatccatttaccttccaaatatccttttccgttttttccaaaattaactaaaccatgatttttcactgagcacattgctacactatttcctggtcttctctgcaattatatgtgaccatgtgaccaagttttttccaatgaggtgtaagcagaagttgtgtgttccatgagacctcagagtagtctcttgaaaagggaaggagtacaccatttttcttatcccctccatcctgctgttgggaacatgacttgatggctggagcatcagcagccattctggaccatgagagtaaggaccaccctgccccccaaagaatgataaagcagaaatcagggaaggttttggatt

SEQ ID NO: 469307 - DNA, 801 bp, Homo sapiens
tgcaggattcacatgctaattatggttcttttcgatgggagcctgagatcaccactgcttctagttgtccatctcggccccacgtccaccaaaacaatcttgataaagaacaaatttggtgttcaagaaccaaaccttcatatatgtgctttccacaactgtgaagaagaaggctatgattattgcagaatcaggtacttcaagaatgaaagtttgacactcacactaccaagcaaggttggaaaaagtttgaaatggataatgatggaaggaggcaagcgtgagtggacactggtggtcatgagaatgggagcatggttgaccaagaaccctagctgctgtactctggaatttatcagccacatttgcactgaagataaatttctcactgactaatcaagccaatgactgaaagtggtttgccactgacaaaatccttgattagttaaaactgacagtgcaatatcaaatagcccaagaagcttggataggcaagaggctaggaattactaattggattaaattgattcattttgctgattgatatggtttggctatgtccctacccaaatttcatcttgatatgtacctctcataatccctaagtgtcatggaagggacctggtgagagctaagttagacatagtctgtaacataaacaaggtcacattatttattactgacaaattttacacttgcaataaagttcattcattaatttctttctcctaacaaaattctaagcttgttaaaagtaggcaaaattagtttactcaccaatgcctacctaaaatagtctgg

SEQ ID NO: 469308 - DNA, 2033 bp, Homo sapiens
gaaagtttgaggagaagaaattccaacagcatctatgtgaaatgatccagtggggcacccacatctggacaaggggaacgtggtggcagccggatgattggagatgccaggaaccctcagagagccccaaagagggtgtcacagtcctggcttggggagcccctaggtctgggctccccaaagggccacagctcttctctccttcttgttgcctgcaacgtggtgaatggggggtatattgtggccctgtttgtgttacagctttttcagtcctgcatttggtgggtcctgacttcttgtcctacattcggaaagaatgaagtgtgcagacaactggagggtgttcctggaaaaaggaccatccaattggccaaatggtcatcaatgaagttctcactcctggctgcagacttcacctggaactggcagcccagtccccagccttcaggccggccctggcctgaaggtggggtttcactggggacccaccacttcccacctaggagcctgtctgccttttacatgccatccatagatcccaggctgtcagtgctgagaggtacccacgggtaaacacatataatactaatgaggtatagaaaatctcatatttattggcaaataatttatgaataatagtatctaaggtatttgaaaaacttgcttgaaaatgtgtcatcatattcaaaatgtaagaccctaaaagattaataaataataaaattaagatctagtttagcaatagaaaaaaaaatattaagttgtgctttactacttatatattgcctagaccattgtttcttaaccttaacactattgagatttggggtcatataattctttttttctatatttatatgtacaataaatatgaaataattatatagagtgtgtattcataaatatgtatacatacatagagaatgagagaaacagagggaatgagagagaaggagggagagaaaatcaataactgttgacgtgatgatgatgaaatccccattagtaatggcctagactttaagcacaaataaccttgaggttctagttcctaatactataaaaccccttcctttctcatcttttattcaaatgcctagaattctaacatatttaaacctgagcaagaagacaaatcttatgagaagtttaacatcagaatataatctctaaatatacttacatctaatatttgtggaccacagtcagattttctcaagttattaaatttctcagaaaaatattacatttacaaaggagcatcagaacatgattgttgtctattttatttaacaaagttcttcacataatatctcaccctcagaagtgaggatgaaagtaatacactgaaataatacatattcctaaactaatcactaaagtcagttcaataaagtaaaaagtcattcaacaaagtcagtgatactgttgaaaggcatataaacacatgctctaataatgaaaatctatgtacatatgtgcttacataacttttctaaagttaaatcaaattagagaaagagcattttaagttttactagaatatctttggtaatcatatacacacagaaaaaaagtttgtattttttttagatgagattttatgatggtaataacgagtgctatccctcctaaaaatgttttttttctagttttattgaggtatgcttgacaaacaaaagttgcatatatttaacatatacaatgttatgttttggtatacatatgtataaaccatgaaataattaccacaattaagctaattagcatatccatgacctcacataccatacttatgacttttgtgaatgtgtggtgagagcacttaagatcaactttttttgtttggtgaatttcaagtatgcaatatagcatcattaagatttcttttcttcttcttaacctatagaggcaaataccattcaaatttcagcattttgaacaaaaaattattaaagtattaccatactaaaattataatacattaaattcttaaatcatggcatacattagattatttggaatgacccaga

SEQ ID NO: 469309 - DNA, 687 bp, Homo sapiens
ctgggggtttgagctatggggcaccaaagaagcgagccacaccctcgtcacatgccctgaaaacggcagtaacttctgggttgtggggtccttgccatggaactcccaggtgttgctgcgtcaatggtaaactaacgtgccattaccatggcgatggtaaaaagcactgggaatttgaaagacgttcctggaggaggcagcactgaagaatggcaatgtgaaaatggattaatacagggattattagatgctggctctaaattgacactgatcttcaatgatctaaaatccaacataggccatgaatcagagagacaacttgtgcagaggcggttgctggctgcacactatgttctcctggaaaaagaagctctcacagtccctgaacttgtgagtctccctaccctgctgttctgtgtgcctcgggtcatggaagcaatgactcacacattctgcatggccgccaaggcctccttgataccagatggaccaaacctgtaccttccggtatatcccttttatgggaagtggttggcctcccctcagtttagtattttgtcagattccatggtgttgaaggagtaagcttttgccacacctcatggctacctggggagtttcttgagattacttgaatgagttcttacactttgtggatcgtattgaacccatgaatgtgatagaact

SEQ ID NO: 469310 - DNA, 1303 bp, Homo sapiens
aaccatgaagggctgcagcttcactcctgaggccagcgagaccatgaacccacgggaaggaacgaagaagttcagatgcgccgcttttaagagcttagaaaagaaaaacccattttctgaggagaaattcatggcagctgcagaaatttgcatgagtaacaaggagccgaatgttaatagccaagacaatgggaaaatgtatccagggcatttcagagaccttcatggcagcccctcccatcacagacccagaagaataggagggaaaaatgattttgaagatgagggagtttggaacttcctagagacgttgaatggttttgaccaaaatgctgaaaatgatgtggacgataaggtcctcgttgaggtggtcacagatggagatgagaaacttcttggaaactggagcaaaggtcactcttgctatgctttaacaaacagcctggtggcattttgcccctgccccagagatctgtggaactttgaacttgagagaaatgggtcccgctcctctgtgtatcctccagacttggtgccctgcatcccagctgtttcagctccagccatggctaaaatgggccaaggtacagctcaggctgttgcttcagagggtgcaaaccccaagccttggtggcttccatgtggtgttgggcctgtggatgtacagaagtcaagaattgagaggatgtatggaaatgctccgatgtccagaccgaagtctgctgcaagggcagagccttcatggagagcctctgctagggcagtacagaagggaaatgtggggttggagaccccacacagcgtccccagtggggcactgcctagtgaaattgtgagaagagggccactgtcctccataccccagaataatagatccatcaacagcttgaatggttcatctggaaaagccacaggcactcatggccaacccatgaaggagctgcccacggctttgggagcccaccccttgcatcagtgtgccctgcatgtgagacatggagtcaaaggagataattttgaagctttaagatttaatgactgctccactggattttggacttgcatggggcctgtggccactttgttttgaccaatttcacccatctgggatgggaatagttacccagtgcctgcacccctactgtggcttgaaagtaactaacttgtctttattgtataggctcataggcgaaagggacttgccttgtctcagatgagacttcggacttggatttttgaattaatgctggattgacttaagaatttgggggactgttagaaaggcatgattggtttgaattgc

SEQ ID NO: 469311 - DNA, 464 bp, Homo sapiens
ttatatcgtctgagcacacattgtagaatgtgtatattctggcaagagtttctgagggtaaagttgaaaggttggggagttcgggaaattttcgaggggtggattgcgaatactaaaaaggctctgtcaaaaaaaaaagaagaagaagaagaagaagaagaagaagaagaagaagaagaagaagaagaagaggaagaggaagaagaagaagaagaagaagaagaagaagaagaaagatggaaagcactgagagtggacagagggaagatacagaagctgggtgaaggaggaggaagtcgggagccctggacggggctactgtgcactggtactcattgctggctcccaataattcctggagaactggcaaagaacaacctacttacacctctgcactctggaaccctggaaggaggagaccccttgaccaccagagataattgagttggcagggagagctcctt

SEQ ID NO: 469312 - DNA, 2216 bp, Homo sapiens
aaaggcaccactgtcaacagatgtttctggatggcgaagagtcaaatgttaatcactgagaaaatggggacaatgtctccaggctatgtcagaggtcttcacagtagcccctcctatcacaggcccagaggcctaggagagaaaaatggttttgtttgccaggcccagggcctcactcctctgtcctctcctggggacatagtgccctgtgtcccagccatggctaaaaggggccaacagctcaggctgttgcttcagagggtgcaagccccaaaccttgacagcttacatatggtgttcggccagaatgaaaaatctaacttgcttaaagcaaaccatggacttattgcttcaccattcttgcttgcggagctgaatgatgtcaccaagacgctggttcctctgctttctgatgtcctctgtgctggtctcatgctcaatcaggatacccttaatgctgaacccttctcaccttctcaaagcttcccatgcaggagaagataaatcatagctttccaacaatggagaggtcccccacgtctggacctctatggcctaaattaggtcacataaaccattcatgagtcatgccttttgtcctgtaagataggatacactaattattacaccaatcaggactgactttgtagctggggttgtcaacttcccccatataaatgggttagataactgttttcagaacattgaactgtcttcttttcctttgtttccttttttgtcttctttttttattgtaaggaaagaaagcatattataaagaaataaccataaaaatgggcaaccagcagcccttggggctcctctgtctatggagtagctgttcttttgtccctttattttcttaataaacctgccttcactttgcagcgcggactctccctgaattcttccttgtgcgagatccatgaaccctctcttggggtctggatcgggacgtctttcttgtaacaaaactgaagagtcaatgggagcacaggaaattcaaactcattttatatgactatctctaaatttctttttttatttctctctccttattcccatccttacttccttcccactctttttcttctacttattaaaaccaggccgccaagcataaggttctaatgtgttcagatttataatgaagaatggagctttaactgagatagtgtgaagtttgccataaattttaagcaaaaatctatagaaatatataattttggttcatgtgcaaaactagctattttcttaatcacaggaaaattatatttagaaatacttgtttttcatatttgtgaaagtcacatttttctatattgtatgcaatataaaaatgtatgacattttaaagttttttttttttttaatttctaatcagccttgtttcttactgtgtaaaaatcagaaattgccttaggtaggtcagttgactggattagatacagaatatgtgttttcgtaacaagaagacattttggcatggctttgatatttttatggatgttttaactcctaaatatacgggcaacaccaacaaagataacttattactttattatggaggaaatgattgtaacaaagtttgcatagagccacactataaagctcaactcaaaattaacacattttgtttgtttgttcctaatatcagaagtcagtccaaaaacacacttttgtatgttaagattagtatgttttctgttagaacacttttcttttatcatagccatgtagcatgttatataaaacaaattatccaagtgtgagtaatgagcacttccatttggatacagtttgaaaatgcataatattcttttctcacaatgagagctaaagcttagacattgctatgattaccactagtttggcaagattttgtgagtcagtaatcttgtgtcatttctccaaaaataagaataaaacaaaatgtcagtcatttatacattaatgtaaataaaagaatagaggaaataagtgaactacagttaaattctaaattaaaaaaatattcttttctgatttacatattttaaatgctcctatttttcacatagaattgctgcctttgttacgtacattgagaagtccctaaatgtaaaactaaaattacaaaagttaaaaagcaatatattttctgattaaaaagctagaaatgttttctttgtgcgtctatgaaagtatttctcctcataggttaactaatggatagc

SEQ ID NO: 469313 - DNA, 689 bp, Homo sapiens
ggtaacagccatgtctattttctttgaaaaggatctggaatttatagaaaacagtgaaaatttttctgatcaaattttattgggcaattattacacctttccttctaacctatcatacattaaattattagaaccagagtctgagataatacttctggtggagtggctcggtgtcatccaccttcctatcatgggaaggtttcatgtctttaggcatagcagtgagctcctcaaagaattcaaggcaagtatttctacatttctcagttctggcaagctggcacttttggacactccactgattttttcagttttcatcacttcaacaatacagtctatttatcatctcacatttttaaaatctttcctatgttacaggatcaaatgccatacatccagacaaattctctcatcttatactccaataatagacttggattttcattataaattattacaaaaataccttcctatcactgtaataccattgtaccattatagcaaaatgacattttctctctcagcttaaataattatctgtaaaattaaataagatattttggttaatccagtaattaaaacacacttatttcccttgctttatatattgtcagccttaccacaaaccactttactgaatgttctatttatttatattaatattaatgtaatttctttattatttttgg

SEQ ID NO: 469314 - DNA, 1350 bp, Homo sapiens
ccattacaagtatttaatcttcgtgtttaattaattaacatagtaaatgatcacctcatttcctgtgctctattttcatgtcagagcatacagtaaaagacagcaacatccgagaggacagggggctttctgtatcctggggttcttgcgttggtgtaccggaaaaatcagatcacacgtgggcttggagaatgaatgcaaggtttccttgaatgatggaagtagccctcagcagatagatggggagccagaaggggtatggagtgggaaggtggttttttactggagtcttacccctcagtggccagactctcctgcaaccactccagccaaattccccttggcgtccatgttgttctgctggttgatggcctgctggcttctgccagtgcctgtgggtctcctcttccgctcctctgcgcctctggacatccagctgcctgtgtgctcttctgccagtgtgttcctctcgacacccggccacttgtgtgtgtgccatctagggtcttggctgattaacacaagccgcctacagatgatacaactaaaagggcacactgtaacatgcccactgtggctaggtgtaatatgcctacactgttaactacaccgtggctagcatctggtgtctgctggtaatccttgaagcttcttggcttgtaatccgtcactccaagttctgcctttcatatggtattttccatatgaaaattccatatgaaatttcacatggtattttccctgcatgtctttttacctcctgcctctgaagctaatgttctgtccatataatcccagtatcatataaaatagttttgtagggagaaatggttgacttaaattgacactagacttgatgatcttagagtactcattcacttaaagatattattttatgattacattacaatttagaaatatagttactagattgacgaatcatcagtgatccagatacatcttaaataaggtaactttttagtctgttgatgcaagcaagaaatagtacattggctgaaaattggtgaaacactaaagtacaagaacaggattcagaaagcttttaaaatgtgatgatccagtgatccaaggttggctctactaggcacatgtttcctaactgaattattcttatcaaacttatctcttgtagaattatgtcaagtaagatttggagattgagtttatgatatgagtataaacagcctatggctgactcttgcctatgtattttctttatattctggaaatggcttctttattactttatctgaaatgctacctattgaagcttctgattttcaatttttcaattactcaatcttctaaaacaggggtgtccaatctttc

SEQ ID NO: 469315 - DNA, 576 bp, Homo sapiens
gattgactttctgtgctatgagcaatgggaactagtccaaattcccagtgtttcagcaacaaactgtgtaacatttatcaagatagtagagaggatcctcctgcaccaagatatctgcaaaggggaagtggggtaactgagactgctgaaccaggcaagcaggttctccgaatgcctggagatctgcttggacatgtagcagagagggcccttctgcaccaggatctcagcacaggaagagtaagcagtgctccaaatgctggaggtctgcctgagcatagagcagagagggctcccccaacaaggtctctgcaaaggagggctggagtgactcaagttgttgtaccaggcaaacaggtgctccaaatgcctggagatctgcctgggtgtggagcagagacagtctggctgtatcagtctatgtccaggaaaggttgggcagctcaggctgctgaatcagccatattggcagctgattagatggtacccatcaagattgagggtgggtctgcctctctcagtccactgactcaaatgttaatctcctttggcaacaccctcacagatgcaaccagg

SEQ ID NO: 469316 - DNA, 1269 bp, Homo sapiens
gaattagtttaaggaggctgttttgttagaggctgtggttgcattcaaaaattggaataggaacaatgacttctgtaagctccacgcagttcaacaaaggcccctcctacaggctcttggcggacgtccagaaccggttcctgtccaaatatgactcccagaaggagaactggtaccagctagaaagcctctccaacctcctcaaggccatggtcagctacagcatgaaccccgtggacctatttgagaccaacgacctgtttgagagtgggaacgtgaggcaggtgcaggtgtctcttctcgccctggcaaggaaggccaagactaaggggctgcagagcgaggtggacatcggtgaggagtactcagagaagcaggaggggaacttcgacgatgccaccatgaaggctggccagtgcgtcatccggctgcagattatcaataaacgcgccagccagtcaggcacgactcctccagatgggtacaagcaagtgtgccagccaggtgggcatggcggctcctgggacccggtggcacatctacgacacgaagctgggaatcacaagtatgacaactcttccacgaccctgaagatgggctacacgctgggcaccaaccagagcagccaggtcttcagcctaggccgacagatatacgaccccaagtactgcctgggggcacagtggcccacggggctccctcaggtgcaggcgactgcccggggccagcggaggcccctgaatatctcccttactaccaagaggagaccagctactgaggctcccagcacgctctctccccacatggtctccctgtctgggtgtttgggactgagccaccgggctgtgggggaagggatcaaggccatatcccgatgcgtgtcgggtgagggtccccgctggcgcgtccaggctgtgggcctagctgtgctggggagacgagacctgggcatggagggaaccggtccccgaaggtttcccgttgcctcgcctcttcccccttttgtcagccgatcagtttgtggtttctgtacccgcaaaagtttcaagaagtattaacaaaagaaaaaaaaaatttttcccccaggaatggggcagggacagtgggtgctgggaaatcagtcccttgggacagggggccaggccaggatgctaaaatatctcaggctcctgagtggctggatttccctagcaccctcagaccaacagacctcagaccctcagacctacgctggggcccggtgaggaaacaggcccatacaaggtagtg

SEQ ID NO: 469317 - DNA, 2055 bp, Homo sapiens
aggacaccctaagatggcggcgagggagacggtgaaggcccgaaccaaagacctccgcaccgccgtgtacaacgccgcccgtgacggcaagggggcagctgctccagaagctgctcagcagccggagccgggaggaactggacgagctgactggctaggtggccggcggggggacgccgctgctcatcgccgcctgctacggccacctggacgtggtggagtacctggtggacccgtgcggcgcgagcgtggaggccggtggctcggtgcacttcgatggcgagaccatggagggtgcgccgccgctgtgggcgcggaccacctggacgtggtacggagcctgctgcgccgcggggcctcggtgaactgcaccacgcgcaccaactccacgcccctccgcgccgcctgcttcgagggcctcctggaggtggtgcgctacctggtcggcgagcaccaggccaacctggaggtggccaaccggcacggccacatgtgcctcatgatctcgtgctacaagggccaccgtgagatcgcccgctacctgctggagcagggcgcccaggtgaactggcgcagcgccaagggcaacacggccctgcacaactgtgccgagaccagcagcctggagatcctgcagctgctgctggggtgcaaggccagcatggaacgtgatagctacggcatgaccccgttgctcccggccagcgtgacgggccacaccaacatcgtggagtacctcatccaggagcagcccggccaggagcagctcataggggtagaggctcagcttaggctgccccaagaaggctcctccaccagccaggggtgtgcgcagcctcagggggctccgtgctgcatcttctcccctgaggtactgaacggggaatcttaccaaagctgctgtcccaccagccgggaagctgccatggaagccttggaattgctgggatctacctatgtggataagaaacgagatctgcttggggcccttaaacactggaggcgggccatggagctgcgtcaccaggggggtgagtacctgcccaaactggagcccccacagctggtcctggcctatgactattccagggaggtcaacaccaccgaggagctggaggcgctgatcaccgacgccgatgagatgcgtatgcaggccttgttgatccgggagcgcatcctcagtccctcgcaccccgacacttcctattgtatccgttacaggggcgcagtgtatgccgactcggggaatatcgagtgctacatccgcttgtggaagtacgccctggacatgcaacagagcaacctggagcctctgacccccatgagcgccagcagcttcctctccttcgccgaactcttctcctacgtgctgcaggacccggctgccaaaggcagcctgggcacccagatcggctttgcagacctcatgggggtcctcaccaaaagggtccgggaagtggaatgggccctgcagctgctcagggagcctagagactcggcccagttcaacaaggcgctggccatcatcctccacctgctctacctgctggagaaagtggagtgcacccccagccaggagcacctgaagcaccagaccatctatcgcctgctcaagtgcgcacccaggggcaagaacggcttcacgcctctgcacatggctgtggacaaggacaccacaaacgtgggccgctaccccgtgggcagattcccctcgttgcacgtggtcaaagtgctgttcgactgcgggcccgaccgggacagcagggattttgacaacaacaccccgctacacatagcagcccagaacaaactgcccgccatcgtgaatgccctgactgaagcaggggcccacatggacgccaccaacgccttcaagaagacggcctacgagctgctggaagagaagctgctggccaggggtaccatgcagcccttcaactacgtgacgctgcagtgccttgcagcccaggccctggataagaacaagatcccttacaagggcttcatcccggaagatctggaggcattcatcgaactgcactgacctgcccagaa

SEQ ID NO: 469318 - DNA, 707 bp, Homo sapiens
ttattcaatttagacatgaattacatcacccaattaagaggttgccggaagatgaaaggggacactcaccggcagttttgccatgagagtataccaaacaaaggagacagggtcatttataacctgatgcatccaccctactgctgtgtttggtttccattggccggaatgggacctcacattctgtatgtgtcccaattgtttagcaacttagaattttttaaaagagtcaaaggcagaggagaacaaaggaaggaggaagtaacttgtggaatgctgagaaaggaatcacaaatactggtgaattccatgggccaaccgactcttctatatgtcctgcttccaattgcccttttactaattgatggagttgaatcagtttcccctgtgataggggccactgatccacccatacagaccttccttgttcaagctcctataggaccctatctgtctctgtccctgttctgtcccagcaagtctctgctagtctttatcttttcctatctgtccctcgactgtccctatgggtccctataggtcctagaatttgatgccagtaaactttagttccttgaaactttgaaaacatgcttcagtttttatttagtttggaaagctaaatttggtcaaaagtaaatataacaataaatgaatataaatcattttggaagtgaattcaaattattacgtaagatattaaattt

SEQ ID NO: 469319 - DNA, 2225 bp, Homo sapiens
cctgtgtagttgacctctttctaaccgtaccatctgaaattttaccaatggtttattgccacctttcttctgaacttcagctgacccatacagttgtggatgtgacatgctataaccccctctttggggctttgcaattcctggtatctccaaactttggggcgccaccatgttctccatgtccagaccctggttcccacagtggaggcaacttgcggtatgtctggtccagccacagcctttcacagagctggtgcctgtgccagcacttggagctgcccatcctgctgcagctggcatgcctggctgtgcacagtggccgaaccctgcacttgctcactcacatgccccttactgctcctcgatttttacaaatcaaaagtaaacaaagcaaaccaaaccaaacaaaaaaagcctacagcaatgcagaatttggtttattcctgctccagtcacagtgataggatacagcagagagcattatagagacttgacaatgcagtgattagctaattaatctgggtactcagagactagttcatatgaaagtacaaaaaccaagctgactttgcagcattttctatatttgtaatgtttctcattctgaatataataaacaacttgaaatttgcataaagaaaaataatacatttatatattccctaaatatggcattttaattgtcttaatactgtggatcacagtgttagaaatagtcagatgcttcaatctgtgaaaaaaaaaaaaaaaagttcacttgaccaaataacttgtgtaaaaccaagtgactgattcccctaggctttgataaaactttgtaaacacaattaaaaaagacactctaggattgttttataattaattgttaacatgtctatgttccctggtagctattgaacttaaagacataaattatattacttggtatttttatatctaatatcctagttggcatacatctagtattaaataagtaatttgaaattatttcagttgaatatgattggctgttgttgttgggccagtggaatgataaacaccggaaacactattttccttcttcttatttcagcttagttttgaaattttatcagtcttgggattttcagtttaaaatgataggggagaaatgctgtcaaatgtagcttggcctgtgaaattaacaaacagaaaaagataaaaactcaagcatcctagatatttgtatggatagattaagaaattgcaaaaacaagaaaaaattcccactagccatgttataaacaaaactaaatcaaaatattcctatctaggctttcactcaaggcacaatagtgtttcattttacaagattaaatgcatcgaaaaaaggtgccagttctaggctcagagatccagtgttgtagattggggcaaatggttcactgataaatagatgcataaaccataaaatgcacagagcacctgacatattaatgtcatatattggaaatacattttactgagttaatgtaaactctaaaaaacaaagtattccagtgtttcttgctaattccataagcatcaccactgacttgtgttaagtttaagcatgtatgagatatagaagaaaagtgacttttcacccactggatgggtcatcagataatcagatttggtggagtcatctgttgtgatcattatctccgtgtgaacaacaaaaagctagtaaaactgctctaataattttttttaaatgatttctggattgctattctatgttatcttattaaaatatttgaatctttaccctaaagttttgattattgattatattgctattaatgtgattttaaaaaatgtctattttcatataattttacacttaaagaaaaatttaaaaataatacaaagaaatgttatattctattactaagatttatcagttgttgatatactacttttgctataacacacatacatacacacatacacatacaaacatatatatacatattattttttaatattccatgtcatatcttcagcttgcataggttctttcaagatgtctaaaattagcaagtgacattcacagaatagaataaatattaagtatttattattactaataataaataaatgattgtgtaaatgtacaaatgaataaaaagtagaattctgactgataatgtggaaagcataaaagatttatcaaatcacaatttttcaatgataatgataataattttgttaatactaatttc

SEQ ID NO: 469320 - DNA, 1675 bp, Homo sapiens
cagaagtaggctttagaagcctcctctccttccctctctcccctcccctctcctctgctttcctactctcccgtcccctcttcacttctctcctctcctcctccccttgctctctctcttttctgcctctcctctctctttatcttttcctcctctcccttgctcttccctcccctctcctctcgtcctcctcccctccctcctcatgctctcccctgcccttccattcttacccctcctcctgttttctctcctcctccccatctatgtcaacacttcaaagggatcccctgaaatgagtgacaccaagccacctactgcaagtgaaggatggaataagtttagactgaaaaatataaaaataggagaggctgcttctgccaatgaagaagttgctgccccatttccagaagctgaagaaggctcagaagaagatagaaaaatctggaaaagtttggaacttcctagagacttggaaggctcagaagacaggaggatgtgggaaagtttggaacttcctagagacttcttgaatgccattggccaaaatgctgataatgatatggagaataaagtccaggctgaagtggttttagatggagatgaggaacttgttgggaactggagtaaaagtcacttttgctatgcaaagagactggtggcattttacccctgccctagagagctgcagaactttgaacttgagagagatgatttgaggtatcttgcagaagaaatttataaccagcaaaggattcaagaggaagcggagcataaacatttggaaaatttgcaggctgacaatgtgatagaaaaaaaaacaaaccccattttctggggagaaattcaagccagctgcacaaatttgcatcagaaaaagccattagatgtgacagacacgtggactgaggtcagatcttaccaggccttggaagtcatggtcatggataattctatgatcaatgagaagatattggaatgttttaaggaagtatatttttgtttggaaggcccatatgataagttctattcaataagatgtgagcagaaatttcacatcgcttcatatcgataccaatacgaatgctggtattatgttatccagaagtctctattttcttctgtcatggcaaccagcaatgtttatgatagttcctatgatactgatgtgaactgtgaagttctacagtgaatatttccccatcctctcagtcagccctacagggtcataactatgagttgtaaattatccattgttgttttaaaccatcaaatatttgagtatgtagcgtcatcaatttccttgtgaatagtataaaaattgctacctagagtcaggatgcatctataagaacaatcataaaatatgagtcactttcagatgagaaatttgttggaaaaaagaaaattattataagaggacacatgatttccactataaggaagcaaaatatgtagtactcagataagatattaaaaaaactgaattttactgttatgggttggctccacttgtctgtgtttgaaaagacaacttttaaataattggcaccttagagttctaggtgtcaggcagtttagtttttacacctcttagcaaaattgtttcctagtttgtgccaaaaacaatatggaatatatgggacaatatgggtggagagtggtcccttcactc

SEQ ID NO: 469321 - DNA, 1099 bp, Homo sapiens
aaccatacctgaatttatgctaatgcagtcactcttaagtgctggcagccctggcagccctcccccacgtttggtgcctcctcggcctcggcgtccactccagccgcgcttgaggagagcccttcagcctgctgcttcactgtgggagcccctttctgagctggccgaggccggagccagctccctcagcttgcggggaggtgtggagggagaggcgcgggcaggaaccagggctgcgcgggcgcttgcaggccagcacgagttccgggtgggcgtgggcttggcggccaccccgggcagtgaggggcttagcactggggccagtagctgtggaggatgcgccgggtcccccagcagtgccggccgggggcactgcactggaattctcactgggcctcagctgcctccccgcggggcaggggtcaggacctgcagcctgccatgcctgagcctcccctccgccgtgggctcctgtgccgccggagcctcccctaggagcactgccccctgctccatggcacccggtcccatcgaccacccaagggctgaggagtgcccggggcagggctagggactggtgggcagctccacctgcggccccagtgggctctctgtaaaatggaccaatcagcaggatgtgggtggggccggataagggaataaaagcaggctgccccaaccagcagtggcaaccctgtggaaactttgttcattcgctctttgcaataaatcttgctgctgcttgctccttgggtccacactgtctttatgagctaggaagcagacataaaagtttggaaagtttgcagcctgatgatgatatagaaaagaaaaacccattttctgaggagaaagtcaaactgattgcagacatttgcataattaacaaggagccaaatgttaatcaccaagacaatggggaaaatgtctccaggacatatcagagatcttggtggcagcccctcccatcacaggtacagaggcctaggatgaagcatggttacatgggggagcatgctggcgatcatggaggatgggaggcagaactagattgcagctccggacagagcagcgggtgggggctcacattgtgaatgtt

SEQ ID NO: 469322 - DNA, 533 bp, Homo sapiens
agtagaaacaagacttacaaggttaagtatgcatgcatcaaatatgtgtattatacaaaaagagataaaaggagagaatctaatgccaaatattacagaaatagacgtgaaatatactaatcattctgaaaacaacattgtaccccatggtatagaacagaacaaagctccagatcaactgcaagaacaaaccagcaatcccaagaggacccacagaccatctgaaaaaagtggattgcttctgcaggacctgggagacaccccaaacactgtgaatgccccaaccgtggaagtgggaaagggagacccttctctccgaacacacacctccactggagaagctgaagcagaagctgaaggcctgtttgctggagaaggcaagttttcaaatctgtcacgccctccacctggaaacagactcagggctgttgcaggcggcccagtgggagtgagaccggcccttcagtttgtgtggaagctgggtgaggcctgtgactgctgactttgccccacttccctgacaacctgcatga

SEQ ID NO: 469323 - DNA, 967 bp, Homo sapiens
aaagtaattttttatggcatatgaggctagacaaggagagacagtgccctgtgacccagccactccagccattgctaaaaggggccaaggtacagctcggcccacggtttcagagggtgcaagccccaacccttggcagcttccacgtattgttgagcctgcgggtacacagaaatcaagaattgaggtttgggaaccttcatctagatttcagaagatgtttggaaatgcctggatgcccaggcaaaagtttgctgcaggatcggggccctcatggagaacctctgctagggcagtacagaagggaactctgggtttggagcccccatacagagtccctactagggcaccacctaggggagcgctgacaagaaggccactgtcctccagaccccagaatggtggatccactgacagcttgcaccatgcgcctggaaaagccacagagactcaatgccagcctgtgaaaacagccaggaggggggctatgctctgcaaatccacaggggcgaagctgcccaagactatgggaacctatctcttgcatcagggtgacctggatgtgagacatggcatcaaaagagatcactttggagctttagaattttactgccctgctggattttgaacttgcgtggaccctgtatcccctttgtattggtcaaattctcccatttggaatggctgtatttacccaatacctgtacctccgttgcatctaggaagcaaatgtaaaaatgcttataaataaatatagaagcatatctatctttctaattatattcatcaaatatttatattcatggataagggaaataaataattattttaaataaaaatataaagtttgaaacaggagttgaatgttcataaatattttattatttgtatggtccacttgcccagttccaaatgatttcaagttctgagaattagtctggaaacaaaataataagtaaaggttctc

SEQ ID NO: 469324 - DNA, 552 bp, Homo sapiens
ctaacaatagaagagcatcaggacaaattcttctgccagacaaatgaatttaattgagagggcagtcagctctccatttctgagggttcatgcagatatggagggcccactaaaggccatgaacatcagcagattttggtatgatgcactggcagacaaaatgaactcttgtgatttacggagacacctaaacttaaaagcagaatcaggcagccacagcaagataggagagtggtcacatgccctgcgtgcttcgaaaatgcttttgtgttctcagaaaggtgttgtaaaagtaacacaagactgccttttctacaattatcgagaagaaatcagcagcctggagaagtcaggggtggtgaggcacgaagcaccctgggaagaggttcggcagctggctgatgtaaagtattcagctgagctagctgcaaaagctcaggcttctacagcaggatggagttaattccattagtttttaagaaatccgtttattctttgtgaatgaccaaaaccaaattaagttttatgtacattccttagttcctgataata

SEQ ID NO: 469325 - DNA, 785 bp, Homo sapiens
aagagtgggtgattccaaccccctacatccctttgcttcatggtcgcaagctgctttggcactcatgtcagcacctactaaggtcactgggacccagggatgcaaatacggaagaaggaaaagaggatgttcttccctttctccctcatgtaccccagaagagttctctgtcaaatcatatcttttagtcacaccagccatcatatttgatatgggtttgctgtgtccccacctaaatctcatcttgaatttaactcccacgattcacacatgttgtgggaggaacgctgtgggaggtaattcaatcataggagttagtttttcccatgcttttctcatgacagtgcttccagttttgccagagccaaatgttactcctatgatttggttggagactggcacaagggtatgtaggaaagcccttaattttgtacattcgaatgtcaaggtgttttttctgcgtagaacatactatcaccaaatgaagagattaataggggtaaagggagagataaaggaagctttgcaatcaagacctggcgaacaagaacaacataagaaaatgtgctgatgtgtgatactacaatggagggactcagcagaaatgaacacagtgctcttcccagaggataaaaggcttaaccttttatgctatgcaatcttttaaaaagaaatatgtgagcaaagggaatgacattgggaggcaagagtgtaatggtgtcccttacacgaagtgaaattttccttttatttaacttaaatgatttttgtaaatctttgaatga

SEQ ID NO: 469326 - DNA, 653 bp, Homo sapiens
cagttctaaaaccattgttattatgtgtgaaaggagtgcagatttggttttagaatattctggtgcttttcaaaatggctacagttccgctccgcctgacagaagcatgagaagatttttctctgatattcactgtgagaacctggccacgttcctggagcaaaaacaggcagtcttttccctgatttttattggcactattgggaatgatgccaggctcatgtacttcaaaacccatgaaactaccaagggccattgccaccagaaagtgtatgagaacaaagttaatcagaggcaaacagaacaaaagtgtttggtggaattcaccagtgaaggcatcaggtcccaggcttttacttgcttggagactcttcattatggcttgcatcttgttacttgttattggtctactcaagctttggatttctttatagttcaaccttgagtatgtattttcaaatagcctgttttcaagctcactaattccttcttctgcttgatcaattttactgtcgagagactgatacgtttttcagtttttcaactgaatttttcagctcccaaatttctgcttctttttaattatttcaattttttggctaagtttatctgataagattctgaattcctttcttatcttggatttcactgag

SEQ ID NO: 469327 - DNA, 476 bp, Homo sapiens
taaggtaaagccattgggcaggatggccaaacacatgacacctgactggaaaaataacattgacagcagtttattacctgttgctggacaagtcttccattttgagctgtcagactcatttacaagcttctgctgttattttgccaataatgcaataatgctgtcttgccctaagaagactttcaccaagcagcatattaacataggatttaagaagaagggaccagaggagaacgcagtgcagcaaactctttgccagggctcagagtttggaatctgttgtttccttaactggaaaaagcctgagcttcgtgtttccccagcatcagtgacccaacaagcatctgcgcgaagaggagctgccggctacctgcagagagcgttctcgctgagctttagagtccagagatttctatctcctcctctcaaaatgcaactggttatttacttgtaaacatttaaattagttcaaactg

SEQ ID NO: 469328 - DNA, 673 bp, Homo sapiens
ggacacaccgccatccatgtaagatgtgacttgctcctccttgcctgccaccatgattgtgaagccttcccagccatgtggaactcggagtggggcattgctgaaaagatacctgaaaatgtggaaacgactttggaactgggtaacaggtaaaggttggaacagattggaggggtcagaagacaggaaaatgtgggaaagtttggaacttcctagagacttgttgaatgactttgacaaaaatgctgatagtgatatgaacaataaggtccaggctaaggtggtctcagatggagatgaagaacttttgggaactgaagcaaagatgactcttgttatgtttcagcagagactggtggcattttgcccctgccctagagatttgtggaactttgaacttaagagagatgatttagggtacctgttggaagaaatcctaagcagaaaagcattcaagatttaacttgggtgctgttaaaggcattcagtttcataagggaagcagggcataaaaatttggaaaatttgcagcctgacaatgggatggagaagaaaatcccattttcagagaagaaattcaagccagctgcagaaatttccataagcaaagaaaagccgaatgttaatccccaagataattgggaaaatgtctccagggcatgtcagaggtctt

SEQ ID NO: 469329 - DNA, 553 bp, Homo sapiens
aagttgcaagccctgtgtttaaaagtggatgcagtcaccttcccagctaggcttagggattcttagtcggcctaggaaatctagctatggagacttttgtggaggtctattagatccatttgttccaatgttgagttcaggtcctgcatatctgttaattttctgccttgatgatctatctaatactgtcagtaaagtgttgaagtcttccactatgattgtgctggagtatgctggcagaagactggtgccacctgaatttaagggcaatggcatggcagacagtgtgaatttcctgtttgcctctgctcctcttgtcctccaaggatattcctttatagcaatgctaaatggactaacacagataattggtaccaaggagtggggcattgttataaagatacctggaaatgtggaagaggttttgcaactgggtaacgggcagaggttggaagagtcaggagaaaagacagaaagatgagagaaagtttggaacttcttagagactggttaagtgattatgaccaaaatgctgatagacatatggacagcc

SEQ ID NO: 469330 - DNA, 686 bp, Homo sapiens
ggaaagaagagataaaactgagcttccctgacaccttagggttggacacccatgagaaacactgggaatctgagcacgaacaaattcaaaattgtgaaaggaccattttattctctcaggcaatgtgaagaaaataagataaaagaaggacctcttaataatgttggtaacagtgaggatgatgatgatgatgatgatgaagatgatgatgctgtgtctgctgctacaaaagacgataataacaagaggagggaagaatttcaatatgaagatgccagagagataattgataactgccaaagcaaagtctacgagaaagatgaagtatgtaatattcaaagcagaacggttggttcaggaaataccaagtccattggaatcgcaaaatgtaagaatctgctgtttctcattctctcttatggtcaatacttggatgctgaaggaactctctattttccagttgtatcagttatctagtcctgtgtaaacatctaccccagaatttaaggcttaacacaataatcagttatttcactcatgctttctcagttttctgcacattgaaagtactacttactgcctatgaaccaccttgctcatgtcataccattcttgcccatcctgactccattcatcttactcataaagtctgtgaaaatacgactaaggtaggaatagtgattggt

SEQ ID NO: 469331 - DNA, 604 bp, Homo sapiens
tgtaaacaaataaaaatgtcatttgccatcaaaatatttttaatgaactgtggaaattcactgaaagatgtcaatatgggagtaacacatttggatgtgttcccagagtggatgacacagagtaccaagggatattcagttgtgtctggagtttcttccttctggtgggatcgtggtctcactgacttcaggagtgaagccacagaccttcacagccctattcatctgattcactcctgtgcttggagatgtcactcgaggaggctggagaacagcaaagatgagtgcctgctccttctcctgggacctgtgaccttgagggtcaccaacttgataccagttctctcctgtatagggtgtctgaaaaccccttttggaagttctcacccagttgggaggcacaaggagcaggacccgtttaacagagcactttgtcccttggtggagctgatgtgcttccctggggggaatcccactcatctgagctgtctggattcctcagaactaccaggaggagaggttaagtctattggtccacagactgtggccaccccgccacctaggggctcaggcccagggagaactggattatgtccctgaacct

SEQ ID NO: 469332 - DNA, 828 bp, Homo sapiens
tatccagagctgagagaacgattggttctgaaagcacatctcaaagggtatgaagccagaaagaaaggaagcattaatgtctaactacttctcctcctcctcctcctcctcctcttcctcttcctcctcctccttctcctcctccttcttcttcttctttaccttgagggacttaaactcagctctggactaaatggacctaatagacatctacagaactctccaccccaaatcaacagagtatacatttttctcaacaccacatcgcacttgttctaaagttgaccacaaaattggaagtaaaacactcctcagcacatgcaaaagaacagaaatcataacaaactgtctctcagaccacagtgcaatcaaattagaactcagcattaagaaacttattcaaaaccacacaactacatggaaactgaacagcctgctcctgaatgactactggataaaaaatgaaattaaggcagaaataaagatgttctttgaaaccaatgagaacaaagacacaacaaaccagaatctctgggacacatttaaagcagtgtatagagggatatttataacattaaatgtccatacaagagaaagcaggaaatatctaaaattgacaccataacatcacaattaaaagaactagagaagcaagagcaaataaattcaaaagctagcagaagacaataaataactaaaatcagagcagaactgaaggagatagagaacccttcaaaaaatcaataaattcagaagctggtcaaaaccttgtcttatgtccatttttaaagggaatgcttccagcttttgcccattcagtatcatatt

SEQ ID NO: 469333 - DNA, 696 bp, Homo sapiens
ttttcctccttttttgggaatataatgacattgtcttttacaatatttggggtgttctaccccaaccccaatggccacaggtgcatacactggaagggtgggcaagggacagctccctgctcctttcctttccagctgtggaacatgatttttcttgccacatgtacatgcagcatccaacggctacacacagcaggaatgaaccacagccactgccactgcccagaacccaggatggccttggggacccatgctccacgaggcagcaaaggagcaacaccactggctgctggctgcagtctgatgagagacacctgggacttgatgagtccatgcacccttgaggcagttcttttgtcccaaactcaattccaagctcaggtcgaagccctaagaaagaaaactggatctgagggatccagaggtggacaacaacagaagttaaaagactcaaggtaactttcattttgagttacttacagtacttaataatcaagtaaagtatattcctgtgaacaaaatttggagcatatttgctcgtctatgcctgcttcctttagaatttggaaattatctagtcccacttagcttattatctgaccttgacatcacagccaagccctaaatcaaagcattttatcactctctatttttgctaaagaagatcctgaacttttattatgcaagcaataacta

SEQ ID NO: 469334 - DNA, 937 bp, Homo sapiens
tgctgagaaactacctgctaagatgcttgcaaaacttgtaggaaggccagttgtagttctaacaaaatgccaggtaaacattagcatcttcatgatgtggaaagtgactgaaatgtttgacaccagtttggcagatggtcagcaggtacagagaaagggcagtgatcttgcatggagactgctgctaatggaccattttgtgggcacaggagacctccaaactgttaccagggtaactgtgcactgcggaaagggaaatgatcagacatttcgggaactactggacactggcttcatttccccagtgccagaatgcataattggcacaggcatacttagcagctggcagaaccaccacattggccccctgactggtagggtgagggctattatggtgggaaaggccaaatggaagctattagagctgcctctacatagaagaatagtaaatcaaaaacaatgtcacagccttggagagattgtagagattagtgccaccatcaaggacttgaaagacacaggggtagtgattcccaccacacccccgttcaactttcccatttggcctgtgcagaagacacatggatcttggagaatgacagtgtattatcataagcttaaccaaatggtgactccaattgcagctgctgtaccagatgtggtttcattgtttgagcaaattaacacgttccctggtgtctggtgtgcagccattgacttggcaaatgcctttttctccattcctgtccataaggcccaccagaagcaatttgccttcagctgacgaggccagcaatatacctttactgtcctacctcagaggtatatcaactctccggctttgtgtcatagttttattcggagagaacttgatcactttttgcttccacaggatatcacactggtccattacattgaagacattatgctgattgga

SEQ ID NO: 469335 - DNA, 631 bp, Homo sapiens
ttcatcaatatgacaaaactgttttatgtcattttaagtattttagcacttcttgcccctctagaagtgctgaggcttgtgcagaggttgcaggatatggaaggctataacattttctccaatttagaacccaacaaagtaaaaatccgtgaaggcaatgaatatcacccagagcctccaagaactgtgatcagacaatgtttcttagaatgtgagaagcaatatgatgttggctatgagtttgtcatggatggttcttattattttgagacaggggacagcaggagaaatggactctctcctcaatataaaagtcaattacagccaactttagaaaacagtttggtagttcctcaaaaagctatattgcatgtgttaaatattcacatgtggttactgactattacattgaacaacacagggttaaagccctactgcacatctatgaggtaaattaacttgagcaacttgcacatctatgtgtatgtcaaagactcatgttcttttctctaaacttggcataaagatagtaactacttcacttagtgtatataaagataaattataatctatataaaatgtttgcactaaaaatgttagctaatattataattattcttgctgataaggt

SEQ ID NO: 469336 - DNA, 3812 bp, Homo sapiens
tctctctctctctctttttttctttctttctttttttctttttttttgagacagggaacacatgtccacaggaaatggcagtgtttctactggagaggtgagccccggaccggggcacccctttggtgtaggcatagtttgtggtcaatgtcacaaaggcctgatctatcatggtgctgctcaggggtgctggtggccggggcagctgcgggttggtggctcagagaagcctgtgccagaaggcagcagggccagcgaggggattgtggccaaagatctgagaggccctggcaaacccctggtacacacccagcaagaatactttgcatccttcaatccaatcaagttgacatttaatattaatcatcactctgcccattccatgatggatgtagttcagtgtaatcaagctgccaccaggttcgtggtctcgctggcctcaggagtgaagctgcagaccctcatggtgagtgttacagttcataaaggtggcactctggagttgttcatccctcccattgggttcatggtctcgctggcttcaggagtgaagctgcagaccttggcagtgagtgttacagctcataaagatggtgtggacctgaagaatgtggatcttgtagacattctagagcttgtagacacaacagagcaattaacagaatatgacccaatggagaggcatgctttcaacctagttcttgacaatgaagaggaagattctactcagtgtgaagccaatgagggtgaaggtctttatgatgttacactttcacttaatgaagagtaaatatatttttacttctttatgattttcttaatattttcctttatcttcttttattgtaagaatactgtatttaaaacatataacataaaagaagtgacatatttactgagagaaaataagttttgtggagcatggagaaggtttagaaaataaattctggagaaatgaagaggtgctaatttggaaagaataattgattttcagttaatgagtaggacccaaatgagttgacaactatgaattttttgtaattttgttctataaatttgtgaagttttatttagtaattagtataggcaaagaaaatacacattgaactaatttgagatttgaacataaacttaatcaagcatgagggttaatatcattgccatggaaaatcaccaacttagtgagcatggaatgtaaacaagtttgacacatgtaaagccttcagaaagttaaggatccatatcaatgaggtgcaggtcatgctacccccaaatacggcacattggaagacattttctgacctcctctgacctttctgtgtgtgagctgtacataaaataaccctgtgacctacatttcttaaaagtacccaataagactatcatatgccaggtgtcctgccctgtacccaacgagaaaaaatgccatatactgacagaaaagaatccgaaaaacaggccttccctagttcccttcccactccccagtttattagcattaaattgtattcgttttgtccaaacatttttttttcacaactgtacacttccttcactggatttagcaacttacacagttttctctgggtctctgggtcttcatttccaaaagatcaaatgtcacataaaactgtggtgaaataaatttgttatgcttttgtcttattaatcttcttttggttttatattaccacatgtgaacccaatggttctctccaagtatgggttgcataactgcctttaattactactctttgtcctgtaacctaagagaatttagaattctgccagggtcaactggtaatatacatttttgaggataagtttgtcacttttcagagatttattaagtaagtctagtctcattttttgcaggtgtatgacttcatatcctagttttcaacaatgtctgactctgggatattgagatacaattgtggtttacagagaaaatatatatatttttgctcatgtcaatagtttaccaaatttcttcttagaactgttggtaaacttaccaaattccttagaaacagcattatgaaagcttatattctaacattatctatatgttcaaaattacctcacaaccagtgagaatataattctttttagctctagagcaacattcattaaatgtctcaatcatactctctgataaagtgagcaacaatacctagaattgttcccaatactaagtaatgacaatgcatatttgtggagtaagtaatcatatcctagcataaagtacttataatattcaattagcaactgatcatgtatacctcatgatgtttttatatcattgttcagtgttttgcttttaaatatacctttgcaagtaggtttattttatgtatagcatacatataaccataataggtgaataatctttaatagagcaacatgtaaaacatagttacatgaacaacatagttattatttatatttataaaatttggtacaaaataaaccaataatctctgggtgatataatgtatgtttgtttattgcgactaaatcatgttatttgtaaaatccatttggagcccattatcaaaggactttgtagataatttaaaatcccagcccaagtaaattctctgttttgaaagaacaagaaaaaatataattgatctcctcatgagatgcagctttctcatctattataagacacatgatgcccttatctgctttagatgtgttaagtagtttcctcaggctttgtgctttatgtttttctctgatgtacaaaactcacctttttgatttatgacaactaagaatatagatactgtgtttcttttgtttttctgcatcttttaaaattctaagttgtatagttttgatgttcctccttttactcgttgcataacaactcattatcagacaagtttcaaattagttaaaaaagactatattctagcaaacagttactgcaaatcataaaatatgtgttcatgttcaaagttcacaataaaaatttatgagtaagcgactgttaaacttagccatgaaagataattaatcagaaatatagtattcccttcttctctattcctcggggagggaacttggaggagggaatgaaatttgatctgaagagcttaatgactaagactatctcctggagtagtgtgtgtgtatgtatgtgtgtgaatgtgtttcttgagggtgtgtttaattaagttcttggtttttaaaaaagcatttatatatcagttcctctaaatggtatgtcacttttctcaaaacgatagaaagtctaccagggtatttaagacactcttatcatctcaaaaatgtctgctgcatattaataacccatcacttctaagtttttcattttcttctacttcctcttgcttatcttactcttttcctgagagtatatccactagtcacacacacacaaatttcatttctatgaaggtatagtttagagcagctgaatcaattgctgtgggtcaaatgtggggtttttttttgggggggtgagtttttctgtcaaagtttcttttgggcaaaaactaaatttcttgtaaactatacttacatggacaatatagaaaatttaggcagaaaataaatgtattgtttatttaccaggaatcaggaatttgcaacatacacatgcctaacatttatctaaatgtattgctttcagccttttctctgaattgagaaacaagttgccaatcaagtataccatatacagtatgatgactttgctacctttttaggacaatagcattattttataatattttccataaatgtcataaaaagaataatttttctatatatagtac

SEQ ID NO: 469337 - DNA, 981 bp, Homo sapiens
aagaaacttacaatcatggcagaagaggaagcaaacatgttctattttgggaatcaagggacaggagagaccaatgggcttagaggaggagagaccaagaagggcaaaaccacaccagccaggcccacctacagtttccccaatggcaagcacaagcaccagttccacgggggtatccagtgggaggctgccaagtatccagaggtgtttgtagagatggagttgtgtgagtgtgctgagagagtgtgcagagagtgtgctgctacaccaaggtctttgcatagcaagaggggcagctcaggctctccagtgaaattcaacacttttttactcacaaggcagacagtgttccattttctaactggagaagttacttgcattttcctcggtacagctgaatattcttccactattgatcgatattagatctattaggaatcctacaaataaaaggtgggaaagacttaatatttcctggtacttttatgtgtaatctatatacattgtaaacactaatcttacatagttataaatagataggaggaataagttcaagagatctattgtacagcatggtgactctagtcagtgacaatatattgtattcttgaaaaatgctaaaggattggatattaagtgttctcatcccaaaaatgataactatgtgaggtaatgcatttggtaattggctagagttaactattttttctttaatgtatatatgcttcaaaacaatatgttaggcatgataaatacatatagttttacatgtcaatttaaaaacgaataaattagcaaaaaattaaaaataacaaaattgccaactaaaaatattttgaaaattttacacccagaaatatgaaattttctaagatcagaagcactgagttgtaaactaagcgtaaaattcaacttggctgactaaaagtatattctattaaacaatggatcatacatactctttacgttatgcattcattt

SEQ ID NO: 469338 - DNA, 546 bp, Homo sapiens
ctatatgacattatcctatggatgatatggaatgacctctgtgaaagggccaagaagccctggcaaactcctggtgtaagtccgagagtccaaaagctgaagaacttggagcttgatgatgagggcagaaagcacccagcacaggagaaagataaaggccggaactctcaaggcctaagtgtcttgggtaaaaggcagctatcatccaaggctccggttgcttggtcatttggaggtcagtggcctgaagatacaacgggggtacaaaaattgggtaaatacagccattccaacctggagaaattggccaaaacaaagggctacaggccctatgcaagtccaaaatccagcaactgccaaggtttggggcttgcaccctctgaagccacagccctagctctgtgtttgcccctttcagccacagctggagtgactgggacacaggccaccaagttcctagcctgcaaacagcatggggaccctgatactgtccactggtaacaatactttggtgggggtggtgtcaaaatgcttcatcaaggtgac

SEQ ID NO: 469339 - DNA, 745 bp, Homo sapiens
aggccagtctctctccttttcacatttttctgcctgctttatgttggctggcagcagagcagagggggtcctgctacactgtgatctatgcacaggaaaggtgtcacggcacaggctgctgatacagctcagactgctggtccaagcaagtgtgcgctctgagtgcttagatatctgccttgatgtggagtggagagggcctcagtggattgcaatcttgagggagcaggctagggcatgcagcaatgacacacagagaccagttccaggtcaccaagctggccctaggcctgtgattggggagagcacaattccagtacctactgctgaggcaatttcaacagttctgctatggaggtaccaactgcattgcaaagcaagtgctccaatctttggcctgagactaaaatgccttcacagccatgctgctgggttgccaaaaagtgacagaactttgaaagtgagacctttgaaagatgcacgcagtctagaagttgctggagcctaaaatgtgcatctggagaaaggatgctggtcatattggtttagggcacagactactcatctaatgttaacttgaccacctctataaagactttgtctccaaataagatcatattctgatgtactgggagttaggactcttaatattttgtgagctgggagagaaagtgggtgggacacaatacatccatgacatcgtaggtactctaaatctgttcttttataaaattattttggaaag

SEQ ID NO: 469340 - DNA, 629 bp, Homo sapiens
caaataagaaacaaactgcaactcagtaaagattataatgaggagccaaatgttaatcaccaagacaatgaagaaaatgtctccagagcatttcagatgtcttcaaggcagctcgtcccatcaaaggcctggaggcctaggaggaaaaataggcttcaagtgtcaggcccagggctttgcttcttcatacagcctcaagactcggtgccctgcatctcagccatggctaaaaggggtcaaattaaagttcaagcactcacttcagagggtccaacccccaagctttagcagctttcatgtggttatatttgccttgtatattagtccatttttgtactgctatgaagaaatacccaagactaagtactttacaaggaaaaacagctttgatggactcacagtttcacatggttggggaggcctcacaatcatggcggaaggtgaaggaggagcaaagcacaaggcttgatgtagcacagatattagatatggatatttgttaatgtccttagtgccaattgataccttctgccaaggccaaaagggttgaatagtgaagactaaatagaaagagaaaactctgcaaccatttctacacttcagaattctttccaatttcaactcgattc

SEQ ID NO: 469341 - DNA, 720 bp, Homo sapiens
cggcagttaacaaggatctgaatttaaaggagtttaattgagcaatgaatgattcgcaaattgagcagcccccagaatcagagtggattcacagagattccaggggtacctagtagtcggaacaaatttatacacaaaaaaagaagtgactgttttcacagctcgcattgccatttaaagccacagaaacatgcatgccactccacaagtcttcctgtacaaaatgaacaaggggacattgtgagccacaaaaaggctcatatcagttgccaagatcttgtctctaaatatatgaaaaaggttgatgagcttacccacatttctgcccttgcggtagagaataagaataagctggctgctggactcattcttgaccaacatctgctcctggtgttggcccatattaacagctacacactggggcctgctactcctcatctccaaggacttgttgtattttcaaactttctgccttgtcctttactctgccctgcctatcccaatgtggaacaactggattttgatgttgccacagctgttgttgctggccccaggacaggggccctcaactaatgtttccccttgtctgtccccttggggatgctccccacaactttgggccaccctcccatggacacagcatcccttcaaaggctccttaactctcttcctccagttaatgttactaccagaatgaacgtgctactggccaccctacac

SEQ ID NO: 469342 - DNA, 1916 bp, Homo sapiens
tgaccaatttctcccatttggaatggatgtatttccccaatgcctactgtacagaaagcatggtagcttctgcttgtggggaagcctctggaaacttacaattatggaagttgaagggaaagcaggtacatattacatgccagagtgcgaggaagagataaagaggggggaggtgccacacacttttaaacaaccagcgcttatggtaactcacttactgttacaagagcagtaccaaggagatggtgttaacccattcatgagaaccctccaccatgattcagtcacctcccatgaggccctacctccaaccctggggactgcaattgaacttgaaatttgggtttccacagtgggtgtaattaatcccaaagtaagatttttaccaattacttccagggctacatccaaacttggggagaaagaagacttatggcccatagtatattcatattctatgactgccatcacctatcacaacaaactgggtggtttaaaatttcagaaatgcattctctcacagatcaagcatccagaagcctaaattaagtttctggcagagccatgctccccctgaaagctttaaggaagtattcttcctatgcctcttttatgtagccatcttatgtaattcatttatttaggattaagctttcaaactaagatgcgctattttgaggcattttttttcaaagagctactctaaaatcctatcatttaaagacaactattgttaccaagcatatactttctcttcctgttttatccccagttctacagaaaaaaatagtctaatatcaaaatgaatttgtacttaggattccaaacacttaaaaaatgtttagcagacacaatagttgagaaaaaaatagtattgttactaaccatatatgttttaccaagaagtaattgttagttggatcactatcaccaatattaaaaatattagaagaacctaatcccagtatattaaaaacagatttcttgaatttgcaaatttatttagaattacataaagggttgcttctatttaaaattaagaaagtagataaatcatttatcacagaggtgcttactttatccacgtataaaccaaaatcaccctgacatgctctctgcattcaagaggttaattgttttggagatatgggcttaagtgagacataagcaggagttgaaatgaactttagaagttcacgttgcaagtactccaacaagtgtataattcaatctgccttacctcaacttcaaagaaatgtttatacctcaacaccctattcaacccatagaccttcataatgtgaagacactggcaatgtgaaatattttcaaattcaggttaccttttagtcattaagtcccaaattaaataagcccttattctcattttaagtctgttacagtgagtatataatgttaaattgcttgaccatgggagtcaataacaattcaatattacgataatgaatagaatctattttgttaattgcttaagacacaactagtggtcatgtgcctttaggaaatatagtaactgcttaatattattttataatatattatcaataatgtattaaatgataatcgtctgattgacttatgagctctggaaatactataatcaataactttacgtacatagggaaaataaactgacaaattaaagaaatatccttcctttaaatgtccccttaccttctcttaaagagtaatttaagagaagaaaggaaatttttgaatattagctcacattaattccatgaaatagctcatttccatttgtgaaaatacagaaaagttccttcttataacaatttgttattcacaacctttgcagtaattacactagaaaaatgatggaagagtgtgattaatgataaatgaacttctattatctgccagttactttatatatg

SEQ ID NO: 469343 - DNA, 665 bp, Homo sapiens
gacatcttgcaccgtgcgcctggaaaagacgcagacaatcaatgccggcccacgaaagcagccagaggcgaggctgtaccctgcaaagccacaggggcagagctgcccaagaccatgggaacccacctcttgcctcagcatgacccagatgcgagatatggcatcaaaagagatcattttggagctttaagatttgactgcccttttggatttcagacttgcatggggccggaagcccctttgttttgtagacgcctgagattcaagcatcactgtgggatcattgagccctcaggtcctagatctagatgcttgagtaagttcagagaatccaaagctgagacactggctgcctcggaagaggaagatgaaagagggcacacatatgagggggtgaaaccaggactggggaccaaagatgctgaaagtctctggaggctgcttcgagcgggattaggggtagcgtgggaacctagagtgggagagattaagctgaaggaagattttgtgactgaggaccgtaagggatataaacgtttcactggatactacgagcctgaaaaactgcttggctgatttgactaataaaagccggtctgctattagactgtatagaggtgggaaggccaaactgaggaattatgtctgacagaagggaagaaatg

SEQ ID NO: 469344 - DNA, 725 bp, Homo sapiens
aaacaacacctcagaaagacttaaatgtccctgtctgacagctttgaagagagtagtggttctcccagcacggagtttgaggtctgagaatggacagactgcctcctcaagcgggtccctgacccccgagtaacctaatggggaggcacccctcagtaggggcagaatgacacctcacatggccaggttcccctctgagacgaagcttccagaggaacgatcaggcagcaacatttgctgttcagcaatattcgctgttctgcagccaccactgctgatacccaggcaaacagggtcgggagtggacttccagcaaactccaacagacctgcagctgagggtcctgactgttagaaggaagactaacaaacagaaaggacatccacaccaaaaccccatctgtacgtcaccatcatcaaagaccaaagaaatatgggactgtgtgaaaagaccaaatttacatctgattggtgtacctgaaagtgatggggagaaaggaaccaagttggaaaacactctgcagaatattatccaggagaacttccccaacctagcaaggcaggccaacattcaaattcaggaaatacgagaatgccacaaagatactcctcgagaagagcaactccaagacacataattatcagattcaccaaagttgaaatgaaggaaaaaatgttaagggcagccagagagaaaggtcgggttacccacaaaggaaagcccat

SEQ ID NO: 469345 - DNA, 1638 bp, Homo sapiens
ttcttctcctataaagcaaaccactgtgcgtgcagctctgttttccagaaacatgttatcacataaggtgatccaccctaccacatattgtctcctaatggccgtccagtttatcctggagcccttgcatgacacaggcctatcgaagcataggaggatttcacctcgttgcgtatcagggctttatatttccttggtgtgtcaggatcaagtactcaatagtgtaccaggagctgtttctcaaacagtgagaatttctgtgactcagaagagcaacactctccactggaagaaagatgtcacatgttccaaagacccattaaagatgctcaagggaccaagaagaggtcccaaagcctccttgctggagaaggtggttctaatgaaagaaaggaggcacccaatattggaaagactggaaatttggtgtttcacttctcgtcagggtatttttatttaaaagtaggtctcagaacagattgatggtcaaataaggtaataaatcaggaacagtgcaaatttagcagggcatagcaagaaggcctttgccaggtgctatcccctcaatcttggacttcccagcctcccgaactgtgagccaataaatttctattcattataaattatccagtctgtagcattttgttattgcaatataaaacagaataagatattgttgttgctgctgttgtaattgttatttttctcacttttggttaaaggcagatgaccttcaaaataaaataacattcaattggatttatttcctctgatctaaaaaaagggtgttttcttgttagcttatattttctttgtcctttgttagctcatctgtacattgcatatgctatattatgtatgcaacaggaatgcatatacattcaatgttattctttccattttgtaccaccattcacacttattatggtcacttttaattctaattctattctccaagatatcagctatttcttccacttgatgtcatcagcagacttaataagcatacttgatattctatcatcctggtcattggaaaaatgttaaatagcactgaactgggaactgacccctgcagaacacttcttgttacattttccctttaattcattcccaaattgatacttattatctgtatctttagatgtgtaccagtccaaagatataaaatagttgctgcttccttcttcattttctaatgagacaatggaaggtactgcttatcaatcatggtactcttgcatggagcccacatgtgacctcaaaatcttctctgatatagtaacccagatgtttacaacagactgaccaaggatgagagatgtcatctgagcatggataatcatagaagctctatgtggttgagctataatgagcttttcagtactttccccaaagaacaatgttaggcagttcctaccatctcaacatctgaatatttttgcaacactggccccaaataaatgcttttatccggagtcactcttcttgtcctggtgattacaatagcaaggtagagaaaaataaatagggcctgctgtgcaaactaacattgtaatgaagatctaaatttgctcgttatcccttgaaacagcagttaggaggtacagaggggacgggatattgctgttcttttgc

SEQ ID NO: 469346 - DNA, 549 bp, Homo sapiens
gacagtctggacttctgacgtaaggccattatctgccatgctagtgccagctcaccactgtcaatgcctctcgttgacaggatcctcagctgcaggtctgttggagtttgctagaggtccactccagaccctgtttgtctgggtaccagtagtggtggctgcagaacagcggattttcatgaaccgcgagtgctgctgtctgatcgttcctctggaagttttgtttcagaggagtacaatgtgcaaaactttgtactttctgaggtgtcagtctgcccctactggagggtgcctcccagttaggctgctcaggggtcaggggtcaggggtcagggacccacgtgaggaggcagtctgcccgttctcagatctccagttgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttagagcttccc

SEQ ID NO: 469347 - DNA, 940 bp, Homo sapiens
tttggaccattcatttccttagggaaatggttccctgtgagtatgcagctagcccaggttagatagaatgactaggacagtgaacataagactaatgactaatgcggccatacaatggctccttcaggctgaattgagaatgagtttgatactttccaggatccaggaattcaaaagggcaaaccttcagtcttcacacacaggcagtgatgagaaagctgtgaccttcagtactagacagcagaaaaggagacaatgggaaaacatgcaatgggctggagattcaccgaaagtgaaaattctggggccccaccataaactttctgaatcagaatctctgagcaggaacactattgtgaactgtgcatgcgagggatctaggttgtgcgctccttatgagaatctgatgtctgatgatctcaggtggaatggtttcatcccaaaactataccccctaccccaacctcgtctgtggaaaaactgtcttccacaaaagtggtccctggtgccagaaagattggacaccgctgctttaggatgcccagagtctggggaacactgtcttttgtcgtctactttccagttgtgcttgctcaggatttcagctcccccttccagccccctcatccatctccctccagcccatgcaccctgctttcttatgaaattgagggtcctactttaaccttccaaaactaaaggatcaataattaattcagctaaagttatgtaggttaggagtcagaattgggatcttttgaaaatttatttttgcctattaaaaatgctaaagaagaagttcctgcaagatctatgtagtaaggcatattagtgagcatttgtgatggtacattgtctcagctaaggcaagataaacagacaagctgtgaaaggagaatgcaaattagtaattaccaccatttgtcctgattctgcagga

SEQ ID NO: 469348 - DNA, 1425 bp, Homo sapiens
aagcagcttttccacacaaagccagtctgcaaagactggaataagtcctcactttctgaatgtgcagtcatccatgtaagaaggattggtaccagctcctcctcgtacctctggtagaattcagctgtgaatccatctggtcctggactttctttggttggaaatggcacaccaggagattatatcctgcccctggctcggagggtcctacgcccacggaggcttgctcactgctagcacagcagtctgagatcaaactgcaaggcagcagagaggctggggaaggcgcgtccaccattgctgaggcttgagaaggtaaacaaagtggccaggaagcttgaactgggtggagcccaccgcagctcaaggaggcctgcctgcctctgcagactccacctctgggggcagggcatagctgagcaaaaggcagcagaaacttctgcagacttaaaagtccctctctgacagctttgaagagagtagtggttctcccagcatggagtttgagatctgagaacggacagactgcctcctcaagtgggtccctgacccccaagcagcctaactgggagacaactcccagtaggggctaactaacacctcatacagccagatgcccctctgaaatgaagctccaagaggaaggatcagacagcaacatttgccgttctgcaatatttgctgttctgcagcctccactggtgatacctaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaatagataaaaccacaaagatgagaaaccagagcagaaaagctgaaaattctaaaaatcagagcacctcttctccaaaggaacacagctccttgccagcaatggaacaaagctggatggagaatgactttgatgagttgatggtgatggaacttgacaaaacatttaacaaggaacacaaccagtccttttgcacaatttgcttggctggcattcgtccattttatataactacatataattatcccacagcaattgctgctcgtgtcacaaaggcctccaacatgacccagagaaggagcactggcaaagccagtgacaccaatggcttacacattgtgtcatactgccctgttcagttacttttcttaatcaaaggttttgatggtaaagggaataggcttgccacagacttattgcaagtaacattaaggaaccgcagacattcacatgtttaaataggtatgctaatcagactgtacattgttcaccacgtcctggatcctcttggcaaaaaaaaaaaaaaaaaaaaaggcttatctaaaaataacatggcatttcatttatagaaaa

SEQ ID NO: 469349 - DNA, 999 bp, Homo sapiens
atcctgctgtggctgaaatccttgcagcagctgctccagatgggctgctgctgccatcaatatggtcatatcagtacacagatggagatccccagccaacaagtcagaattcataagtatatctcaaataaatatatttgacaacatacttgagaactttatcctggaagggtaccaccctcctgatctgtctgctgtggacattaagaagttgacagcaactaccacgtacctctggtcgaacccaaactttaataccaaaaccaaacagaaaacattacaagaaagaaaatttcagaccattatctcttatgaacagagatgcaaaaatcctgaacaattcaacaacaaaaacgaaatagtgggctgtgggacaattttaaagcagtttattatatacacaattggaatttctgaagcagtagacagaaaaaaaactgataaaataatgaccaaaaatattcaaatttgaagaaaaccataaacttacatatccaagaagctcaataaacctgaatcattaaaaacataaaataacattgcagcaaagaattaaattgttcaccataggtgataaagagaagatattttaaacagctagtgtaaatataaacattaaaaacagtaaaaaatattaagataattgtatatttcttattggaaacaagataagtgaaaagacattgaagcaacatcttaaatgtaccaatagaatcgtcagcctagaattctatgcctagcaaaaatatccttcaaaaacaaagatgaaatagagatttgattgtcataaaaatgttgacagacttaattgccaaaaaccctcactgtaaaaagtattaatttcttcaggtagaagaaaaatgataccaggtggaaataggaatctatacaatgcatgatgaacactgaaaatgataactacaggaataaatagtaccagtttttcctgttatttaaatcaatttaaaaggtaattgactatttaaatacaaataataa

SEQ ID NO: 469350 - DNA, 437 bp, Homo sapiens
atgtacactttcttatatggcagcatgctggtacacccagccatggcacatgcagactgtttcctaggatcaagttggttctggctacaagtcttgccatccaggaaaaactgcagctgtagcagctctcctcctgcctcaggcttacaacaggggacagcaccattccagtgcttactgctgaggcacttcccacagttctggctgtggaggcctttaccccactgcaatctctggcctgagggatgctccaatctctggcccgagactaatgtgtctgtgcagccacattgttgggtccccaaagaatggctgactttgtatgcacctggattaaaaatggcatcttcttccaggtcctgggtctgtgaaaatgcctgcagctttttccagtgtctttccctctcagagcctccaagcctctccccaagttagct

SEQ ID NO: 469351 - DNA, 817 bp, Homo sapiens
cagagacagcaggaaaaagctgcatgaggggagtccattcagctggccttgataaatggggcaaagcactgagcaaggacatggtgagggaaaaggtgtatgatgagagaaaaggggtcctgtggagaaaactgggaggaaaactcttttggttggttgggaaaaatgggaaacaaatagttgggagtgtctggactatctatgtgagaagtaggaccagatgctttcggagttgctcatgtgctctggggggaagaggaaaagttcttcgtttgaataatttggtccttgctcttttaatcaattcagcgcgtcaagaagaactatggtttggtaaggtccttgccctgggagttagtgacctagtctcagctgtgtgtcgtctccctaaagatttgtcgtatatgcacccacagaaccctggtgaaggtggatgtgctttaagacctctgtaaggctctaggtctccactgttccaagaaacaatttcttttatgtatttattcttatttatttatttatattatactttaagttctagggtacatgtgtacaacacgcaggtttgatacatagcctgggtgactgagcgagactccgtctcagaaaaaaaaaaaaaaaaaaaaaaaaaagcaatgacctctaaaggttaatgtgtctttccaatgtttccaactgattgactctcaaggaaaaactcatcttttttagcaaaatcacttcacaaatgctcgtgttattctatacaccatccagatcacacaggtaggcctcagtgtctgttgtttctctctgtgtccatgtgttctcatcattt

SEQ ID NO: 469352 - DNA, 1064 bp, Homo sapiens
cccaccgggaggaatggaaaactccagacgcgccaccttaagagctgtaacactcaccgcgaaggtccgcagcttcactcctgagccaccgagaccacgaactccaccagaaggaagagactccgaacacatccgaacatcagaaggaacaaactctggacacgccgcctttaagaactgtaacactcacagcgaggggattaagcaacacctaaactgtctgcaagggaaagcattttctgctttgcaaaggtggtcactcatatcccagtattttattattaatatgtgtgaagtttttcaatatgtattaaggacatatacaggattttcttgtgtaatgagaataatggaaataaaaacatgcatatcagctttggagtttgattgccttatgggcataaagctttgcatatttactgcccatgaatcataccgatgcaacactaaaggtgtaatccatgagagaaaaagaatggataaactggcctttgctaaaacggaaagtttctgttctacaaaagacactgcaaagataagaaaaagacaagccacagactagaagaaaatgttttcaaaagacgtatctgatgaaggactgttacgtaaaatatcaaagtaactcttaaaattcaacataaccaacaattgactgaaaaaatgggttgagagaccttaacagactccccatcaaagaaaagtagcataatgaaacttatctattggtttaggataatagcattgcacagtcatgcacaacacattctcattccagacctggtgaaaaatgaatgataaatatcaatataaattatgtcctatggttagcagaaattaggttacaacatcgtccttgaaaaatttcatcacattttctgcatcttgcatattaaaagcctgaaatttgaaggcagtgtttacctcaaagttgttccaccctgtaccatttaacaatcagatatgaaaatagtacagttttgcaaatgtgcttatatttgatggttcataaagttgatcattagatctttctttttaagttgtgattggatcacctaccaatattc

SEQ ID NO: 469353 - DNA, 656 bp, Homo sapiens
tctcttagtcttcgggcaagcagccacatctacgtacagtgccatgatttttcgaaatttaacttgtgaactgcttccaagaagtctttccttgcacttccaggtaaagttctcatctctgtgcttcctctgcatcgtacaagcctctgttagatcatgttcccttggatatatcagctgccttgtctggcaatatgcattagagaaggagctcatacccaggcctctgtttgtgaatccacagatgagttcaaagagaggagatggagggcagaaaaggatggagagccctagataccacagaaatcctggtgctgaccatcctctgctgctactccaccaaacaactcagggtgtacacactgatgatgatgatgacctagtctatccttggaaagatgggactgaggaagaggcctgtacagaacctatcaatgagatcagggccatattaatacctggaatatggtccagaggggatgcatggagtctggtgatggcattaagaggtgattatgtcacaagggtggaaccctgacgaatgagactagtgtccttataaaataaatcaagaagagaaccctcacccccttcaccagataaggacacagtgaaaagatggctgtccatgaattaaaagatcatggagaagcatc

SEQ ID NO: 469354 - DNA, 1022 bp, Homo sapiens
gtttggagtggaccttcagcaaactccaacagacctgcagctgagggtctgttagaaggaaaactaacaaacagaaaggacatccacaccaaaaccccatctgtacatcaccatcatcaaagaccaaaggtagataaaaccacaaagatggggagaaaccagagcagaaaagctgaaaattctaaaaatcagagtgcctcttctcctccaaaggaatgcagctccttgccagcaacagaacaaagctggacggagaatgactttgacaacttcactatccgatttgatcaagggggagaaagggtatcagtgattgaagatcaaatgaaggaaatgaagcaagaagagaagtttagagaaaaaagagtaaaaagaaatgaacaaagcctccaagaaatatgtgactatgcgaaaagaccaaatctatgtctgattggtgtacctgaaagtgacagggagaatggaaccaagttggaaaacactcttcaggatattatccaggagaacttccgcaacctagcaaagcaggccaacattcaaattcaggaaatacagagaacaccgcaaagatactcctcgagaagagcaactccaagacacataattgttagattcaccaaagttgaaatgaaggaaaaaatgttaagggcagccagagagaaaggttgggtttcccacaaacggaagcccatcagactaccaacggatctctcagcagaaactctacaagccagaagagagtgggggccaatattcaacattcttaaagaaaagaattttcaacccagaatttcatatccagccaaactaagcttcataagtgaaggagaaataaaatcctttacagacaagctaatgctgagagatgttgtcaccaccaggcttaccttacaagtgctcctgaaggaagcactaaacatggaaaggaacaactggtaccagccactgcaaacacatgccaaattgtaaagaccatcgatgctaggaataaactgcatcaactaacgagcaaaataaccagc

SEQ ID NO: 469355 - DNA, 479 bp, Homo sapiens
tccctgagataaatccaacttagtaatcatgtatggtttttggaatgttcatagagtccctactggggtaccacctaatggagttgtgagaagaggaccaccatcctccagaccccagaatggtatatccactgacaccttgcactgtgcacctggaaaagccacagacactcaatgccagcccatgaaggcagctgaaagggaggtggtaccctgcaaagtcacagaggcagagctgcccaaaactatggaaacctacctcttgcatcagcatgacctggatgtgagacatgaagtcaaaggagatcattttggagctttaagatttgactgccctgctggattctggacttgcatgggacctgtatcccctttattttggccaatttttcccatttggaatggctgtatttacccaatgactgtacctccattgtatctaggaagcaagtaacttgcttttgattttacaagcttat

SEQ ID NO: 469356 - DNA, 544 bp, Homo sapiens
tcctcacaatcatggaggagggtgaagaaggtgcaaaggcacatcttacatggcagcaggcaagagataatgagagccaagtgaaagggaaaccccttataaaaccatcagatctcctgctgatccaggtgagtggctgctccagatgcatggagatctgcttggggacagagcggagagggcccgactgcacaagatctctgcacaggaagggtgggacaactcaggctgccagtcagtgtgaccaatctggaccttacagcaagtctcatcgtctaggaaaaactgaagctgtagcagctctccttctacaccagcctctccctaagttagctccagagtttaagagacaaagtgctcttcctcagcctgggttgctcagatccccagtggaaagcctgcctgtgacctcactgattccattctgctgttgagatactctaatgaatttttcagttcggcatatatatttctcagctcaaagatttctgtttcattttttatttacttcaatctctttgttaagtttctctgataaatttcc

SEQ ID NO: 469357 - DNA, 753 bp, Homo sapiens
cgggcacgctagcaatctgtgcttctgtggctttgaggacttctttaacagaagctttcagaagagcatgttctcagtaaaagaactgaactaaacaaattctgtctagctcatcatgctatctctttgccaaaaggagtatatctgtatcctcaatggaagtaaaaggcaagcagggggttttgtatttccaaaagtatacatgagtaaagactactttgttgtcatctttctggctaaatgtgtgaacctgattcagcagcatattctcaaatatctcagtatcatttgggacgtatgtctgaaggcctccccactgaatcctccagaggtcatctttcaggtaaaatgctctcagcaggtgcccttcattggagagcagaccatttcactggtgaccatctcctatggtgggaagactcttccctaccctgaggcacggcagctgttgctgttactattgaggctggctgcagctgcagtgtcctcgtcatactcttacagagcatcaagtttccactggccagagttagaatgcaagctgtaacctaccagtcgtcctggaatgacccccgatcccttcctgtttcattgcattctacagatgaacacaaagacgtgtgtccttgttcccactgtgcacacacgcttctcctcacaagttctcattggattctcctaaaatatattttagctcagtcctcaccctaaagctgcctgtatagaacttactagtcagtgtgctgcaagact

SEQ ID NO: 469358 - DNA, 690 bp, Homo sapiens
agagccaggactgtcttccgagctatatcacgtaaagcctcttaggccatgacgaaatttttgggtcgcattctgagtgagatgggagcctttggaaggtttgagtggaggggcagtacaagactggagatgcttccctcaagaagagctggttctccctggagtgcagcaaaactgccactcactgcaggcatcttgctccctagaggaacagggatagagcagaaccgagctggtccagatgtttccaaacaggaacatggctttggggacatggatgaagctgcaagccattatcctcagcaaactaatgcaggaacagaaaaccaaacatggcatgttctcatttataagtgggagctgatcagtgagaacacatggacagagggagaggaacaacacacactggggcatgaaaaaccggttcttgtcacacgacaaggaacaattaagtttgcagacacttcgaaagaggcctaagtttaatcaaggatttcaaaacataaagttgactgaaaagttttgttgagtaaagtgtatatttcaatcagtcataacttttacctgtgaaatttaagaaaccatatccattaatttcatgaaagaattttaataattagaatgcttttgagatttactattttaaatgtaatgactcattttaaacattttacattttagaaattaaga

SEQ ID NO: 469359 - DNA, 2371 bp, Homo sapiens
ctcctctggagtgtgtacgctcaagaatgattactctgccatacctcattgccaccgcttgggataactttccaaatcactacctgcatgcaagccttgatcttactctgctttgtggggagcctaagaaaacctctggcaaaaagagactctatgcagatgaggaatcaaagaggagaaattcctggtcagaaagagtcatgtttgtttttgccttttcagcagggctgctgaaacagtcctgccgtggaggatggctgttctcagccacccacacttctcagaggctgcagccgaggctgacggcaaaagcttctcaattgtattgtaccttatttcttgaatttgaaaaagctatgataacggctgaaactgaatgcagcctccaacacctgcaggatctgctcctcctatccctcagcctaatccaagaccttgctctacaatgaccttactgaagtcccttgaatgtggtccttatcacttcaccttcatccatgctattccctctgcctggaacactcctccctcaccactttgccaagattataaatttgaccatgcattttatgttttgacatatataatagcatttcattgacattaatttcaaaatatctttcattttatcttgatttccaatttgggctattttagagagcagctattatattttcaagtgattatatttgcaggatacttttcaatataacatataagatttttttactatagaatttatctagttgactagtctgattgtcatatctggttgactagtatatggttgatttttggtatgttttctatgaacagttgaaaatgatacatttgacttggatttggagtacaatatgtctatattaagtctcttctgcaccttttctctttgtcaacaccagccattaaattctaaaaaattttgttaaatcttctactctggctgtggtttggttgaattctgcctgaatttctaagaaaatggttgatagaaaattccattcgttggcttcttcctttagcccttttctaggattttaactgttattcagagttggagctgttattcttggtggcctttgattgtgagtcagaatattaataataatagttctcaaggaatattgacattttacactattgctcagaagcattctatatctctccattctatatatactttccaattcattgccataaagttatccagaaagaataaagtatacacttcactcttttcagtcttctccacatttctagttatattcattttcttatcttaaaattttgtaattgtgtttagtttaggttagtgttttggtcacactttccagtggtttgtctgttttcatggcttatttttcaatacatgctttttaatgttcagatattctaacatattacccttttctaattattttgctcattagtgagtatttaaccagtgaaggattgggtatatattaatattttcttcagttaaaaacaaattttaaaagtctattatgaagaaaatatatcggaattaagtttccagatattccaaacatgtgctgttttaaagaagtgcttaaaacaaaatgcctcagaagtttaaaataaaaggaataatgaaggtatatttaaaaaggtaacagtacagaatttgatgccaaatgcactaaataggccaaacagaataattatatgttcataaaagcatatatagtaaaataaatgtaaacctgggtgcaacaaatagcatggcattaaaatatatggaacaacggaaagaaagaaagaaatgaacaaaacaaaagataggcaagctatttaaatagagtactttcagtgtgtaagagattatggagaaaaaaaattgtattatttatccaaaaataccctacttgaaatcacaaaagaacctcaagaaattctacaagtatatttttttcatactatactctaactacagtacaaaatacctagaaatcaacattaaatgtgtaattttaaaacatatctgaagatttagaaaccccttctgcaaactagtgggtaaaaaaggaaattaaaataattacaaagtatttagaaaataatactgtagtttatatgaacacaaagtatatagaaaaactcataatgaggtaaattcttacccttaaggatttcataaaggaagaaagaggtataataaattaaatatgcctttgtgctgaactaggcaatcttcaaaatgtctgccatactcatacccttttgtgaggttaactacctgctcataggccctactgcccacagtgaggctctgtaccctataacctccttccagagatggctaattaaatggaccaggagtcagcttgttatctaagacctactcattctt

SEQ ID NO: 469360 - DNA, 3642 bp, Homo sapiens
tacctaggatgggccactcggaggggaggcagctctcctcggccatcacagccagaaagtgggctttgagtgttccgtgcggtgctgccaccgtgtctacacccacctccaccgtgtctacacccaccaccgtgtctacacccacctccaccgtgtctacactcaccgccaccgtgtctacacccaccgccaccgtgtctacacccaccaccgtgtctacacccacctccaccgtgtctacacccaccaccctgtctacacccacctccaccatgtctacacccaccgccgtgtctacacccaccgccactgtgtctacacccaccaccgtgtctacacccacctccaccgtgtctacacccaccatcgtgtctacacccaccaccgtgtctacacccaccgccaccgtgtctacacccaccaccgtgtctacacccacctccaccgtgtctacacccacctccaccgtgtctacacccaccaccctgtctacacccacctccaccatgtctacacccaccgccgtgtctacacccaccaccgtgtctacacccacctctgccgtgtctacactcacctccgccgtgtctacacccaccaccatgtctaaaaccacctccactgtgtctacacccaccgccaccgtgtctacacccaccaccaccgtgtctacacccaccaccatgtctacacccacctccaccgtgtctacacccaccgccgtgtctacacccacctccaccgtgtctacacccacctccgccatgtctacacccaccaccaccgtgtctacacccaactccaccttgtctacacccaccaccctgtctacatccacctccaccgtgtctacacccaccaccaccgtgtctacacccaccaccgtgtctacacccaccaccaccgtgtctacacccaccaccaccgtgtctacacccaactccaccttgtctacacccaccaccctgtctacatccacctccaccgtgtctacacccaccaccaccgtgtctacacccaccaccgtgtctacacccaccgccaccgtgtctacacccaccgccaccgtgtctacacccaccaccgtgtctacacccacctccaccgtgtctaaacccacctccatgtctacacccacctccaccgtgtctacacccaccgccgtgtctaaacccacctccaccgtgtctacacccaccaccactgtgtctacacccaccaccgtgtctacacccacctccgccgtgtctacacccaccaccgctgtgtctacacccaccaccgtgtctacacccacctccgccgtgtctacacccacctccgccgtgtctacacccaccaccaccgtgtctacacccaccaccgccgtgtctacacccaccaccgtgtctaaacccaccaccgtgtctacacccacctccaccgcgtctacacccaccgccaccgtgtctacacccaccgccgtgtctacacccacctccaccgtgtctacacccaccaccactgtgtctacacccaccaccgtgtctaaacccaccaccgtgtctacacccacctccaccgcgtctacacccaccgccaccgtgtctacacccaccaccgtgtctacacccacctccaccgtgtctacacccaccaccgtgtctacacccaccaccgtgtctaaacccacctccaccgtgtctacacccaccgccaccgtgtctacacccaccaccgtgtctacacccacctccaccgtgtctacacccacctccaccgtgtctacacccaccaccctgtctacacccacctccaccatgtctacacccaccgccgtgtctacacccaccaccgtgtctacacccacctctgccgtgtctacactcacctccgccgtgtctacacccaccaccatgtctaaaaccacctccactgtgtctacacccaccgccaccgtgtctacacccaccaccaccgtgtctacacccaccaccatgtctacacccacctccaccgtgtctacacccaccgccgtgtctacacccacctccaccgtgtctacacccacctccgccatgtctacacccaccaccaccgtgtctacacccaactccaccttgtctacacccaccaccctgtctacatccacctccaccgtgtctacacccaccaccaccgtgtctacacccaccaccgtgtctacacccaccaccaccgtgtctacacccaccaccaccgtgtctacacccaactccaccttgtctacacccaccaccctgtctacatccacctccaccgtgtctacacccaccaccaccgtgtctacacccaccaccgtgtctacacccaccgccaccgtgtctacacccaccgccaccgtgtctacacccaccaccgtgtctacacccacctccaccgtgtctaaacccacctccatgtctacacccacctccaccgtgtctacacccaccgccgtgtctaaacccacctccaccgtgtctacacccaccaccactgtgtctacacccaccaccgtgtctacacccacctccgccgtgtctacacccaccaccgctgtgtctacacccaccaccgtgtctacacccacctccgccgtgtctacacccacctccgccgtgtctacacccaccaccaccgtgtctacacccaccaccgccgtgtctacacccaccaccgtgtctaaacccaccaccgtgtctacacccacctccaccgcgtctacacccaccgccaccgtgtctacacccaccgccgtgtctacacccacctccaccgtgtctacacccaccaccactgtgtctacacccaccaccgtgtctaaacccaccaccgtgtctacacccacctccaccgcgtctacacccaccgccaccgtgtctacacccaccaccgtgtctacacccacctccaccgtgtctacacccaccaccgtgtctacacccaccaccgtgtctaaacccacctccaccgtgtctacacccaccgccaccgtgtctacacccaccaccgtgtctacacccacctccaccgtgtctacacccaccaccgtgtctacacccaccaccgtgtctaaacccacctccaccgtgtctacacccaccaccaccgtgtctacacccaccaccgtgtctacacccacctccaccgtgtctacacccaccgccgtgtctacacccaccaccgtgtctacacccacctccaccgtgtctacacccacctccaccatgtctacacccaccaccgtgtctacacccacttccaccgtgtctacacccacctccaccgtgtctacacccaccgccaccgtgtctacacccactgctgtctgcttcatgactcgggggtctaggctgcttctttcctctctctctgcatttcaagaagatgagagcgagaccatgatgctccgtgtgagtgtcatttgagattaaaaacatcctcccctaacttgtccaatattccttttgaaaagaattccctaaaaaatttcttgtattgccttgtgggctaaagtactgtctttcctgaaagtctgacatgcttccttttatcagataatgtgacttgtgtaagattcatatttccatatttcccttttcaccttggctatccggaagctcagtgtgtagctttacgttc

SEQ ID NO: 469361 - DNA, 1029 bp, Homo sapiens
ccgtccagtcctagtctaggctcgtgttttcagtaaagaaactgtgtctcccaggagttgacagcatctgcttgagggtgtacagctccgtcgtcactggggaaggctggacaaagcagagatttaggtgtcggaaaagcactgcaggcaccttatccctggaccagagactcccttggtctgctttgtttttaaagtagaaacggtcattgtcaaaatggccctcaggcacaatatttacacagcagagacccagtcgcagccgcctcacaccgaggtcaaggggcagagacagcaggaaccgtgagctctggttcctgagccagtgtctcctccctctaccgaagccctcgtgtttgcactctcttgacgaaacaccgagctatttaagtgggaataatatagttccttctgtagacagcacagctgatgccgtggtcaaggacaaaaatgttaaaaggtttggcctttagtcgaggacgggcagttgttgctttcctggaggtagctggacgcaggcgggttttcctcccgagctgtttactgccctgtgagagcttcctgacagcagcttcactggcccccttccaatcgagttcctgccctctcatctttgtggagaccacgctgactatgatttccgaaaatttacttgttctctgccaaatccaaggattcccactccctcccacccataccctcgctttgcttcttcccggctctgcacactccccaacttgcttctgcaccaggggcccctctggggaaaagcagatgtcccttgagctaaagaagttgcagttcacccaggctgggctgtcctggaggttgtgggcacgtgagcgtgggaggggtcgtgtgttcctccacgctcacccagagcagccccctctcggcttcgcagcccatggctggcatcttgagtgccaataacgtgctccctgaagctttccctggtggacacgaagcagcacttcgctcgtgatggctgattgaaaacatgccggtgaactggacgacggtgagcac

SEQ ID NO: 469362 - DNA, 1888 bp, Homo sapiens
gtcagtcaagtccaagagcagacgtgagtcgagtggtcagtgggttgcaggtaaccataggccagccgagggtggcagccgtaggtggacagctgggactccttccctgtgggtgacagctgtgggtgacagccgtgggtggacagcatgggtggcagccgtgggtggcagctaggactccttccctgtgggtgacagctgtgggtggacagcatgggtgacagccgtgggtggacagctgtgggtgacagccgtgggtggacagctgtgggtgggcagcatgggtggcagccgtgggtggcaactaggactccttccctgtgggtgacagctgtgagtgacagccgtgggtggcagccgtgggtggcagccgtgggtggcagctaggactccttccctgtgggtgacagctgtgggtggacagcatgggtggcagccgtgggtggacagctgggactccttccatgtggatgacagctgtgggtgacagccatgggtggacagcatgggtgacagctgtgggtggacagctgtgggtgacagccgtgggtggacagcatgggtgacagctgtgggtggacagctgtgggtgacagccgtgggtggacatcatgggtggcagctgtgagtggacagctaggactccttccctgagggtggcagctgtgagtgacagccgtgggtggcagctgggactccttccctgtgggtgacagctgtgggtgacagccgtgggtggacagcatgggtggcagccgtgggtggcagctaggactccttccctgtgggtgacagctgtgggtggacagcatgggtggcagccgtgggtggacagctgggactccttccatgtggatgacagctgtgggtgacagccatgggtggacagcatgggtgacagctgtgggtggacagctaggactccttccctgagggtggcagctgtgagtgacagccttgggtggcagctgggactccttccctgagggtggcagctgtgggtggacagctgtgggtgacagccgtgggtggacagtgtgggtggcagccgtgggtggcagctgggactccttccctgtgggaggcagctgtgagtgacagccgtgggtggacagccgtgggtggcagccgtgggtggcagccgtgggtggcagctgggactccttccctgacctgagctcacttcatttgaccaggagcatcaaaaacagtgtgtgcatccaaaccactgtgaatccccacactgtaaaaacaaaaacttcaaacgtcacatattttgtccactttgccctcaatgcacgctttatccatgtgagtgtgagcagacatagagcacagccctcactcctccatccaccaaccgatggcagcagcaagcacagtcaggcttctcagcacacaggatgaaggaacaagggaagacagccccacggtctgactccgagtcccagctgaggaaccagccaatagcatggacagcactacttcccatcagcatgactgtcagcgtctccaggtctgcaccaggccccagctgctcctctgtctggaatgagcaagacgattttgttgctgagatgcacggagccccccggctgacctttccctgtgccagtgagtacctgtggcatgcaagggagaaagcctatcaggaccacaggagaaagcacagaccctttaccggtgtcgggctggggtacagtcaggtctttctcatcccacgaggccgtatttcagactatcacatggggagaaaccttggacaataccccgctttcaagggcagaggtccctgcggctttctgcagtgcattgtgcccctggtttattgagactagaggatggcgatgacttttaccaagtatactgcttgtaaacgttttgttaa

SEQ ID NO: 469363 - DNA, 645 bp, Homo sapiens
gggctcttgtgcacctcacaggacagtaggaaacggaggcactgggaggtggcagaacttggccaaggttgcacagaccactaggtccagcatctttctggaaaaaacaccgaaaatcatgtacccctgcatcctgtgtgggtcccagcctgggatactgctcagcaatgcagatgcacaccagaagctgcagccaagtgcatgggctctgctccccacagctcctagtcgaagggccttcttcctggaaggggcagggccttacttttctcatcttgtctgcagttgcctgttgctgagactaaatcccagagagaagatcgccattgttcccactccgagctccagggctctgagattttgcccagaggaagaagcagaccctcaactaatccacaagttcaacaaggttgcagaatacaagatcaatacacaaaaatcaattgtgtttttatatacttgcaatgagcaatctgaagaggaaactaagaaaacaattccatactcaaaagtatcaaaagaataggtacttaggaataaacaaaggaagtacaaaatttatactccaaaaactacaaaccgtcatccacaaaaattgaagatctaaataaatggaaaaatatcccacgtgtatggattcagaag

SEQ ID NO: 469364 - DNA, 1266 bp, Homo sapiens
ccatggtatggagctcaaaggtggtgtgaagactggggcagggctgagaagtcccgggtgctggtgtggaatctccctggagacagcagatacgcctagcaaaaaggaccatggaccccacccctgcacaaactccagaaccacagaccccacccctggacaagctcaaggaccacagaccccacccctgtggaagctccaagaccatgaaccccacccctgcacaagctctaggatcacgaatcccacccctatggaaactccaggaccacagaacccatccctgtggaagctccaggaccacagaccccacccctgtgcaagctccaggaccacagaccccacccctggacaagctccaggccaatgaaccccacccctgcacaagctccaggaccatgaaccccacccctatggaagctccaggaccacagaccccatccctgtggaagctccaggaccacagaccccacccctggacaagctccaggaccacagaccccacccctgtggaagctccaggaccacgaaccccacccctggacaagctccaggaccacaaaccccacccctatggaagctccaggaccacaaaccccacccctggacaagctccaggaccacagacccccacccctatggaagctccaggaccacagaccccatccctgtggaagctccaggaccacagaccccacccgtgtacaagctcctaaccctaaccctaaccctaaccctgaacgagcttcagaaccacagaccccaaccccggacaagttctaggatcacaggctctacccctgcgcacctacttgaagtagcacctcattgccttgccccctgcagtttccacagcaattacaaaatattttatacagatttgccttaatttatttaatcagtcccctaattattgaaatttaggttgttttcagtttttcgatattccaagtgaaactatgatgatcatcttaacccatatgtatctttacacaaaattatgctgtaacttatattcctagaaggaaaatggttaaatcaaaggtaagcacatttagattttcaatggataccacctaattgccccccacaaacagtctagcaattttcacctctgcttaaagtggtcccaaagtgtctgtctcctcataattttgccaaccctgggtagtaaatatatttttaaactttggaccatctgatttcttcttgtatgaattgtctgttcatagcctttgaccaaattcttatcatatgttacttttc

SEQ ID NO: 469365 - DNA, 815 bp, Homo sapiens
aacggggagatctttggaaacatggctacagaacatgttaatggaaatgatactgaagagcccatggatactacttctgcagttatccattcagaaaattttcagacattgcttgatgctggtttatcacagaaagttgctgaaaaactagatgaaatttacaacaaaagtgcctttttatgtggagtcatgaaaccttataggcagagagaaaaacaagggaccaaagtagcagattctagtaaaggaccagatgaggcaaaaattaaggcactcttggaaagagcaggctacacacttgatgtgaccactggacagaggaaatatggaggaccacctccagattccgtttattcaggtcagcagccttctgttggcactgagatatttgtgggaaagatcccaagagatctatttgaggatgaacttgttccattatttgagaaagctggtcctatatgggatcttcgtctaatgatggatccactcactggtctcaatagaggttatgtgtttgtcactttttgtacaaaagcagctcgggaggctgttaaaactgtataataatcatgaaattcgttctggaaaacacattggtgtctgcatctcagttgccaacaataggctttttgtgggctctattcctaagagttaaaaccaaggaacagattcttgaagaatttagcaaaagtaacagagggtcttacagacgtcattttataccaccaaccggatgacaagaaaaaaaacaggcttttgctttcttgaatatgaagatcacaaaacagctgcccaggcaaggcgtaggttaatga

SEQ ID NO: 469366 - DNA, 555 bp, Homo sapiens
gtctaagacatgttggctgacagagggcttttagaaagacatgtgtggtttgtctgtctctctcattcttattccacacacactacgtacatgcttaaaccgttggctgccatcataaaaatggtcccaaccaggaaatgtgcaaaaaggcaggacagtgaagttgaccctccagaaagatggaccaaggatattctgctctttgcatcctccctgcacagaattgagtctgtgcctactcccgtttcagaagcatgtattagtggagtactgagtgatacaggagccagaaggccagagtgggaggaattttcttctctcatctgggatgaggctctggcaaagtcctttgttcctggagagaccacaaaaagatcttcctcaggttctcaaaaggagaacatggtagggttcctggagggcaagttcatgaaagtgtgaggcctatcatgggtgcagccccagaagtttctctccccttgtgctagtctacactgtcttcagcaattcatccaaattaccatttaaatgttccccttagtttctgcctccagc

SEQ ID NO: 469367 - DNA, 775 bp, Homo sapiens
aaccataagtgtagcattttttctgagttctttgaggagtagtaggaaaccctgaatgtgtagccagttggtcagatgtgcaggtggtctgggaagcccacagcctgcagctgtctccttcttcctcctcctcctcctcctcctcctccttcttcttctccttcttcttcttcctcacacatctttaaaaacaatgacatccctggtccccttgctggcatttggattatgtctgtgactggtctggcttggctttgtcaaagggcatctgtgttccctagatggctctgcctcacctgggctccctctgcagagactacagcacctgctgtgctctctctgccaccttctgtcagcctcattccacaaccctaccaagcgaggtcccagagaggccccaggagctttcagattagctcccagaccacatgggaagcacaagtaggcagttcaagaaaacgggacctccctgttgctcctcagtattatcctcacttatcccacacacctcatctctccaactgggaaaactttccccacggagagaaacatcaaggtgtatctcattacattgctttctttcctcctcctgccttccactccaccttctggaaatcaaaaacaggcaagtgttttaatgcacttccctcatgccattcttctggattccaaacactccttaaaattatagtggctggaattgcaggtgcgccctaacacatgaggcttctgcagggcatggcgagtgcacctgtaaattccggctactcaggac

SEQ ID NO: 469368 - DNA, 1575 bp, Homo sapiens
aggagggagaaagcagtaacaggaggcacagcacgtcctgcagggccatatgggaagcaccagggctgatcggggagcaaaggaagcaggaagaggatatcttggacaagagcctttattgtggtttctgtgggaaggaacaggcaagatagaagctatgaaacttggttgctggatcgttacactgaggctaataatgaaaggaaggcggaataaagggccttggttagctacaggatcctatcggacaggaaggattgctgtttggcagagggtgggcatttctgaagatcttcagggagtaaaggagcatgatgtctaccacttattctcaaatgggttgcaaaaaattccttttagagagaaaggagaaaacaaatgggaaacaatttcagttagccccaatttggacgtggataaaaagtaccttggaggtgttggtctgattctggcaacttctctggagggttaaaaataaatcaaattaaaaagttgtacaaaagaaaaaaacctttctcaatatttaaaggtgcaaaatatttcgatgtgatataattacaatatgttgttgcagtactgtgaaaccaaagctttatacttttaaacagttaagtctgattaatgaaagcagaaaaaaaaaatccccttagacttagcaacaaacagactgtacccctggacaacactgatgttgtagctctcagtgttcttcccagttttctgttgtaggtcagctatgcctcacagtttaaaattgcgaataggagaaagagaagagcacctagcatcttaactcctcatgctgaagaggaaatagttctgagcaattatttatttaaaatattaaataatatttaaaatattaaataatgtttaaaatatttaaaatattaaataatgtttaaaatatttaaaatattaaataatgtttaaaatatttaaaatattaaataatgtttaaaatatttaaaatattaatgtttaaaatatttaaaatattaaataatgtttaaaatatttaaaatattaaataatatttaaaatatttaaaacattagtggtggtaaggtgaagaaaaaagttaagttggttgttttctacaagttaaatagataagttttgtggttggtaattgaaatagggagcaagctttttgtgaaagctttaaataaacttttagagttttaaaatgggaaactcaaagtatattttgggaaaatgtacagtttagtacaagccgtgagctgtctcatatgtttagagcaaaatgctaattgggtaagtacttggagatgaagctggaaagagaagctgagcttgaagagccttgcttgcggaggtgagagagtggactcttgttgagccagtgggaagctggcagtggttttggagaagaaggataaattcaccagagtgtaaatatattcttattactggattaaatcacttcaaataatttcatctggtaaaaacttgaatttattcctagttctttgtgacaagctagcaacttgaattttcttttctttttttaaagtagttaaaaaaaactacaggagagccagatctgacaag

SEQ ID NO: 469369 - DNA, 507 bp, Homo sapiens
ccagatgtgtcccgtgcttggggaattaaaatgatcggcactcttgggctgcatgctctaaccctgggggactgggaccaggcccacagctttgttctttggctcctcaaggatcctgtttcactggaggggctgaggtattcccagtccactggtaacaaccctcttaagggggcgtgctggcaaaagtacttcactggggaagtggcagtgagcttcatgctttcaatcaccaacgaagtggtacaagaaggctgtgagcaaaagcacactggcgaagcagtgtgggctgctgtcagcaggtgcatgctgggagtggcccatctgcagaagctctctgatgatttggtggtatctgccagtgaagatatggcagtgaccactgggaaatgccacagttggagatctcagactgcactactgggagaggccagcagacagggggctctcagatcagactgtccccatcccatgagcagacagtcctgttccacccatgtctaatag

SEQ ID NO: 469370 - DNA, 539 bp, Homo sapiens
tcctttaacatggtctttgcattaaaggtatggaagagttatcttctctttgtatcttccttgctgaacagttctcatcacaggtctcagcacagcctaagcctggaaatcaggaagagggatggcagggtccaggtgttgtttcacggaaagggaaattcagggaaagaatttggaggaaggccagtgctttctggtgaaaaaaacagttgcttggaggctgcgcttggtggtttgcgcctgcagttccagctacgggagaagctgaggctgcgatggaaggactgcttgagcccagaagggacgattgctgaacttttccaggaagctccctctctgtgctgcaacccagaaattttctctgtacagtacaccgaaccaggcattccttcaaagagccctgtatcctttaacaggagaacagtattagaaaccaaatatgggcactagatatgctcattgctagtgggttgtgattgcttccagaccattttggctatcacaacaagaaaatatgtatgtatacccaattaatcttc

SEQ ID NO: 469371 - DNA, 938 bp, Homo sapiens
aaaatttctgatgtttctagaagcagccatggtagcatggtggagagtacacatcagctgggtgaggtactgtcagaagtggggctatagcatttctacatgtacttgcaccagcacagaggacagggttaccagcgtctgtgctcatattcacaccatcagctgtggggatagggccactggcgtctgtgagctcgttcacaacagtggcaattgtggtgtgcagagggtggcagagtcaccaccgtctatgcatgtgttcataccagcaatgacagtgcgactgagtgcccacacattagtggtgtgggggggcagcatgttgcttcacaccagcagcagcagtggggtgtacatgcaaatgtgcaatggcagagcgaaaatgaggtctgcctctacatgcctgctcctgatcttgggccagcaattccttactgtcttgaaggctctctaatattttaaatcaaattagagagttacttttttcatatttcactctgtagtaactaggggttatgttctgcatattaaaatttacgtaagacagaaatatgaccctgaatattcaacaatgtataaccctaacactttaaaatgctgagtgttttttgtattatgtacagtgaatatatttattttgtaaggtacaaacagaaagaaacaatagaaaaacactttaaagaaagtggataggtgacattaatcagctattaaacacttttatcattttgcactaagaaagttattccaaggttaaaaaatatttatgggaggtgagagagtcttaggaaacttatttgctataagcttttaaatgtttggttagtgttctttcaacaaaagaaaataatatctcattgacagataaaaatttcaataaaacaaatataattttttaaattactgattaattttgctcatcaattttgataattata

SEQ ID NO: 469372 - DNA, 682 bp, Homo sapiens
aagggatcttgacctctgtgcataagctagagcacaaaggccatgctgctagttagggcagggtggttccctgccctaatggtaccaggtgagaaagagagagaaagaggacagagaaagaaagaaagaaagaaaagaaagaaagaaagaaagaaagaaagaaagaaagaaagaaagaaagaaagaaagaaagagagagtaaggagggagggagggagggaaggaaagaaagaaagaaagaaagaaagaaagaaagaaagaaagaaagaaagaaagagaaagaaagaaagaaagagaaagaaagacagacagacagaaagaaagaaagaaagaaagagaaagaaagaaagaaggaaggaaaaaagaaagagagagaaagagagaaagaaagaaagaaagagagagaaagagaaagaaagagagagagaaagagaaagaaagagagagagagaaagaaagaaagagaaagaaaagaaagaaaagacactggaaaacagatataccttgagaactattgcaaacaaacttggaatcataaaatttcgaggcatactttgtggaaatataccataaattgtgtaaatatctgagtataaagtggagctgtttcgagactgactgtatttaagtaatggagatgcatataaaacttagattttaaatattttattaatcttggcat

SEQ ID NO: 469373 - DNA, 713 bp, Homo sapiens
acagtggcacccgaaaacagagatgccagcaactgcggagccccaaggggtgttaacagcttttcctcggggagtcctgaggtctgagccaccagggaatgccacagctcccttgctctcattcccaccgcccatggcttggctaataggggcgtgttataactctggctcgggaagtcccgaggtctggaccctcttcactcccatagtccggcaaatgggagtgtgtcacagcgcttttcattcatgctgtccacagcttgagaagccagacaggagtatgttacagccctttttcgctcctgccgttcagcggttccgagtacttgtccacaaccaagaagaaaggagctatgtggacactggagaagtaactgtgcactggggaaagggaaatgatcagacgtttcagggactactggacactggatctgagctgacattgattccaggggacacaaaacgtcattgtggtcctccagttgaagtaggggcttatggaggtcaggcccaccagaagtaatttgtgttcagctggaaaggtcagaagtataccgttactgtcctacctcaggggtacatcaactctctgactttgtgtcataagcttagtaagagagagcttgatcacttttcacttccccaagattatcacaccaaggtaattgaccaatgtaatggtccaatacattgatgacattatgctgactgga

SEQ ID NO: 469374 - DNA, 3022 bp, Homo sapiens
ccctgagctgccaggataggctctggcttcccatcaccctgaactggaatctgcagtctgaaactccaaatgccttgtgaaactggaactgtgaatttgaaaatgcgattcatcttcctggcagcagtgtctttaaccttaaatactaaactgagcattcttaaaactctaagtgactggtttcaaagcttcaaagaactggctgactcattcagacttaatgcagctgttctaatatgggcaaatgctaccaaacagcagcaaatgctatggagaaatctttcacaaaaagaagagtcagtaaatgtgacaaattccattgttgtcttaaagatattgctacagccattccaatacacagcagccaacactctgatcagtcagcagccatcaacatcaaggcaagaccttccaccaataaaaagtttatacctctctaaaggctcagatggtcataagtatgttttagcaagaaagtatttttaaatcaagtgtgctttgatttcttgcaatatgattacattatttaaaaaggcaacacaagtttagatttcttcaaatggaaataaattgaggtaatacttgttgtggttgctattgctttattgctgtagctttattaaataaattttaaaaaagcttaagtttgaaggcttcaaatgcaggatcctgagctatgaactgaatgtagaaaatcagtaaggtatgaaatagcttattgtgtttagagaaatgcagtgttttcaatatgagtaggacatgctatgtcagcttgtgtttgaaggtatatgttctgggctggagctgggaatttgaggaaataaaagttagattgactagagcctgattatgatggatattgcatgctatactaaggagtatgggctttgtccccaaagccttaaaaaaatagtaaaagattctaagcaccaattaatatttgggttttgcactttttcccattgtactttttattttttaagtttttaaaaaactgttcacttttaacacaatttaaaggaaaacaaaacataaacaaaaatgaattctactctgattatctgtgaagtttgattttgttagagaaagaaataaaataatttataatggagaagctaaatctaataaccgttgtttaataaaatatatttaataccacaggagatacagtttacttcagatactgatatactttcacttactcatacagttctttctattaacagttcccttctaaatagaaacagagatttttattaatgattctgtagaaaatcacatattctaataactaaaattaaactatttaaaataataaataacatgtttagttgagtaatatcttccaggcacagtgctaagtttttcatatctatttaaattaatttgcctattaaggagaactctaggaaggagtttgccgaggtttagtctccctgcataccacctattatactggcagacatatacttgtctgctttgacttgcctcttggacattcagggacattttttgggggaaaaattaattccttactcctgatacttccttatatgtgtataaagtttcaatattgaaaaacttcctgaccctgcttcaccatttcattttgtcactaagaagataaagcaatgtttttgattggtaaacgagggaaaaaaataaccatgtattggccagatgcagctttctttctattggaaccgagaaatcatcagggagtaaatcagggaataagttttaccctctcttgcatccctagttcttcactctgtgttttctctttattgctgcaaaattaatagaagatacaatttaaacttgggtgtagcaatacaatagaaatgattttttaggaggcaattgctttaagatccaagaagtcataagaaagcaaaacaagtcttgtataaaaagtaaggatatttgtaatccttcaaaccttagcaatcaacataatttaatagacattacaaaatgacatattttgcctttaaaatctagtgctttcagctgtgaaatagaagacatgaatttattaaatgagggtaaactaatataaattaaaagttcagccttagccgtgatattaatatctgttcaacctgacctgtctatttttctcccatttctgtaaaacacactatcaaaagtggagaatatgtattcaaagatagccctcacaatcagggtcagagttccgttctgaagactttaaagcaacaagcatacaaaagtgtttcaagggcataacattccccacagaagacctcattggttgcttctggtcatcctgagcattctgctgaaaacatctgtcctcctagatgtccaatatcctaccatctgcttagtcagctatattcttaaaggcacaatatgaaacattgaaatcagcaaattaaaaactcaggccttaaattgaaaattcagaataaaacagtaagaaattatgaaaaatgtctctaatccaggaggtgctaaaaaaaaaatacatgaattaatcatcaaaagcacagaactgattacatacagaaagttataaaagaaaatgtgttcaaggtagaagttccatacagcacctgggggcggattataatgttttctttttaaaacagcacattaatatagtggaacaattcacatatcattggatttgatgacttaagctgcagccttactattttaattccattagaagccaagttctgatccaatgctctattctgttagaaatacaacagaaaaatactgtgccaaattctggtacagtatacgtagcctctcctcatagagctcatcctgccaacaaaatgctcagtccaaatcaataagtaaataacaccaggaaaatatagtttgaaatgaattgaaacagagttacagtgtagcggacaaaaataaatcctttcacaaaactgagagctttctgagttatttcaatcatggaatgcacctgcatataactcacttaaaattgtggcatttgtgaattatagatctttcatacatgtgaaaaacc

SEQ ID NO: 469375 - DNA, 1141 bp, Homo sapiens
aacatttggctcctcactacttatgcaactttctgcagcaggcttgaatttctcctcagcaaaatggagcccaaacccctccactacacaatatatccatgtaacaaacctgcacatgcactccttgaatctacaaacattaaaaaaataagtattaagggttttggcccattgtacctcagagtctgtgatggtattgacatagaaaaggacagctggaaaaatttcacatatgaggaagaatatcaaaaatacttaacaaaaacttcaatgttctgtgatcaggctgttgcttataaatctgaagcttattctcaggagagttacaaaccactgctcaacgaaataaaagaggacacaaacaaatggaagaacattccatgtgaatggataggaagaatcaatatcgtgaaaatggccatactgtccaaggacataggcatgggcaaagacttcatgactaaaacaccaaaagcaatggcaataaaagccaaaatagacaaatgggatctaattaaactaaagagcttatgcacagcaaaagaaactatcatcagaatgaacaggcaacctacagaatgggagaaaatttttgcaatctacccatctgacaaagggctaatacccagaatctacaaataacttaaacaaatttataagaaaaaaagcaaagaactccatcaaaaagtgggcaaaggatatgaacagacacttctcaaaagaagacatttatgcagccaataaacatatgaaaaaatgctcatttcagtgggattcaatgtgaataaaacaatttaagatattcaaatagccatgaattcaatttatctttttgagactgtaaactgaactcatccgttcccacaatatttatttattttatatcccttgtaaattttggaagatgaggagggatttttgtattctagtatacacttatatggcctttctatataaaaatcatgatttacagcatttataaaaaatcagaaaagaagcccacactatgtagaaaataaatctgataattgcatgtttcataaacggtatgagcgttagaaaagatgaatgacagagctataattcagtgtatcatagtgagtatataaaaatgaaacatatttttatgttttatgatacc

SEQ ID NO: 469376 - DNA, 597 bp, Homo sapiens
gagctataacacaaacaaggctgaaacatgacccttgctcaccatgttgcgggtgatgagaaggagggaaaaaaggggagagaacagctgcagagacagtccagacctagaagtttcttgagagagcccagacctacgagttccctgagccagggctgtgataccctttttggggctgtgcggttcctgaagtctccaagtttccgggctgcccaagtttccgggtgtcaccgcattcccggtgccagctgtggaagctgcttgcagtacacctggtcaagctgtagcctcacaaagagccagtgccgggagctgccagccccgctgcagccagtgtgcctgactgtgtgcggtggctggaccccatgcttccttgcgcacacagccctcgctgctccactagctcttgttcccagtaaaagagatattcaaaattgtaattattcttgaagaattgccttaattattcagttagcacttgtacagatatccttaaaaaaattagtataaactataatgccaacggttttcaaactttttgctcacgaagcacctaaaagaatttgcaaaaccatgtgctcacttgcacattttctg

SEQ ID NO: 469377 - DNA, 718 bp, Homo sapiens
aactgcccaagaccatgggaactcacctcttacatctgcatgacccagattacgtagttaccaccttgttgggaggtagaatctttgagcctcttgtggttctccatatgtttctggatggtccaatcgaagccctgagcactctcttacctgggtcatttctcagagttttttacacagttggtatccttgacagaggcaagagacatagctttctggaggaagaccagattcagataagggatgactctctgggatccagtagcaaacgctcctacacatgtggggaggtcgtgcctatattcaatgggaaggaatttagagttcacctagtagatgggaaaagtaccaaagaagtgcaagtaagcctctggctaagagcaggtcttcctccagggatccagaaaccacacccagcacctcagaagctcggcccagttcagtaccaggattcaacaatgtacgtatttgaataattctgaaatatatttttatttgagtcatccacagagatttccaaccaagtgatttttgtgagaaataggtaccaacttatatttcacacaggttaaaatgtattacccctatacagaattaaatattaaatatggactactttgatctaattcagttccattaaaactgctatttagtcttgtagtaaggcaagatttctaaggtttatttaaatttagaagagcttataagataatttaag

SEQ ID NO: 469378 - DNA, 5373 bp, Homo sapiens
agacactaggctgtctggcagatattatttgcaactgttagcagtgacaaatccatgcaggtctgcagcaacctcaattcctgcctcctgcaaagaaagaatttgacctaggggtaaaaagcagacctgagagagcaagtatcacacggggggtgtacaccccctgcgatattgggagtaaatcaggctctcccccgacccttgatattaggaaaaatatcccaccgtgtgtgtacacctcctactatatggggaatttcttatatacctggagggagacgatgatactaatggcaatgtcacagagggtgtacaccccctttgtgatattgttccgaatctccagaggggaagaaaatgatgttactcccaatatcgcagggggtgtacatccttctgtgatattgtggggagaggatgatattactcccaatatcgcagaagttgtaaaaccccttcgatatttttcctacaatctggggggagaggatgatattactcctaatatcggagaaggtgtacacggccactgtgacattgttcccaatatacacacgttgacagacaatggtattacgcccaatatcgcagaggatcagtgtgagaacagactaatacagaaggtatctgcagacattgatgcatacattaatgtttttattaatggtttcaagaaagaaagaaaggaaaaagaacatgtcactgtttggctggccaaacttgagtaactttaataataattcgttttacaattgcactattagttctttcctatactttaagttttaaaatgcattttggaagctaatggtacggacaatagctttgaaagatttactttttgaattgcaagtacaaaccgacatcctaattcaaagaacttggaaatatgtgtgatcagataagatgagtttttctgacttttcgagactacataaagagcgcatagctaataaggaggactaaaaaagaaaacctagatgaagaggcaagaaaatagatattgtaatatttttgaagacgatcctttaacagtggtaattccaaagttggtaagcaattgaacttcccacaaagcttgcaggtctgaaaatgtagaaaggcaaatccgtaatgtaaggatgttatcttagtcgtaactgtagagagaaaaaggaggtacattttaaattgatttgttttaattgcaaaattgactaagtgtgctctgaatttacaatgattgcctctatctacctcagatggcataggctctgaaaagaaaactaatttagattttgaaaaaataaaattatgcatttacacttcagccatctctctctctatatataatatattatatttatataatttatatattatatattaaattatatattttaaatattgtacatgtataatatataaatagatataatatatttatatatatttaaatttttatattttttatttatattttatatattttatatgtattatatatataatctataaaatatatattatatattatatattctataaatctatattatgttatatattatgtataaatatatattatatattatgtataaatatatattatatattatgtataaatatatattatatattatgtataaatatatattatatattatgtataaatatatattatatattatgtataaatatatattatttattatgtataaatatatattatatattatgtataaatatatattttatatatatttcatatattttaaaatatattttatatattatatatttcatatattttaaaatatattttatatattatatatttcatatattttaaaatatattttatatatattatatacaaatcatatatgtttatataatttatatattttatataaaattatatgtaattatgtatagattatatataaatatagattaaatataaataattatatatattctatatataaattttataaaatatatgaaaataatatatatgtttaatttatgtactttacataaaaattatatataattgtatataattaataatttatatattttatataaaaattatatataattatataaaattatatataattatatgaaaattatatataattatataaaagttatatatatgtttatataatttatatattttatatataaatgttatatatcaatatattatataatatataaataatatataaatatattatataatgtataaatatattatatagtatatagatatattccataatatataaatagatttatttatacataattatatatttatttataagttatatttatatattgatatattatatatgtttatatattatataacatttatatacaaaatatatacattatataaacatatatgatatataatttttatgtaaaatatataaattatataagcatatattatacataatttatatataaatatataggaattttttacaatatataagtatattttatatactatatcaatatataatataaaacatattatatatttatgaaatatataaatatatgttatatattataaaatatattatatatatttatgaaatatataaatatatgttatatattataaaatatatttatatatttatgaaatatataaatatatgttatatattataaaatataaagataaatatataaacataaatatgtaatatgtatagatatgaatattttataaatatatattatatataattatatagtttttatataattatatataatatgtaattatttatagaattatatgcacttatttttgtatgattatatataacctaatatataatattatatattatatataatcataaatacatatagatatatgtgaagcacagtaaagtgaagtataataaaataatgtatgcctgtacattggtggttagcagaagctgagaaaaatacaaatattttcttaactactttgataattatggccatttagatgttttataaataaatacatttctgttttttagaaagtatgctttctttacaataaataacatgtgaaaagtaatgaaaacttgtactgattataaatgtgggaatactcaagtataaattccatgaggacacagactatgcctacctgaccagcaatattttcctggcattctcacaatgaatgagaggatggatatatggatacatttgtctcacaaagctctttgcagtctgactagattagctgtagaaaaagttacagggaaaatttcattttatactttccaaagccatcataagatacattatctaaatatgttatttttaaataattagtttacaatgacagtagcagtagcagttgtattaatactatggcttatagagtaattactgtgagtcttctaagtactttaatatattaattcatttagtattaatgttattaatatctcagttttttgaaagaagaaactcaggtacaggaagataaattatcacacccaaggttaccagaatgaaagattgtgaggcaattatacagaatccatacccttaaccataacactacactacatctcaaaaatcaagtgaggcagtggtaataataccaactcctgaatatcaacacaacaagtaattaagaatatgcatatttaacacttgtacttttatctatctgataatgttagtaaacagtgatttacagtaactcatataaggaaaagacaatacctttcttccttattttatgaggcagatgtttgcaaattattgttgtgaaaactatagatccacagttttcttatattagcaaactagcaagcttgctagatattgtgacttttaatttatacttagaatcatgttgattaaagcttaaatttggcaattagactgaaatgtattcattggaaatgtctatatgtcatttcagtaaaatatatttagatgtgatattaaatacaaatgcatcaagtgtaaacctgtccagctttgtctatatattttatattttgattcctccacaaaagtatctaacacatcaagattccaatgtgtttccaatattgccagtttatactcattcctttagtttaaggcaatgatttgaaaatgtgattctcaatacaccaaatggtttacaagttgtttgatggtttcagtgaaggaagtgatagaataagtattctcatatgcatttcacaaatttgaaatgtaagattaagataattgttaaaaagcttatatgccacctaaaaagctaacaacacataatagatttgggggcaaaaagcaaaacaagattctggaaaaaatagctttacaaaattgcaagcttgactattcaaagcaataacatataatattttagagtaattactatcaaaagttcagcttacaattaaacaaacacattaatatgaagagtatatggtacctcttggaaatatgttttaatataggaaagaaaagtgctttacaacttttcgttctatttattattgagaatgtatgctacaggaacaatattaatattaatattaattcctaataatttttctcaatgtttacagaaccactatgtgtgtagaaaaaaacttaatatagacataaaagatcttacatctaaataccaataaaaaaactgccctatttaaaacataattgttagtcaaaaatatggtctttctttgcagtcagtgtagacaaaaatagtgcaaattgctagtcaaaatatcatggccacatgtgttttttaaatacctgtttgaataagtggatatataacaaattattttctaatttagaatgttctcatggtagtgaaacacatgttcttaagaatgtctgagttaggggatgcaattgtaataatttcttcatgatattgttaatacagtaaagaaaaacaatgcatcaattgggcttttgacagttggtgtttatcaatacatgttctgcatcctgaatggactaaaaacttgagtaaggtagaaatcatggccaaaatatactgacctttaacatgaaagtaaagcattaggttatttaatatgaactaaattccaatgtttcagtctctgaatttaactcctcaccatcaacagattattttcttcacatatatgaagacagtaacagtgatgacatattaacaaaagtctacaaccaaagactaaattaacaaaagaaaaaacttcaaaatctgaagttgattaaaatatacactttaaattcatttttcagtatttctagattctccttatagcttatgagagaaacacgatttttgatttggtgtctgatggagtgccaaagtggtctttagtgagaatttttgccattactttt

SEQ ID NO: 469379 - DNA, 1879 bp, Homo sapiens
taataggaaataagatttaataaacaatttattctgcaacagaaattgtgattaatggtttccaaagacctgtgtaactttgaactagagagagatgatttagggtttctggcagaagaaatttctaaccatcagcgtgttcatgaggaagcagggtataaaagtttgaaaactttgcaccctgatgacgcagtagaaaagaaaaacccattttctggggagaaattcaagccagctgcagaaatttatataaataacaagaagctgaatgttaatcaccaagacaatagggaaagtgtctccagggcatgtcagagatctttgcagcagccctcccattataggcctagaaacctaggaggaaaaaatgattttctgggctggtcccagggcctccttgctgtatgtagcctagggacttggtgccctccttcgcagctgctccagaggccaagggaaagagaatgtggatactatgtgaaagatttgtatggggcagccccggaaagggcatcaatcatattgtaactgtcttattggctagaactcagtgaggtggtcaagactcactgaaagagagtcttcatcaaagagtggcctggttgcatccaaggaggaaagaaaagtatatatacataaaatttatcatatattatatataataatatattataatatatgatatattatattatatatattatatataaatatataatatataatataatatataatatataatatataatatataatataatatatattatgttataacatatattatatattttatgtatatatattataacatatattatatattttatgtatatatataatattataacatatattataaattttatgtatgtatacttttctagatctatatataaatatataatatataatatatgatatataatatatatcatatattatatattatatatttatatgatatataatatattatatatttatatgatatataatatattatatatttatatgatatataatatattatatattatatttatatgatatataatatattatatattatatttatatgatatataatgtatttattattattaaaatatgtattaaaatatatattaaaaataatatatataaatatataaatatatattattattaatatataataatatattaattatatctaatatatattatattataacatatatattttatgtatatattataaagtatattatatattttatgtatatatatattataacatatattataaatgtattatacatattatatataacatatgttataacatatattataaatgtattatatatattatataaaatgttatatataatatattatatatttcatcctcattgaaattagggagtccattccatggaattatagctctttctctgctagcttacaaacacaaatacaaaatgttttttcaataatggtaatgctcccctcaccaatatatacctcagttctactatataaagtttatctattgtactttattatgaaataaaggttacattttatacttctttataaaataaatttattatgaaatatgttttattataaactcatgtcagaattaaacatgataaatctactcaaattttatataaacctaaatgttttaatttttaacatcaaaagggttttttttaaaccgtgtttattccatgtttctattgaatccaggtttcaaccaatcaaatatataagtggaataatttttagtaatgcagccgtaaatattacagtcagaatctctgaaagtttcaatttggttgatagttattacttagtcactgaacacagaatgtgagaggagctt

SEQ ID NO: 469380 - DNA, 684 bp, Homo sapiens
gcaataagatttaagggggtggaatgcagcgagtccgagtgagttgtggttgtccctgccagcaccgaaccagccagctggttccagagctcatgtactctagttcctgcctcattctcttgcatgttcccaccgacgaggagttgagagcagcaggctgagtgaacggtgtaccccggtcatgggtccagcagagggatgcaggtgcccacagcggaagctatgtgcagtacatctggtacagccacagccttgcacagagctgcctgtcccaccgcagcagccagtgtggctggctgtcggcagtggctggaacccatgcttgctcacccacacactttttgacactttgtgcctggctcacccttggcaggcaaagggtgcaatctgccacgtggaaataccattctgtggtctggagggcagtggtctccatcccatagctccattaggtattgctctcatggagactctatgtggggtctccaactccacatttccccttgtcattgccctaggaaagttcctctctggggccttcatttccatggtaggcttctgcctaggcatccaggcttttctacatgtcgtctgaagtctaagtggaagccaccacacttccttcatgcttctattctgagcatctgtagactcaatatcacatggaagccaccaaggcttatg

SEQ ID NO: 469381 - DNA, 766 bp, Homo sapiens
tacaaaaataaaatggactttgcttctctgatccttgattggaatcactcgccacaagtccaaactctcgagtgtggggtctgcccactgagcacagtcagacatgctggctgccacagcggggagggcagctccaagtaccggcatgggcaccagttctctgtgaggctgcggctggacctggcgcactgcaaacagcttccacagctgccaccgggaaacgcagtggtgcccggaagcttagagattccaggaactgcaaggccccaaagaaggagtcacatccctggcttggggagctcccaggtctgggggtccccaaaggattacagctcttctctccttctcttcacccacaatgtgacaataaagggtgtgtttagccctgtttgtgtcacagctcttatagccatgccattcagccagtcccaagtccttgtcctgcatgcaggaagaatgagcattcaggccctccctggtctgaaggtagagcctcaccagggacccgtccccttccacccaaaaccctgtctgcctcctgctgccactcatggtgtccaggctgcattgagagctaatcaaggaacttccaacatttacctggcaggatttcagaattgacatgaatgagggcttgcttttgccttttattttatccctttttgaatgtgaggatctatagtggattttctatgcatatcccatgattatattttgtgtgggtgagggttgaataaattgttaaatgtcataggttatgagaaac

SEQ ID NO: 469382 - DNA, 1778 bp, Homo sapiens
gtaacattcccacgagtcctacttaactctacatcctcatctctcatcagaatggggccgaatccaggaagccaagcagcattgttctgtgggccccacttccacagtgcctcacaatttaagacccactggcttggaattcagctagccaatggcagcaggttgaagtccacctttgatggatccaatttcccaggggcaaccaccaagtctgtggtttggtcaactcagccactccagcctgctggctttggagaatacagccatctcctacatgtgcatgtgggccagcaacaggtcagtccccttctgggacaaagcttccagaggaaggagctggttgacatctttgctgttctgaaaccttcattcgtggtacctccaggtatgggagaaactgaggcaactggagtctggagcaaatccccagagaactgcagcagccctatgagagctgagtttacagggcaatcaactatcccacaatttaaagaaagggaagcacctccaaagcaacaggactgcaagcgcttaattacctagggcggttttagctggacaacaagaagatgatttagatagattaaatagtttgttgttaatgtatagaaatgctacggatttttagcatgtaagaactatgtggatacctgaaaaaaaaattgaaactgttcctcagagaagacggcttaggagaaaataaccatgtgtactttatactataagagcaaaagaggtatgtctttatcggcagcatgaaaatgaactaatacatacagttataatttttataattacccttatgtggggtggtgaagttttttatttgaagattaaaactgagataagacttgattttatagtttccataatataaaaattttatttttcaagtatctactttttcacaagtaatgaaccttttaagattatgatcagaaagtattactaaagtattactaaaataatttaatggcacagaaatacattaatccatagtaagtttaaaataaccactttctcatgtaagataacatatatcaatgtggtggatttaatataaatacacagaataatataatcataataatgaattccaatccactatcatttagcatgaaagtgcttgccaggtagctctattttcccctcagtataaattcatgcatcacaacgtcatgatatttatagtgcaattttgcctacactttgtgcaaagcaaggttttacatgatatcaatccatcaagattcaatatcattatggaatgtcagcttaaagtccctgaacataattttaaaactatgcactccctctgagcagtagtacaaaacagaaaaaaatctcaaatggcatgtaagctattgattgatattacagaaagaaaacaaggctttccttattggtatataaaatatcaatgaatagaattgcggagctgaattgtgtcaaagtaacaggtagctatacatttgctaaaagtaatacatttggggaaaacataatactgttttttaaacggtcataagatttatctcaccattactgcaacaagcacccatgacaaaaattgtcttactctccagacagaagagaaagaccaattccagaccacagggctttcatgttataagcaaaaggaaattaaatttgttacaaaaggaaaatattttaaataaaattatgattaaaataatgaaaataaaacactctgcttttatatagtaactatatttccccaaataattacattgaaaaacacttctgaaagctattta

SEQ ID NO: 469383 - DNA, 733 bp, Homo sapiens
cccctttgaagtcgctttcaaccaatgactgctgaaagtggctatacatacgatttagctcctaaaagttatgtttggcctgtcaagactaagagagtgcccacaaatagtgacagacactggaggctggagatagagtcattactcaaaggacagaccatgcctgtaattagttcgctatccttgcatctcatcatggtcctattcgtggaaaacagtgccatgatgagcatcacaatcctatgtgacagacgtgagaacaacagttgggtgaatgcctgcatgagcatgagtgggccacatatgcaattagcagcttacttcctatatttttttcttcttagtggaagagaggccatgatcaatttagtatcttgtcctagatcagagattctggggagccatcttccaatcagtttaaagcttgaggaaaaaaaaaaaaagattgactctccctctagtaggagaaaactcttcctgcctgactgctttgaagtggaacatttatcttttcttgcctttggactcaagtagaaacacaagctcttcttgggtctagaactgaacttgctggctttcagactggaacttacacccttggctaaacagactttttctggaactaaagccacagtatgttcctggttccaaggatttcagactcaactgaagacaccagcatctcctctgggtcttttgaatacagatcttgtgattttcagcctacattatt

SEQ ID NO: 469384 - DNA, 483 bp, Homo sapiens
taaagcaaggttggagagtacccaaaccatgaaatttctgtcatcctcagagatctattgccctcccggcacatcaatgtatttctcctctctgggcaggtcatctctaaaaggcagcagccccagtcaggggcttatagataaaactcccatctccctgggatggagcacatggaggaaggggtggctatggtccagcttcagcagacttcaacgttcctgcctgccagctctgaagagagcagcacatctcccagcacagcgctcaagctctgctaagggacagactgcctcctcaagtgggtccctgacccctgtgcttcctgatggggagatacatcccagcaggggtcgacagacacctcacacaggagagctctggctggcatctggtgggtgcccctctgggacaaagcttccagaagaagcagcaggcagcaatctttgctgttctacagcctccgctagtgatacctaggcaaa

SEQ ID NO: 469385 - DNA, 666 bp, Homo sapiens
ggacatccttgaaggacagtagtgaagaaaaatcctgtcagtggagaaggggcgccagtgaaggcagaaagcctcaaatgcatggtgtttatgttgggagatacacggtgttgctaaggctgcagcatcaagaaaaatgggaaataaagctctggggccttggggcagctgcaggtctgttggattttgctggaggtccactctggatcctgtttgcctgggtatcatcagcagaggctgtggaacagcaaatattgcagaacagcaaatattgctgtctgatccttcctctggaagcttcatcccggaagggcacctgcgtgtatgaggtgtcagtcagcccctactgggaggtctatgccctgcccccagaggtggaatctacagaggcagcaggccttgctgagctccggtgggctccacccagttcgagcttccatggctgcttcgtttacctactcaagcctcagcaatatcagacgcccctccccccaccaggctgcatcctcacaggtcaatctcagactgctgtgctagtagtgctcaaggctccgtgggcatgggacccgctgagccaggcacgggatgtaatctcctggtgtgccatttgctaagaccagtggaaaagcacagcatttgggtgagagtgtcccgtttttccaggta

SEQ ID NO: 469386 - DNA, 730 bp, Homo sapiens
aattctgatttatagcccatcagtcaaaagcacagggagtctgactgccaatgtccttcctgcaagcctgcactaccggcagtctctcttgtcctctgccctgcccttattccattcctccagcagcgaaaggaggactgagaaaaagaggatatgagccaacatttcataatgcccccactgatgatgatcggaagagctacagtcaacaaatactcatgctgtttattcttggatttcagttcctggttccactgttagcaactgtgaaatacagcagttatccttatctgctggggatgaattctaagactcctaatggatgcgagaaacagccaataaataacatgtttctgcaaatttgttggtccatccaagaaggcaatgtggaccagagccacctcagtcaacacacagacctgcaggaaaaagccaagctgggccaatcatcacagtctcaggtggactcacccagacaagcctgaaaaagatcagacctgccttatccaacacacaacagcaataatactttttttgttgtttcatgacagtaagattgtgctagattaagtctttttagaatttaactttttttacaatagtttattgtcatgatacgcacagaatcagatgcacatgcttagtcaattttatcatttcagatttttttctttttaatacaagattcttttcaagtagtatcatttttgcaggctattaatgacaacaa

SEQ ID NO: 469387 - DNA, 912 bp, Homo sapiens
actaggaagcagctacctacatcaaagctgggtgaattaaacagaagggagagtttgaatagaatatgggccaatacattgatactgcatataaaataattaaaagtggaacatatcatcaggcagtatacaaatctttcgggatacatagcattaggtatgggcataagctacataagaacttaggaagtacagtggtggctgccacaaagacgccagatgcagcaggggaggcctggctggggctgagagctacacgaagcccgtgggagccagaacaggtaggggccccaccctcttctgagttggtggggtgcccagccatagttgtggacctggacatccctgtgctctcagggctcaggaaacccctggacactgcaggcgtgggagtgcctgcttccgctgcctggcctctccctgctcctggtgtctgctctgattttggtgcaaagtttgggccgagcctgggcgctatcacgaccccttcgggtgtgtgtgcactcacggcggtgctgacatgccagccccctgccacctcatccctctccggaatttgggtgccaacgagcatgcgagggaggtcgagggggtgctgaggtctgcacagaagaaaggatgacctgcctgccaataggagctacccactctgggtctcctctctgctgagaactggacacttattgggatgacctgactcgtatttgaagactttccctacaacgaggcactcagctgtgattacttgtgaagaggccaatttgcaaatattttgtcccattctgtagtttgtttgtttactctgttgattgtttatttttctgtgcaaaaactttttagtttaattatgtatcatttgtttattgttgtttttgttgtgcttgcttgtgggacctttgtcatgaattctgc

SEQ ID NO: 469388 - DNA, 634 bp, Homo sapiens
taaaggatttacatcaatagagccatgtacaaatgaaagaatatgattaattgttgctgtgatcagggtattaacagttttagtagagtattttatggatcgtgcattaaagtgcaattgaagaagtgtgggaacagactaatacagaaaattggtaccagaaaagtgggcattgctataaagatacctgaaaacgtggaagtaattttggaactggatttcagaggatgtgtggaaacacctgaatgtccaggcagaagtcatctccagggatggagcccttttggagaaccagtactaggacagtgtgaaggggaaatgtgggtttggagccctcacacagaggcactacctaatggagctttgagaagaaggccactgactttcagaccccagaatggtaaatccaccaacagttttcacagtgtgcctggaaaaagctataggttaaaatgattcctaggtattttatattctttgtaactattatacatggatgatttattgatttctctttcagattgttcaccgttggcatatagaaatgctactgattttttatattttaatttattgcttttatttttaatgaatctattatgggtttttgaattgtggttatcatgaggcttat

SEQ ID NO: 469389 - DNA, 1129 bp, Homo sapiens
taagtgggagttaagttctgaggatgcaaaagcataagaatgatataatggactttggagacctgctgggggatgttgagagggagaaggtgtttgcttcctcttcgccttcagccataatttgggttcgtggtctcactgacttcaagaatgaagccacggaccctcgcggttggtcaaatgattgtgaccaaaattgtgatagtgctgtggacagtgaagtccagactgatgagttcttagatgggaatgaggaattctttggcaactggaacaaaggacaggaattcaagcatactgtagaaattaatttaagtaaagtggagccaagtgctaatagccaagacaatgaggaaaaggatttaaaggtgtgcagaattcatgagtcgaggctagggagccttcaactagattttacaagatgtatggaaagcctgggtgtccagacagaagcctgctacggggtagagccctcatggagaaccaccactagggcacagtggagaggaaatgtgggattggatcctccacacagagtccccactgggtcgctgcctagtggagctgttagaagaggaccaccattctccagattccagaatggtagatccaccaacagattataccatgtgcctcgaaaagtcacagtcactcaatgccagcctgtgagaacagcctcagaggctgaagcctgcaaagccacaggagtggagctactcatggctttggaagcccacccctcagaccagtgtaccctgaatgttggacatggagtcaagaaagattattttggagctttcagatttaataattgccattctggactttgggggttctgcatagggcctgtagcccctttcttgtggcaaattagtccattgtgtaatgagagtctttacctgatgcttgtacccccattgaatcttggaagaaggtctgatgcagaccgtaatgcaatggttgatgacttcagatacgtgcattacactttctctgctgaactattatcaagtgaatttctcatggcttctaacttaggacagaactttagaaataaatgactgtttagtttagagttgtactcattttctattgctgttctaacaaattaccaccaacttcagggctt

SEQ ID NO: 469390 - DNA, 5887 bp, Homo sapiens
ctaacaataactttacctcttcagtcagcttttagtaaatgcttccagcagggtactcacctttcgggtctctaaggtcctctctggcccaaggcaggtccagaaatgctgtcctagagcctagacctggatttggggatcccaattgcctgcttgaaagaatccatctccataacataaaagtacaaggtgaatcagcaagtgctgatagagaagctgcagcaagttattcagaagatccagataaggtgattgagaaaagtggctacaccaaaaaactaacttttaatgtgattgaaacagcttcatattggaagattggcttcaacaagaacaatcataaccagatgcctaaaaagacagacaaaattgagaaggaaactgagtataaaaatctctggtcatatgaaactgttgatcccaaactgccaaaatctgaacttctgaattttctaatgatttattgttgtctttgttaagctaacttgacgcccactttaccatacttccttctattaaaaagatacacttctaaaataattttttgtttaggaaacataattgtatccatttacaactccattaaagctaatgatgaaaaaaagttgtcatattctgtgtttttattgtttttagacttttctaaattcattacttggataaaaaacaagcactcatttatatcatttgaatcctttgttttcaaagggcttgtattaaccttcgacatccatgcataattaataagtattttttcttgtcctcgttaaggtaaactcctggctcactttttagaaaaatgtattattttacttttattattaaggtacaatatttgaagaaatatatgtgggttcatgtttcgcatgtacatgcatacatatatttatgcatgtacattaatataaatgattacatagacatttatttatgaagaagtaaatcactgatttccacaccaaccagaataacacatttgaaagtctgtctcttatatcacacaaaagtaatcttatagaattataattctacagttgctaaaatttaattccctatccattttacttaaaattcaacaataaatattttcaacatcattatataatattataaatattctattttctttaagcatatgcaatagcttatttagaaaactgcatttttagtgtgcttctatttattcaacattatatctacaaataaaacaattacatttcaaatttttgcatttttcaacttttattataagatatgctctctagaaaagattgttttattttcattgtgatatttagtaagtgcatagtttaacacattttaacaacttgaagacaaagaagataataaatataataaatgcatggttttcaataggcatatattatatttactatatatacgttttaagattacacatgctcatcaggcatatgcaagtgaaaatatatgtgtatatcttatttattatatttttatatattgtatatgcatatattaatcttataccaaaaccgaaaatgcctccattttaaatgattatatcataatttcaatatagcatatttcatatgacagaaataatgagtaccactgcagtcaactgagacattaataaccatttaaataagaaaaagatacttggataatttaaagttgcctttaataaataattttgggctgataaagtaatataaacaattgttacaaatgtgaatagtatcaaaattattacaatacaaaatactaaattatataggatgcagtcaaagctgtgctttaaggtaaatttgccatccctttctgtctcttgataaaacatatttatagtttatttattttcttgcaacaactctcattacatttacacaatataaattttattccctcgctattgttttaatggatcgtatttctcctttcttatactctactatttattatttttaaatttgtaaaggaaagacagtgccttactcattcgattatttttggaatttaattaacaaggaaaatccctggaatgactatagcaattcttggaaaatgttaagctgttaataaagatctgctatcatcaatcttgaggaaaataagagttacaaactatatttatacaaactatatttataaatacaaactatatttagctacttacaatgctgattgtgtccttaatagcttatgtcaattgtttcacatgtataccctgtaatcttatctatatcctcctgtaattatgaatgttttgccttcgtgaattacaacacatttaacttaatgcagaactaaataactatcttaaatgtttagcatcacaactctgtagattatatactattgagtttataatatgattatatatgcttacttattttagggaaccaactgggcttaatcccgtgtaagtaacatgatttttctgttcatatgttttcagtgttttaaaatttatatttgtattcacaatcactgaggttctgttttgaaattagcctcttgtgagaatcatgtcttttatagagaaaaatttttgttcaaaccagatctttttacagaataaggtaggtaatgatgacgacaatgactatatgtacttatcgtgttgctctgatctgttactcagaattggtaattatgtgtaatttagtacttagtactctaacatacatctttgttattttctccatatcattttactttatttctactgaccccatgatattagaggagcatctcatatttttcctagatattgcacatttgagtttccactgaaacaaattactacttacattcttcaatggagataaattttactgcaaataattgtaattcttctttatcttatccaaattctctatatcccaaacttttattgttgtttgtcttttatattcctttttttgctatagaaaactcaggtattattccaaatatatgcttcagtgatgtatgcataaaaaagagcttgtgcatggacataatctttttcttggctagccaaagaagtagccaaatagacatagtttgtaaaataatcaaaattctatatttctcagtcatatacaataaagtggtggctacttagtaattcagatgagctaaactgatgtatgcctttttatcttctgttccctgataataagtacaaccttatctcctaatgatatcaatcttgtcttatgaagcaatccagatttcacagccattcctagactcatttcatgtaagcctctctctgtacttcctatttcataatgaatctgtataatcatgaaacatcttattatgtgtatatgtaaagggtagttttaatttgattgtatcagtggtaaggcattccctcttagaaccatctcattatcttatttttaagaatgatacccagtcaattatttatctttgagaagttttttagaaaaaaaaatcagtcccttttagaggtggagctatgtagccacctatttaagtctccttaaatgacatttttatttttaatttacaactttccatatattttgattgttctctattttctgcacattgacagtgtacaatacacatatagcactattaggaaaaaacaaatgtgtaacatctacacttattcatatagcaatgtattataaatactgtgcatgacaaaatatttgaagttgtaagtatttcatgatattaactttttactactaattaatggtaagcctcatagcctttctgaatgtacagtttaatagtttgaagaaagctacaattaattcttattataaaaaagcctgagttcatgaaaaaatatcaattatatcatgtgtatttttatgaatgtgttgaaataagaggaacgagaagcagtaaagattttcatcaggacttttatctttcaaataaaaggcgttatttgagttatagacaagaaaaacaaaattttaaaatatgcacttacatgattttatcaacattttaaaataaaaattgcaacagaaagattccgaacacattcattgtgataatagtctactaaaaattaattcataaaatttaacttctcttaatgtgattgtgtttttaatggtaggtagaacatgccaaccaacattgtcatataagtttatttgaaagctcgattttctgcacagtgacaatgtacagtcattcaacaatattttggagaagtacaaagggtacatcaattcttttttctcttgggaagttcagttcacatactctcttatattagcagggaaacctcctggataagagagattcaaaatgtttgttggttattattgctttgttttcttaaataaaaacttgctgtgatcctttgattaagtaatgtttccattcaaaggaaaagaaaatggtgtcagggtgagaagaagattaaaaatggaaacctcaagacagctttctccagtgctcttgtagaaataaaggttttccaacatattttgtctgtttattgattatcatttcatctggagcttgtgtccagttgatttgttccaaaaattttctccacgttttctttgccttgcttgtttttggacttgtcttctatatttacctgcagagttttctgctagtttatctttgcaactctttgagatgtttcttatatcctgggttttcctgcatttggctttactctgcctactaaaatagtgaattccctgggaagacttatttttgtgtgtgttcactgaaccacatatgtattttttctgtgtctagagagaaataattgcagtttaatatttgctgagcatcataaggcagacatcctttttcactctttttacaacatttaaaatgacagctggtatcgaatgtgacataaaagattctctttgtagagttatatattggtaaaaattaccttgttagaagtcaaagggtgctcacagattcctatttatatactgtttcaattcccaatcaatttccacagccattatttcatttcctcatcatagtaactatgttaagttggtgaagttaggcgtgataacattatgtatgttttagagacgagaaaatcaagtcagggaacaataaaaaaaaatctgctgagagtctgagcaaggtaatgccaaagtttaccttacgatatatgtgtctactttctaagaatactggtatggttttaggcccctttacaaacttcatagtaataaccaataaaagtttgaacagtatttgaaaatgtatatgatttaaattttatttagaaggtagttgtaagctactctatttgaaataaatttcttcctttaaaaacatattgaagcagaaataataaaagcaatattaaagaaggatgtaaattttatgcccagtttcccagctattcgtgtaaaacaaccaccaaatatatcactgaatctacaagttttccatctatttgtgcaaaacaatcaactgccagatttatcactgaatataattgacgataaactgaatgattatcagggtcataagtgaaagttttaataaattattttgcactgtttctcttttatttttccaaaaaaattgaagtttctttttgttgttcttttgaacaacataaagtatttcaactgaaacacaagttttttcaagtggtgaagacaggaatgctctattctggtcaacttttatgtacccaaatacatttctgaaatatactactaccaccttaattatagaaagacaaaatactttgaatttgaatatttattacttttttctactaacacaatttgcaattaaaaataataattatatattgacactcccaattacaatgcatagtacagagaaaatgctaatagatgttcatgagtgaacacaaattgaggatggacaagaatcaaaacagtcagtagcatatatgctttgt

SEQ ID NO: 469391 - DNA, 799 bp, Homo sapiens
ctctggaggaaacaagaggtgttgagcgactgaatggccacatcctctggcatacagcagacaggaagatgtatgaaaacgcctgggtgcccagtcagacgtttgctgcaggggcagggccctcgtggataacctttgctagcgcagtgtggaagggaaaagtggggttggaggctccacacagcgtctctactggggcactgcctacgggagctgtgagaagagggccattatcctccagaccccagaatggtagatccactgagcttgcaccatgctcctggaaaagctgcagacactcaatgccagcccgtgaaatcagccaggagggaggctgtactctggaaagccacaggggcagagatggccgaagaccatgggaacctaccttttgcatcagcgtgacctggatgcaatgggctgacccatatgtcacacaggtgtctaagctttctgctcagccccagagtgtggtgggtgcaatatgggaaaatctggactgggtagccctgcctacaggtcccctgatggcaggcacagtttctagcatgcagctgcaccggaaggtggcaaaacatctagagatttaaacatggtttggtatctggaagagggcatggtacatgtttatatatgcatttaaatttatttctctgtagaaacagatgaaaatatttatttttggtaaattaaatatgaaaatgaaattacctgtttgataataaaagcatcttattctcttctagatcatactatattgaaatattatgtatacttaatatcacaggtgttgtgttat

SEQ ID NO: 469392 - DNA, 929 bp, Homo sapiens
ggcggcagaaatttctgcagacttaaacatccctgtatgacagctatgaagagagcagtggttctcccaccacagtgtctgagctctgagaacggacagaccacctcctcaagggggtccctgactcccgtgtagcctaacttggagacacctcccagtaggggccgactgacacctcatacagctgggtgcccctctgagacgaagcttccagaggaaagatcaggcagcaatatttgctcttctgcaatatttgctgttatgcagcccccgctggtgatacccaggcaaacagggtctggagtggacctccagcaaactccaacagacctgcagctgagggacatgactgttagaaagaaaactaataaacagaaaggaatagcatcaacatacacaaaaaggacatccacaccaaaaccccatctgtaggtcaccatcatcaaaggccaaaggtagataaaaccacaaagatggggagaaaccagagcagaaaagctgaaaattctaataaccagagcaccccttctcctccgaaggatcgcagctcctcgccagcaacagaacaaagcagggcagagaatgactttgatgagttgacagaagtaggcttcagaaagtcagtaataacaaacttctccgagctaaaggaggatgttcaaacccatcacaaggaagctaaaaaccttgaaaaaagattagatgaatggctaactagaataaacagtgtagagaagaccttaaatgacctgatggagccgaaaaccatggcacaagaactacgtgatgcatgcacaagcttcaatagccaacccaatcaagtggaagaaagggtatcagtgattgaagatcaaattaatgaaatgaagggagaagagaagtttagagtaaaaagagtaaaaagaaaaaaaaaaagaatctaagaaata

SEQ ID NO: 469393 - DNA, 600 bp, Homo sapiens
gagggtccgcggcttcattcttgaagtcagtgagaccaagaaaccaccaattccggacacaatgggtccaccaatgctgtctggcagccagggattagagtcaaaaaccttagaaatccacctgatattctattctattgtagcaaagctggcactcaaaccacaggacgaatccttcctgttcttctctcttctttctacaagtaaggagcctcgcttcatggctgtcaccattatcagcccatggagagttctgtcatttcactgtcaatcttcgcttaaggtccatgggctcttcagtcagtttttggtgaatgttgtcaggcctaggactcattcttcaggtcagtgggctcccttctggcccagggcaggcccagaaatgctgcgcaagagcctaggtgtggaatttatgaccccaagggcctacttgctgttctacctcactatagctgagctggtacctgaagtaccagtgaaatctcaggatttcactcaaggcccatggcatactacctggatattgctgttggttattctggtcccaaggtcttcttagtcagcaagtgatgaatcctgcctggactgggtctttccctt

SEQ ID NO: 469394 - DNA, 1096 bp, Homo sapiens
tgccctgaaagccctgatttgagcactgcgcaacctacgccccggtgtgtgatgttccccttcctgtgtccatgtgttctcattgttcaattcccacctatgagtgagaacatgcggtgcagcctatcattgttggacattcggaggttgtatggaaatgcctggatgcccaggcagaagtttgctacaggagagggcgcttcatggagagctcctgctagggtagtgcagaaggaaaatgttggatcagagccccaacacagagtctctactggggtactgcctagtggagctgtgagaagagggccactgtcctccagaccccagaatgatggatcaaccaacagcttgtactgtgtgcctggaaaagctgcagacactcaacaccagcccatgaaagcagccatgagggaggctgtatcctgcaaagccacaggggtggagatgcccaagaccatgggaacccaccacttgtatcagcgtgacctagatgtaagacatagagtcaaaggagaaaaaaagccagctctacccatctaagttatatcacttctttgttcatagctctataatggtatccaatcacactcaaagtggaagacaaaatttttatattgcctctcatcactgatctcatctcctgtctctgaatcccttggttattcttctcaagctccccttccgctgaaagccacttccacttcttaataaaatcctccacattcatcacctttcaaactgttcatgtaacctgattcttcctggacactggacaagaattcgggatgcactggaaaaataaaaagggtatgttaaatgaaaaaggcattataatagaataaaaatgcgcattgtgataatttagcaatgaatgtatacgcataaaaatactaagcaaatgcacacaaaataaaatattagctttagacaggtggaataaattatttttttctgttttctaacattctgtaatgtctacatttttttcaaatagaaaattataattctatttgaccttggttgtttaaagactcaatactaactcaatattaccctaaaaatattaaacttcttattacgtcagtcaagttatttc

SEQ ID NO: 469395 - DNA, 1080 bp, Homo sapiens
agccatgctaacgagtgaagtgggggcggggctgggccagcccaggagccatgagcctgagtgaggcagcagaactgaaggagctaaagcaggcacccccgcccccgcctacctggcaaagttgcgagcagccggaaggaaagagctgtagtatataccaccacccccctagtataccaccacccctcaacccggcccccaccgctaacaaagctgccggctgcaggaatgagagagtggtagaacgacacccccgtctcactccttgggactcctcagttgctggcggctccaagttttcaggagccacggtgttcccctcttccagatgctagtgccaacagtggaagcagcttgcgatatgcctagtccacctacagcctcttaccgagctggcacctgtatcagcgcctggagctgccggctccgccggaggcagccggtgcactgggctgtgcgcagtggctggactttgcactcacccactcacacacccctcactgctccacgcctggctcagcctccaccgaaacgggatcccggccagaagcacgagcctacctacctgcatatggccactttcctccatcttcaaagccagcaagagctgtgctcctatggttttgggcggctccacccctgtggctttgcagagtacagtgagacagacaggtgggagggggtccctggagaaactccaaccagcctgcccactgaggtggagcctcgggaagttcactatgtttgtagcagagaggagcctgacccctcctcttctgtgtggaaccttggattcaatcagcccgtgagcagtagctcctcgcttctctcccctgtctgctgggaattggacacatggcccaaggtggccaggatggctgactggtgttttcccagcagctggagcctttcccttccccggtaattgtgtcttcatactattagacactcccctcaaatgtatcctccaaactagagttactttctcaatcattaaactggttggcttagtttaggatcaggggaagggaactcagaagcccaacatattggcaatagggtaaagtttttttgccagtc

SEQ ID NO: 469396 - DNA, 702 bp, Homo sapiens
gcgtaggcaagatgttacaagcattgataatcactgtcttttggaagattggtacagacaaaatcaagagggtacacaaaacacaaggatgtggccccagcgcacgcctgatgccaggttccttgcaacatagtgctgaaagtgggtcctcttgtccacactacccaggaagatctgctagtacttatttcgaaggcgaagttgagagcccctgggtggggaaatatctgatgacattggccaggttaccacgccagaaggacaggactctctcctccttgggaatacagaccacacagtctataatgtgcttgtactgcttatctgtggtgcaaactcggtgtgggccacgcggcaatgaccttgtgggggttcctgcgacccctgaagccacagaagtcaccactcacggctctctacctcttgtcctgcgtctaggaaaaatgagtttgcacgaacaaattgaaggatggcgaacatggaggattttattgaactatgaaagtggctctccgtgggcaggggagctaaaaaggcgacgggacaggcagtcatatttttgaaaactatttgtattaatatcattaagatttttagaatgtttctgaagtaattttttcttattttaaaaataaatataaagacactattaaaatatttcactactcaaatatttacttcaaaacacaagcatcatatgtt

SEQ ID NO: 469397 - DNA, 3744 bp, Homo sapiens
aagatattggggtacatcataaagaaattaatcaatcactgaatatgggctgttgtggtaatgtgatacttttgctgattatcttatttaggatgggaactgcagtttcaggggctcctatttgggcttcccaccataatagttattacctcatagaccaagaacttattgtgaaggttgcactagcaatcaaccccagttggaacttttggcatggatatgatttaacagtgtctcttccataccaactgtataaagctaactgtatggaaattctcctagagtactggaagaaattctgccctatgggcaactactctccatggcatttctatgcaacttgtgacagcagtttttctagactgtttttgcaagaatatttgcataacttccagagtacaaccaaaatgagtgtgggaaaggtaatataccagaattcaatcatgaaatttatgattggtgacctgaaaggaatataattgctcctttctaaacttgacagagtctcatatcatattttaaagtttaacaatgtgtaatatcttactagaaccaaaaaatacgctatcagggtggtttgaaatgcagattgctttaaaaattgtgctaaaatggcttattttctgcagactacttagcaatatgagttcaaagatcactagttgaatagcccataaaaagtccattatgtcattttatatacatctagctgccaagcactcaagatcataataagaaattaaatagttcaaagaagacaaagttgtgaaagttaagtggtgagacaatgcaatgttctactgatagacattatctcaatagtttataaagtgttgataactctttaccaacctgacttaagcatagtcttgccccattgcctaagcaatacattgtatagttcactcagatagtttctgtatccataatttaaaggtgttctatgcctctcttctaaattctccttctattaaatataatcattgcagattttgacaatagtatccactaattgccattataatacaataaagaagataagtgcttccattccccatgctatgccaaagccctttgcaggacctagggaaaaataaaagttactctccttcagacacattatttacttttcgtcaacctctaaaattctccatgagaacacctgggcactgcatctgattttgcagtgttccttttcttttccaaaccttttcaagcaattaatttgaaagctcccagaaaagaggaaagcttctttttttaaaaaaaaaatataaaccatgaagaataactggtttcctggtcatcattttcattcccattacaaatccatcagattcattttacactctgattccctagtggcctttcatcctgtttatcaatgttttccaatccttagatcataggaatatcacatatacttatgagtaatagagattttcaggcccatcctcacagtggcttaattatagttccgtatgtttttgcacacattttagtgtataattttattagaaatattttactactaaagcaatgatgttttttaaaatgtttttgtaaaccaattctccaagaggaaggaaaggagaagaagaaggaattgaaaaaaaagaaagaaaaaaggaaggaaggaaggaggcgggttgggagggagggagggaaaccttgatttgtagtatttgccaatttccatgatgtaaatactctcatcatggccaatatccagcctaataagttactgtccttggagacagtgttgggaagagatgcacacaataagatcttgtgaactggtgggaaccagctccaacatatcactgtaccttggggattccacttctactaaattgcttgtaagtttcctactcatatgtattatttactgctagtacctgtgctttagttgctccctctctctgatatacagaactttattttctgtctgcctgatcaattaatttctcctggagatactcacaatccatccgggaagctattgttcaagtgacagcctcagatttttgtagttagggataaatgtttctttcatagcacttaccacattatattgcaaatatctgtttaaatgtctattttaatcttaaactgagtcaccaagaattatatttcattcatcttacattttaccagagcatagaaaaatgtgggacctaaatgtttatatgtgaaactcataatttatgataatgaattaatgtaatactgagccagcaatttcaatattgatttaaaattgcaagatctgatatatatgaaagagaagttgcagtagggaggtgataaggtgattaatggattttaaaaggatgaataattgaaaaaatatagagatagaactaaaagaaatataagcaatgtcttgttcatagtgtcaactggtgaatttccaatgtagaaaaatcactggatagttttatgaacagtataattgtattttccacaattaaaacatttattaatacagttgtacatatttatggggtacgtgtgacacaagcatacaatgtataatgatcaaatctgataactgaactaaccatcagttcaaacacttatcatttctttgtgttggcaatattccaaacctattattccagttattttgaaatttacaataaatgattgttaactatagatgcgctattgtgttaccaaacactagatcttattattgctatgcaaatgtatttttctaccaattagtgaaacccactttacccttccaaccctctggtaaccatcatgctattcactgcctccatgagatcaatttctttttttagttcccacatatgagaagatgcaacacttgtctttctgtgcctggtttattacacttaacataatatcctccagttccatccatgttattgcaaatgacagaatttcattcattttgatggcaaaataatattccatcgtgtatacacaccacattttcttgatccatttacttatgtgaatatgtgaatatgagctagaactcatatcccatatctgcaataaacatgagaggccagatagttcttcaataggcaaattttaatatccctttatttgggatattgtgtgattatattttaatcttgctaaccacttttataattataccagtcaagaataatgaggtaatacaattttaagttttaaagcataagcctgagatcagggagatattaatcccatgtgattttactcaaagccagaacaaatagccaatactaaaatctaaatgtgaaacagtacaaaaactatcagaaaaatatcattattgaatacattttatagtaaaatcccttcagtgtccgttttttagcttgtgtttcattttaacttaaatgcctatattttcctatgtaatattttaaatgtttcttgtctttaaattcaacctttagaatagaaaagttacttaatagaagcttatctttgatacatttagaaagaagctttaaaattaacttctgctcaatatagtgttcacctctaggagcaacttcataaagcaacagcctgagcattgccaaatcacaggagcaatgaatagagttatccgggccactcacaatgagaaatgtgatggaagaactgaggaatgaagcacatttaaaacatactttcaactttcaggagacatcaacacagagaaaaagttcagaataaactgggtggatatgagaaggtatcttttgagaacataaatacgttttactttcc

SEQ ID NO: 469398 - DNA, 623 bp, Homo sapiens
agaagtttgagcagtggggcacagaagaaacgagccacacccccatcgcaagtgtccagaaaagcatggtactcaggcaaaatactgcagtgattaagaaggcaaaatctgaagttcacaggaaacagtcaaacttctatgcaaaaggtagggtttctcagcttcacttgcccctttatccttgggaacatcctacccctccagggacagagaagatacaactgttcccctacttgtctcaacctttggggaatctgcctttccagctgatggcaaagaatccttccttcctgacagaaggaagctgtgtcaggtggccactggttcagcagattaatatccaaaggctgggcattgaacaaagacaggggttgacttttgtacatacagctaaagagggttggccatctagtgactcgaaacccgcagggcaggtaagcgagcttacagaagcagaacaaaggcagttaatcatactgtgacaggttttgcaacaggctttgcaacatgagcttatctcacttaaacatgtcttgtgactttgccatgctacagaaagaaaaacaggaacttataaaaacttttacaaacttgcagaaacagttacaaaagtagttatgaga

SEQ ID NO: 469399 - DNA, 1392 bp, Homo sapiens
ctctctctctctctctctctcttcctattggctctgtcactctggagaatcctaatgcatagtgcccttgtagcaaacaggcagccaatttgtgaaagcaaaggaaatgccttgaaggaaatttacagtgcaactcctgtgaattcaagaatgataagaaggcaaaatagccttattgctaacatgggaaaacaatttagtggaacaatagaagataaaaccagccaaaacatttccttaagccacagtctactccagattgaggatctaactatcttcagttctatgaaggctgagagaggtgaagaaactgctaaagaaaagtttaaagctattaatagcagagattgtttcatgagatttaagaaaagaagttgtcatcataacaaaaaagtgcaaggggaagcaacaagtgatcatgtagaagctgcagcaagaataaaaaatctgaatggatgtgtgatgaagatttttttccacttttgggaacttaagaatacaatagctacgtaaacattcatgtacaagttttgtgtagccaattatttttcctttgattagtgaatgcttaagagtagaattatagggtcatgtgtgacttttctaaattatttggtaagatctgtctgtcatatgttgtctctgaaatctctgtctattccatttttgtgcatctagtgtttggcagagtttttcttgaatgccagaagcagagagagaaagaaggaagggaggtggtggtagaagagggaaggtacaaatataaaataaaagtaagagagagaaaaagaaaaggaaaacccttctcccattctttatatagtaacccttaacattaatgcaatattacactatgaatgtctttggctttgatacattaaaataggagttcctcttccctattgaatgagttaggaatagttgtaggaattacccttatagtgaaagagggatttaaaaaactttcattaatgcttaatacaagacaagaatgtaatatttctctgaatgaatttgggcaaaaaggcatttgaaaagaaattgatttcaaaagaaacaaaccctactgatatgtgttttcattaatagcaatattttcaaatattataacattgtaagtttataaattgtgatattaaaattattcaagagatcataatttctttgtcattagattcagctatactgtgtatgcctatagtaggtataaaatgatgaataattccctttatcttattcatatatattgacttttctttcccaaaaacctgaaaccacaagaaactggatttcaatattaatttctacttaaagtagtaaaaatctataatttattctgatattaggattagattaggcaaacatataaagaaaagcacttcagaataataa

SEQ ID NO: 469400 - DNA, 542 bp, Homo sapiens
ggattcactcgccacttcggttcttgtttggaaatgggaacttatgtttaaaagggaagcagagcataaaagtttgaaaaatttgcagcctgacaatgtgatagaaaagaagaaccaatttcctgaggagaaatgcaagtctgctgcagaaatttgcataagtaacaaagagccaaatgttaatcaccaagacaatgggggaaaatgtcttcagggcatgtcagggtcttcaaggcagcccctcccatcacaggcccagaagcataggaggaaaaaacagtttcatgggctgggccaggcccagggtcttgctggttcgtgcagtcttgggacttggtgccctgtgtcccagccatggctaaaagaggccaatatacagctcaggccattccttcagaaggtgcaagccccaagccttggtggcttagatgtggtgttgggcctgtgggtgcacagatgtcaagaattgaggtttggaaacctccccctagatttgagaggatgtatggaaactcctgaatgtccaggagaggtgtgatgca

SEQ ID NO: 469401 - DNA, 611 bp, Homo sapiens
taaatacagatgaaacttcgctcacttgcctgcccctcacctcttgctgtccagcttggcagttattctgaggcacagaataagcgcttagtaaaatcttgcacgtcgattgttccatgcatatcagaagaagtcaagcaaagagaagtcgagcaacagctttcagggtattcagttgcagcagtatcaaggcctcaaatgaggaagacttgcaggatagtccacccccaacctgaacctgcttttgtcagagttctgcctaacacggtcactcaagcccaggtgggatggaagctgatgccacctctgccactagtactgttaattagaaaaacttcagttgaattaaatttaaaggagcttgagagcaatgaacgattcgcgaatcgggcagccccaagaatcacagcagattcagaaactctaggggtgtttcgtggtcagaccagatttatagacaaaaaaagtaaagtaagctataaattcccacttttactttttgtttttggattttagcttattccgtctcccctattgttatatcactgacacctatcacaataatcctgaatagtctttcttatcattttgacaaatgtcagaataatttc

SEQ ID NO: 469402 - DNA, 558 bp, Homo sapiens
gtttaaaaagcatgaggcggtgtcttccaacagaagcaagagcatgctcattaattttagttcttctaatgccctcttctgctgtttgatgagtcaggctgaaatcaggaccctcagctgcaggtctgttggagtttactggaggtccactccagaccctgtttgcctgggtatcagcagcggtggctgcagaacagcggatattggtgaaccgcaaatgctgctgcctgatcgttcctctggaggttttgtctcagaggagtacctggccgtatctcaagctgcatggtgggagaaccactactctcttcaaagctgtcagacagggacatttaagtctgcagaggttattgctgtcttttgtttgtctgtgccctgcccccagaggtggagcctacagaagcgggcaggcctccttcagctgtgctgggctccacccagttcgagcttcctggccgctttgtttacctactcaagcctgagcaatggcgggtgcccctccccaagccttgctgccaccttgcagtttgatctcagactgctgtgctagcaatgaac

SEQ ID NO: 469403 - DNA, 665 bp, Homo sapiens
accacaaacccaccaggaggaatgaacaactccagacgcgccaccttaagagctgtaacactcactgcaaagttgaagtgggtaggggagcaggagtcagaagctagcctgaacaacacggggagtcactttttagcagattggtttggaagaagaagagaccttgaaacgttaacaaaactgcacagaaagcaacaagagagtggaaagggagcctgtggaatgggaaaaatatttgcaaactatgtatcagataagggcttaatttccaaaatatacagatgcctctctatttacgatggggttatgtctcaccctcataatagtgctacctgtccctacccagaacctgagaaaacaagcttgaggaaggccaatctaagatgtaggaacatgagtgtcagtcgggggctttctgccatcaacaagaggatcttcacctgggtagcctgacagtggaaaaccaatctcttgcaccattttgagtgccctgggaagtttgaatgttattggtgcatagaaatgctactgatttttgtgcattgattttatatcctgaaactttactaaagtcatttgtcaccctagcagccttttgttggagtcttcagggtttttaggtatagaatcataacatcaatgaagggagataatttggcttcttc

SEQ ID NO: 469404 - DNA, 1219 bp, Homo sapiens
gcttagtatgttaggcggctatcagtcccagtgttggctgctgaggatctcaaaaggcttagatctcaaagggcttagagagctggcagctgcaactctggtgctggtcacccctccctccaagagctcagcaggcttaagcttagtggctgttgagaatctgcagggctccacagttgggaccctaggccccagttgcatggactcaccagtgggctcttccgatcttcagctacgacagaatcttatgcaatgcaaagtactcataagagtgacagcctgtcggcttttctatgttccattggttgcaagaaagtcacggtgtccaccttcactcaaggtgagggtgctgaacaaaggagtgaatcatcggagttatatcctagcaccttttatttcctcgtcaatcatataaattcattcattctttaattttgccaaaaaagttagcttttgttaaatttaagcagagaatctatagctatctcatattgcatttcatattttcaagtgcttaaatttttcatagctatcaccaaaaataaaaaaaagtgaataaaataatacgtatatttctaaaatgtacactgacatttcatattgaatatattatgatggtctatttaatgcttcatttttctcaaaacatgtttatattctagaattaaatgtcacacaatagctcttctggaagtcatttattgagtaacttctaaacaagctaagtttatctgaaattgaacatctctgaaatttaggtagaagaagcaggccagctttcaacatagtaaaaaagcaacataactttatctgttactaatatgtgggctttatttaccaaaatagcaattttcattgtattttatatctgcgtgtctgtgtgatgaagattaacgttagtatgtagattagaattagattttcagtttggtgtagaaaaaaaaacttaaagttttccaatgaaaatttacaaaggcattacaaagaaatcttcatagatgctcagcatatgcttttagaataaaaataaactaattgaataattgtgtctttaacactgggtaagtataatgtctcacttttaagtattttaattttaaaaactgcagttgaattcccaaatctctctattacgtgctgctacattgaccaagatagaagcatatgcatatattttcaaaatgcatcattcattatcaggttatatttacagcaattc

SEQ ID NO: 469405 - DNA, 804 bp, Homo sapiens
ggctttccacttggtggccatgttgtctgcttcttaccattacccttaagactcctgctgagatgttggatactatgaccaagctggcaaagatctggtggtattatgagggggagtttctctgcacaagctctctctctgtgcctgctgccatcgatgtaagatgtgacttgttcctccttgccttctgccatgattctgaagcctccacagccgtgtggaactgtgagtccaataaaacctttttactttgtaaattgctcaatctccgatatcagaagatgtgtggaaacaccaggatatccaggcagaagttcactgcagaggtggggctctcatacagaactttcactcgggcagtgtggaagggaaatgtggtgtcggagcccccacacagagtccctactgtggcaccaactagtagaactgtgagaagagggccactgtcctccagaccccaaaatggtagatccactgacagcttgcatcgtgtgctggaaaagctgcagacactcaacacaagcctgggaaaccagccaggagggaggctgtaccctgcaaagccaagaggcagagctgcccaagaccatgggaacccacctcttgcatcagtgcatatgcaaaagagtggatctcctgcaaatggaacagagaagtggccaaaggatatgaaaggaaataatttgtgacggagaaagtgattgacaaatctctaaataatttacttgagttaatacagttaatgcatatttattggtgacattggagagagctttcattgttgttgctgttattgttttgttc

SEQ ID NO: 469406 - DNA, 4739 bp, Homo sapiens
aagttcccacttctctctcactctctcctgccaccatgtaagatgtgccttgcttccccttcactttctgccgtgattctgctccagctccagccatggctaaaaggggccaagatacagctggggctattacttcagagagagaaagccacaagccatggaggtttccacacagtgttggtcctgtgggtacacagaagacaagaggtgaggtttgggaacctccacttagatttcagaggatgtatggaaacacttagatatccaggcagaagtctgctgcaggggcagagccatcatggagaaactacgagggcaatgcagagggaaaacgtgggatgggagcccccacacagagtccccactggagcactgagtagtggagctgtgagaagagggccacagtcctccagaccccagaatggtagatccactgacagcttgcatggtgtaccgggaaaagctgcaggcactcaaagccagcttgtgaaagcagctgtgggggctgtacccagtagagcaacaggggcagagctgcctaaagccttgggagcccaccctttgcatcagcatgccctgaatatgagacatggagtcataggagattactttggagcttaaagatttaatgactgccccgctgagttttggactttcaaggggcctgtatccccttcatcttggccagtttctcccatttggaaggagagcatttacccaactcctgtatttccattgtatcatggaagtaactaacttcatttttttttacagatggtgcctggttgctatgtcctttagagtggacaaacgctgtatcttcacatggtgaaagaagtgcaagggccaaaagaaactccctagttcccttaagcctttttataacagttctaagcccattcatgagagagcccttatgacttaatcatcccctaaaggccttatccttaatactgttacactgggccttaggtttcaatatatgaattttagggagacatatacattcatgctacagcatttccaaagtagattgttaaagaatatgaactaaacttaccagttaaatttttgcccaaaatttcagtcctgattcaaagataagtgccagttagagttactacagtgaggtatcatgacttagattaaatgttgccaccagacttacataaaacactgtgtaactgcaaatatttttaaagtaatgtatgtcctttaggaaataaaaaattcagtgatgatggactaatacaagtatttataacgtggtaacattttcatttaataaagctcacagcggatgtgtatttatttagttgataaacttcaaaatagaatgttaccataagttgcactgggattctagatcctgctttctctggctgtcagaagccaaattgtatacctctctgaatatcatatccactgatgactctttggtagcttaaaatcaactgcaggaacatatattgccatgatagttaggatgactagaaatcatggttctcccttttgctccccaaaaagatattggttaaacatttcccacttaccactgattacgaccatgatggagcatgaaatttggagatagacaccaaagctttgagtcctgccacttaggaggtgggtagcctttgcagatcaccaaaggcctgaaagtccccaggcctttactgggaaagagtcttatacactttactctctaggctgttttgtggatttggtaagtaggatatgtaacatagatttaacatgtggtctgccatgtagtaagtgttgaatatgattgaattattttactcttccattgttcctctcctctcatgtttactctggttattttatttagttgttttttctattatggtaattcaagggaacaatgtagacaaagtgaagaagtagagtgaatagaacactaattatctgacagttaatacctatacctagtaactgctgaaaatctcaccttatacatcaaccataacttactcctttgcagatactcatttttggaaggggaaagtaaacttcctttcttttagtttccatcagcaatttgtaactgctttatgtttacataattataaattattgtaactaagaatgagttgttcctatgcaattttaacttaagaaataattactactaaaggtttgcttattcactgtttatttgctgctatttagctaaggagagggctgtggtggtagccctagcaatgaagagggagccctgaatccaagaaatgtgatattagtagaaattgtagggcttgaaaaataattaagtattcagtaagaaatcactatatttgtcaaaaatatatattatgtagatgttacctgaattactatgtaaaggttattttgcaatataagtatacttatatactccaaaattacaaccacttttagtgaaaaaattactatatcaatttcctaaacactatattttaatttttaaaataatgaatattatacttttttggttccccctaacttcttggggagttagctgtaaacaaaataatgtttctaaatatatttcaataaagctagcaatatatacttttgaaatgatttattcatatatttcatctaaagtaccgaatttcagtacaaaagcccttaattcatacataatataaatatgaaatacctatgtccctcattattttacaagatacaaaaaaatttactaaactctggtagtgttttatagaaaagaattaatgtaactaatattcttttcccacactcctctgctctttatgttcctctacagaaccagcagctgagccacacaaaggacatgtttgacagataaagaacactgatgccaaggtctgaaataaattttttagcattaacatctgtgtctgtgcaaagctcttggctgctttcttcatttgatgcttggatgggtctgttagatctgttgactccactgctaaccatgctaatatctgtttagcaggctctggtgacctgcccacaaaatcagacattgattaaactattttaaaagtcctatcttttggaatttgtcatttttgttcctctgaatgacctatgtccacaagaatttgtcctcattttatgaaaagcacactaaggaaaaattatctatatttttcatgtagaagtaaagaaaagtacaaagcacgcatccctaagataatctcaaatcattctctgtatctttggatgattctttttcacagtgcctcaaaagtaaattaccacaagccaaatttatttcagtattaggaaattaactgatttataatttcttaattgaatgtcaggcaattacattttaaaggaatttattttcattattattagaagttcatacatattacttttggagatacaggacatatattccaggaatttgcaacaaactccaaacattgactaaatcaatttgatctgatcatattacagagatattttcatataccctgaaaaacccaaataattctcatttagcaaaaaacatttttaaatatgtttgcacagatacataaatatagaaaatgttcttccatgtttttgccagaatgtgctcaatttagtattttaataaaatgtgaataaatagttctttaaaaatgggtactttcaaaattttatgcaggtttttgagagttatataaacatttttatcaaaatttctcaacactgtgcaagatgaaaaatcaaaggtttatattaatggtccaattcaggagaaacaatttgctctaaaatatttaactgctattggattttgtatgcaagagaaaaaactcacttaatgtttctgttcaggcccagattttcttttgttctgtgaacttatgtatgttttaatttcttacatctaagtagtaaactgagttttattaattgtattaggttttcaaataataatcataagaacgtgaaacacaaaaacaagacacacacaaacacgggcttgtccagagcaattccccagtacaacgacctctccaaatttgttgttatttatcccatgagtggaacagacttgtaaaataattttataaaccttgaaggttgttatgattgaacattgttataagcacatagttgggtcttcccaacacacatctctaccataaaatttcatttagacaaatataaacagttgttatttttcaaatccaaatttaaaaatataacacagtgatgaaggggcatgttgtataccttaatctaatccctaaagactaattaggctttagctttagtgctattcaaattggtttttatgtgcttaagttatttgaaaatatcgtcttccaaagtgtagagaaatcacttggatgacattgcaaacttctgatgccaagctgggaaaatttcttccaaagacagcatctggttctttggcaaaatccattggtagtttttctgcacatctaggtctgttatatggctggctgcttttaaggaccagtttctagtttactaaaatgaaggactatataaatcactgaggaactctgtgatgctgatttaagtactagtttaaaaactaaggctccatatatgagacaagtataacactgacggctgtatgctgatatactatcatgaacatctgtttctgcaagtgcctgtgactgtctaaatgtgtaggatgaataatcatattatatgttctataaaaaatttgaaaatcattaatattgtttgaaaatatattcttcacacattcagag

SEQ ID NO: 469407 - DNA, 582 bp, Homo sapiens
attacaggcatgagccatcgcgtgccggcctatttcaactttactgtaaaactaaaaagatcaaaccagccacaacgttccctgaagccaaagcctaattcagagcacggcactcactctcttaaattctgtgaaggctgtgagagtcacccaagagctctgatgcagatgtacaaagacattaatgttttcatttctgtgaacacaatatctattctgtactccatggatcaaggagtaattttaaatttcatgtcttgtattttaagaaatacattttgtaaggctttagcttctatagataatgatttttctgatgggtctgagcaaactaaactggaaactttctggaaagaatttgccattttagatgctattataaacatttgtgatccgtgggaagagttcaaaatatcaacagtaacagaagtttagaagaagtacatcctaatcttcttggaaaattttgaggagtacaagacctcagtgaaagaagtaactgcagatgaggtggaaatagcaagataactagaattagaagtgaagcctgaagatgcgacagaattgctgtgatttcatgat

SEQ ID NO: 469408 - DNA, 1790 bp, Homo sapiens
gagcgaggacagcacagtcggctgccttggagacgcggggcaccgccctcgcctctctgctgcagctagcgggatgccagcggccactctggacggcccaccactaccatcacatgcacagaagtaatttatatggaattaatctatttacatcaaacctacgatgatgtgtttatagagaagactggggaagtaggtaacagcgagcaagtcatcctgtgaggaaggtcctggagcgagccctagagtggggactccccaggagggcccggagcagcggggacttctcactccacctcttcagtctctgattagcacacattcgggggagtgcttccacttggaaaagcttccaggaggcagctcttcagtagcgaccgaggcacacgtggtccatggacaattttatcctgtgaagcggatacggtttctcacaaaggttggccagcacgtacaaatgtctcaacgcatactcgcacgtgggggagtgccagttgaagcagtgggtctggaagtgcagcagggcctccaggtagcagctatgccccgtgaacggggctctctcagacaggagctgctccacctcagcctcggacgctgccagcaaggaggcgatcttgcgcactgacttctcaatgaggtgcctggcatccagatgccgctggatctcctctgtgagctgcctggagtcctccagatcgttggtgttcatcagtttccttttcacgatcatgaggggcacatcagggctgggggtgaggtcaaggtgtgtgactggaggcagggagataggagaactggctttgtgtttcatactctgaaactgcatcactttaatgtggagatcgtttcgtttccgtactgcatgatgtggctggtattggtgtatgattttaccaggcggcactgcttgtgcagggtctggttagtcagatcttccacgtccgagtcttccatccagttgacgctgtaccagtcccccaggatcatctatgggaacagcaccagtgcccagtgccacgctgaggaatacagctactttccaaagccttctgcactttggagttcaactgcagaaacctgtgataagcgatcgtgactagaatataatctattttggggagtcaatatgttgctgaaaagtgaaacagataaacttcaaaactttatttttatgattgaattgcattttaaaattatgcatcaaaattgttgaacatttggaaatagaaccaaatatgtttaaaaaacaagatattgtcacctactaggcagaattaatatttctgcaattgtcccccagtataatttatgttagttatttttatacttgagattataattcataaatttgtggctcatttatattcattaaattacatgaatgctatcatgtgatactgtaacttattacatatgcatacacaatatatttctaggtcaataaatttaacagaatataattttaataataatattaaattgcatgaatataacatgatatgcttaataagtttcttgatttcagattttcaattttcttacaatttcagcaacataaatgaggctgacagaccctacaatttacaaaactacctttgcctttcccttagacttgtacttcaaatacatatacaaggtcagagaacatttctagattccaaagtatgagtcttatcaatatatactcaaagagttttatcactttttatgtccacattaggcaccatattagagcataagtattgacaacatattatttaatgtttaacattctggaatgtggatgc

SEQ ID NO: 469409 - DNA, 5357 bp, Homo sapiens
cgtgggtgatgggctgatttgtgcagcaaacgaccatgatacatgtttacctatgcaacaaacctgcacatcatgcacacctatgtgtgtctttgcacatcagatgggtatactgaatacagcacactggttggggaagttctcctggataatatcctgaagagtgttttcaaacttggttctgttctccctgccactttcagagatgccttacctagagaggaggaatctagagaggcagtctggctacagtggatttgtcgagctgtggtgggcactgcccagtttgaacttcccagaggctttgtttacaatgtgagggaaaaagcacctaatcaagcttcagtaatggccgacacccctctcctcaccaagcttgagcttcccaggtcgacttcagactgctatgttgtgaaagtatcacaggacctccctttctaccccaaatcagatcctttctacaccaaatcagattctgttgtcggtgccaaaatagacggcacaggaaatctaccacaccacagaccatctgcaagaaacatctgacagagacttctggttttgggcttgaacaccaaccaatcagacttcacctgccccagccagtcaggtttcaactttattaaccaatcagaattcagctacacctacccctctgaactaagctagttttaatcctttatttcccaaaactgatcagattgagaacctgagcagaaactttttatataaaacctgaacccttcctttcttctctggaatgcaccttcattttacacagaaggctatgtctcccagtttgcaaactgttcactggaataaagtctctttcctccaaattccttttcagagaaccgttgtttcacaatatattgacttttacctcattgaaatacatatgagtagatctgaaataaaagatactaattaaattgtacgacaggatctcatgaagataaagagaaaacctacagagataatgctggatgggaaattattagccaggaataagaatttgagtgattgaataaatatagctttaaaagttaatgtttgttattcaatttggcatctgtgacataaagggaataaaagtttttcccataccactgtatctctgaagtatgtagttcaaatagcagtgacatctatctacctagagaaacaggcatgaacacctctgtccataacttctttccattctacaaattgagattgcgtatgagtatcctcacaagattcacaattagaattacctttagcaacaggaaaaagaaaaaaaaaaggataaatggttttaacagaaaggtttctgttagttttccatatcaaagacaaggtgatcaggagattagagggaactcaatacccatgatacatgcctcagaggactgaagttaaatgtagtctaacagtgtactgcttgtgtttgcataatggctctctatttccatcggtgccagaagacattcttttatattctgagaatatggatctagccgttattccctacaaagccaaactctgacgaaagtaacctagatcaaaatcagcctctaggggtaaaatgtggtataacataaatctatgacatttacacattttttgcgttgtgtgagtaaaaacatctcttcaaaagcagtataagataaccacgtttagagattaaatcaactatatttatacacatttatcttagagtcacacttccagcaaatgttactttctggaacacaagctcaaaaatagtttttggcctatattaactatcacaaggctacgcattttaaaacttagaattaattcacacattgattactttttgaaaatctaataccttcattgtctgtttatatccattaagtcaaattcttattatactgatttatctttaattctaggtcatgacatgagaagcagcaaaagaaatgaggaacgtagtagcggaatcactgacactagaaaagacagttgaaatcagaaaataaaatacagccataaataaagctttataaaaaaagccataaaacaattatgaaacaaaataaatatatttgaagattgtagaaatcacactggatttgttttgttttttgtattatcacttaacaagaaagaaaatactcgcttacattttatgtaatatattacatatgtatatatttaacataagtatatgtatatttatatgacatatatttgcatgtatgtacatactactctatttaaaaaagaaataatgtcaaaatacggagctacttaatgctgaattatttatcaatgccaaattctttctaaaatctctctttaactggcactatagaatgagctattattataaaaatataaaaaagtaaagtcaagtataaatatgacatgtatgtaaaatatttggtatttgtttaaaatatttggtatttgtttaactacctcatataattttctgtggtattctgttagattcagatgcagtacggtatgtaaatttactttagattgaaacccaaagcttttatttatgggtaggtaaatggttttggcttcttgtttttaaatatcaaacattaatataattattgacatttatatctaaatgacatctatatctgaaacatgaaagtaactgtatacaaggaattatataaaaaggacattgataaccagcttttctaatcttttaaggaccataataagaccagtgctttgccattttactaaatacatattcatgctattgtcaagaggacaaattatttatatgttttaaaaaactctttcacactgaggaaagagtagtttaaactgctgaatacatttatgatagttaaacttcatgatgtgaattaaataatggttttagctaagataattttaggaaaagaagcatacataacattatttatggatataaaattttctgttaattatatacccagagaaaagataatttactttaaactattttaatctttaattttagatttattcataatacactttcccagctctgaaattggaggattttgttttcacttaatgcattattattaacttcatttctctaagaattaacagtcagatggttctaatcaagcaaactctttccattaagaaatgtaaacacataccagattttatcatttgatttgtgtttgggttatttccagtttttgcactgtcttgtactaataaccctgttaacaggttcatagaaaaatcgtaataagcgttctgagcaaaattcaactgaattcactagtttactactgggcatgttatgaatacactctgtaatttaaaagtttataacattactttttaaaaccttaaataattgcattttcattagctttacatatttttcattgtttagtcattatcaatttcagatcacatggattaaaaattttaaaatactgtgcagaaaataaatatttatgtactctacattttacacttaatcttctcagtcttcatatatatgtgtaagcacacaaacacacacacacctttattagcatacatgtagttctaagaatttagaaatctaaaacaatactactgttccccaaaggcaaacagaacaaattattgaacgtttccgcactcaagttccaaatctagaatattggggtgctatatagacccaattagtcagactctttgcaacttctgattttgtcatctatgttccaataatatagtcaacaaacagcgttctttctaaatgcaagatatttaattcttagggagaaacgggtataatagcaataaaaatgcctatttcaaaatcagagaaaaggaagaatgttagcaattagagctgttcaccaagacatcgtgaactcccttcttgcattaaaaaaaaaaaagaattatacttcactgtcctcttaaatctaggcataatgatgtggacttctttaaacaatgtattataatttggaaccagatatatatttaatctgtaagtacttgggaaattttccagctgtcttctgttattgaatagtttttgaaaaactattatataaagtatataactataaattatatatttattaatacatatttgtaatacataaattattaatacataatatttattaatacataaatatcacacattattaacacaagatgtttattaatacataattattacataaatattatataatgttatataatatattaatatataatatattaattgtatattatatataatttatatataacatataaatgtgtattaataaatgcacataataatataaatattatgtattaataaatatgcttgatattaatatgctcaatattaattaatattaatatcgattaatatgctcaatattaatatgctcaatatttattaatacatattgagcatatttatgatttctgtcttaattcctgatgaaatctaatggatttgtccatttttactagcagttccattcatttttgcctcatctattttggtactatttgtttatgtgcatgtatattaagaattctatttcttcatggataattgactctttttcattatgtaaaatattgatttatccttgatcagtatgctatgtctgaaatttatatagtatcctcagttttcttttgcttagtgttatcaaggttgaataggaattgtgagagtgggcattcttgtcttgttccaggtcttaaagaaaaggctttcagcttttcctcatttagaatgatgttagctgtgggtttattattactatatgtgatctttattatgttcagcactttgaaaatattatttcattttcttggcctgtaaaatttctgctgaaatatccactgttagtctgataggatttctctcataagtgattagatacttttctcttgcttttgtaattctctttgtctttgattttttgcagtgccctagatagctatggaaagaaagaaatgcttaacaaggtacaagtccaacgtaaaagtggtatgagttgaacttcattaattgtgagagtggtgtatttacttatttgataactgctctagtttaatcaaggtacaagcagatttggtgttgcctgagagagcccacttcctggtttatacatgtcagtcttctctctatgtcctcatttgatataatgaccatcagagctaatgcatgctgtgtgaataaataatgcaattaacttagtacttttaatatattaataaaaatatagtattccggagagttaatactattcactgtgaaatatgattaaaccaacaattatataaaaaggttctttgatacgatattttgtttcattttttcttgttttattaaaatattacaaaattttaataagatttat

SEQ ID NO: 469410 - DNA, 803 bp, Homo sapiens
catcacaggaagacagaattggattggaatgctctacaatgtggttgcaatggaggcttcagcctgtcctctgagatttgcattaatcgttcagagttgttccagtaggaacagcagtgccagggctttgtatccctacatcagccaggcactgtggtgcctgatgatggagaaattcttattgaaaaaccacatcattccatttaattactccatatgcacagaaactgaaatcgagtgtgcccaccatacaagacagagcaataaggcaccatcttggaagcagagagcagccttcaccaagcaccaataccagtgccttaattttggattttctcacctacagaaagataaaaatcctggaattgctacagccatgaagacaaacattattgggaaactgtaccaaaaaaaagagaagtgatttcttggcccctctatttgggttgccagttcttttctgattccttttcagaaaaatgaatactgtgtcagtgtgaggtgcatatgaattgaaccctaaaacgaagagttattattaacattcaattgttaaaattttgcattatatttaattgggagattcgtaggtaattattgtcatatcttcagggtcattggatactttacttgaatgggttcaatctatttgtgaaggcaacaaaagaattcttcatacattttttaatttatagcattgccttttgattctttattaaaatttcagtctctcatttcatattacccatgtgctatggtttgaatgcctttcctttctgaaactcttttcaaacttaatttcc

SEQ ID NO: 469411 - DNA, 1567 bp, Homo sapiens
agcatgtacagataaaaaaagtcgggagggacagggggattacaatggggcctaaaggagttgtagggaatgatgaatatgttcattatcttcattgtgctgatggtatcatggagcgggttcctggttcttgtcccacaaccaagaggaataaggtgtgcagacaccagagactcaatcaattctatcagttctatctaaaaaacctaacaataataatcaatattgttaaaatggccacactgaccacagaaatctacagacttaatactattcctatcgaactaccaatgtcatttttcatggaatttgaaaaaaacccttctaaaattcatgtgcagcagatctggaattggtccgagctgcctcaccgtaataatacatatacatgcaaggccctgactgctggtaaaggtataaaacatactgattatcagggttgctttcaaatcatgggtcagaggcaagtttctggacaagttgctaccagtttgtcaaaactgtttattgataattgtaatattcgtgatttgcagcaggtcttgccaaaattggaaaggggctatgcctttagggttctcaaggggcatgcttctagctttcgcccattcagtatgatgttgactgttggtttgccatagatggctcatattatttttagaaatagatttttttttaattttcttaaaaagtcagtttagtggcagataatctgtatactgaatttctatataaataagttcacatcatctctactttctatttagtctgttgatctttttgtctattcatgtctctgaaatatattaatagaattctaaatttcttatatgtttttaaatccagtagattgagtctctcctcaatcatttttgggtttgtttttgtttttgtgtttacttttgaaacttatttttctatatgaaatttagagtcatcttgcactttcatttgaaataatgtttaaattatatactaacgtaggaacaatgtatatcttatgatgatggtgtcttcctattcaaatttatattatatttcaccattgattcaaatggtgataacgtcaacactttccaattttttaaatctccaattagttgattattacaattcaattgcttacttaaaaaaaaaaactaatgaatctttttaagtctccttcacattgccaaatacactattaaataaggacaaaaaaccaaacaccgcatgttctccctcataggtgggaattgaacaatgagaacacatcgacacaggaaggggaacatcacacaccggggcctgttgtggggtggggagagtggggagggatagcattaggagatacacctaatgttaaatgacaagttaagaggtgcagcactccaacatggcacatgtatacatatgtaaaaaacctgcactctgtgcacatgtactctaaaacttaaagtataataaaaataaataaataaatacattgtattctaagtgattaataatacaatattaatgagttactttcacaacatttttttcatctcctttctcataacatttttcacaacatttttctcatctc

SEQ ID NO: 469412 - DNA, 1813 bp, Homo sapiens
tgtaggtaattctgtatctttggcaccccaaagaattacctataattgctggagcagcactagagtaacgccgtatatggttccccggtgttctgaggttatgatcttcactgatcaggcaaaagacgagtgtggtaatttctgggtaatcaggttgttgccctggaaaggaggtgtaacttccaggtgttgccatggcaatggtaaaccgatgtggcacactggggctggcaagtccaaaatctgtagggtaggtcagcaagctggaaacgccttgagcatcccacagaatgttgccatgacctttgctgttgacggaagatgcttcctgatgtctgcaaatcagaagggctgctctaagacacatgtacaggaaccactgagtcaaaccattgctcttctacaacttggacatggggatacattttggatagcaaggcctcgttatcctctgccttcagatcattccaaattttcaagatatagtggaacacctctttccaaagacacatatgacattagctaggttccctaaactgtttttcaactctaacaaattttgttttttatgtcagtaatcagccacaatgtctaacttagctaatcgttggtattttattaaaacattaaaattataatgtgttaagttatactctgtacacaaattatgttagagaccatagaatacacaaaacttaaagtaatgagtacttggtgttctgttcaaagacctttaattactaaatgcagtgtattaactatagataagcaagaaattgtcattttcagttcagaacactccattcaatagtaaacatagatttataattattaaatttataaagtagtatgattcagactgtattaagtgtttgcagagtatggatttcaaagaggatgaagtcttaattctgtttaggccagaaagtatattctttacaacttttaaattgtgccttcagcaataaacatgtattctcctggaagagatgtgggaaaggtatatacaaggatgaaagaacagaatgtataaaagcatgcaggcatcaaatagtttatgtttagggagagacagaaacacagcctataaagagtacaggagaagaataataaacagtaagaagaaaagtatgttgaggttgattgggaaggaccttcccagtcaacttcatatgacatgttgaggagtctaatggctaattctatgcacaatggtgttccatgtgcatgttatacctgaacgtactgacaagatttatttacacaatttaagaattatttttggttattattgaatgtaaggagccagaagaaggaaataatcaaacatgtatccaagctttgcagctaagatcaattgagacagaatttaataactaatatttaaaaatgagtgtttacaaataaatcatgattctaatgtgtgtctttcccttgaggtgagaacagtctgggttactagcaatgaccaaaatgtattatataataagttataaattaataatataaatttttgtctgcctttctgagtataaacacttcatacaagctaactcaaagctttcattgctcaagggaaaattacagaaacagtagatgcggacattaaacaataggatcgtataaacacagaatacttgcaaagcatgttattatctgatgattttctaaaaacgtaaagatatctcaattcagtacagcataggctccagtcacagattttactgctattacagagaagatatcccttttaacttataacagttcggcatgctccgggtaataggagagagcctaggggaaatacactagt

SEQ ID NO: 469413 - DNA, 1484 bp, Homo sapiens
gaatattgtacatttcaaattgctaagataatggccgaataggaacagctccagtctacagcgcccagagtgagcgactcagaagacgggtgatttctgcatttccaaatgagttaccgggttcgtctcactggggcttgtcagacggtgggtgcaggacagtgggtgcagcccacggacccagagccgaagcagggcaaaacatcgcctcatctgggaagtgcaagggatcggagaattccctttcctagccaagggaagccatgacagacagcctttggaaaatcaggacactcttaccctaatactgcagttttccaatggtcttagcaaacagcacaccaggagattatatccctcgcctggctccgagggtcccatgccaacagagccttgctcactgctagcacagcagtctgagatcaaactgcaaggcaacagcgaggctgggggagggtcgcccaccattgctgaggcttgcagtcaggaagcttgaactgggcaaagcccaccacagctcaaggaggcctgcctgcctctgtagactccacctctgggggcagggcatagctgaacaaaaggcagcagaaacttctgcagacataaacatacctgtctgaaagctttgaagagagtagtggttctcccatcacggagtttgagatccgagaacagacagactgcctccttgagtgggtccctgacccccgagtagcctaactgggagccacctcccaataggggccgactgacacctcatactgctgggtgccctctgagacaaagcttccagaggaacgatcaagcagcaacatttgccattctgcaatatttttggtactgtagcctccgctggtgatacctaggcaaacagggtctggagtggacctccagcaaactccaacagacctgcagctgggggtcctgactgttagaaggaaaactaacaaacagaaaggacatccacaccaaaaccccatctgtacaccaccatcatcacagaccaaaggtagataaaaccacaaagatggggagaaacaagagcagaaaagctgaaaattttaaaaatcagagtgcctcttctcctccaaaggaagatagctctttgccagcaacagaacaaagctggatggagaatgactttgacgagttgagagaagaaggcttcagaagatcagtaaacacaaacatctccaagctaaaagacgatgttcagacccttcacaaacaagctaaacaccttgaaaaaagagtggaagaagggctaactagaataaacagcatagagaagaccttaaatgacctgatggagctgaaaaccatagaacaagaactacgtgatgcatgcacaagcttcagtagctggttcgatcaactggaagaaagggtatccatgattgaagatcaaacgaatgaaatgaagcaagaagagaaggttagagaaaaaaagagtaaaaataaatgaacaaagcctccaagaaata

SEQ ID NO: 469414 - DNA, 620 bp, Homo sapiens
ccggatgtctttacttgcatacatgaggcccttccacgtgggggctgtgggcatggacatttttatcttggtccttcttgaaaaaccatataatccctatgtggaccccccccctgtgataagtgagataaacctggagtgtcataggttgttgaagacaatcacttcatcagccatctcctgtcaactggcaattcattttgacttaaatgccaatcaccaggagtcttctgccactgaacacctcaataatctccctccagagctggaacatacactgtggtggacatggagatgtgccacccatcacccccttcaaggacttgtcccagcttctggaggtgtagttgctgggcaaccttctgctgtcaccccttttggggacagccctcatgcaatgactaatcaaggtggagggagaaagccctggccattggcacacaggacgaccctcatggaccattttagctccaggaatggtgcaaatggacttgcttaaatagcaactgcttcaaactgtctgaaacccactgaaatctacccgttagaatacttggtacacctaatttgccaagagaaccggttgatgatagaaggtatcctttgatactgtatttttc

SEQ ID NO: 469415 - DNA, 591 bp, Homo sapiens
actacccattttagcttacaggatggtaagcccccaaatcaaaaccctttcatttactctatggatttccacttgctcagaggtagtagaaaatgaaaaccttttaacagtttctgagcatgcaagaacacaatcaaagggatggtcaaatacgggcacattaggtaaaatggatgagagaaccctggcaactagtacaagggctgtccctaatgaagtggccgtagaagaacaggtctctcaaactggcatcctagcagcagtgagatcaccagagaaaacctcccagaatcttgagtcatcagctctgggggtaccaggtcctccttgcaaaagatttaaaacaaactggttctcaaagtgtggtgctcaaaccagcagcatcagaaccacgttagaaatgcaagatgcatgtcccatcctggatctacagactacagagcccctgggattggggctccacagcctctgtgtgattctggttcacactgaagtcaaactactgatttagaggaatatttccccataaggtgctagaagtaaatctgttcctcgtttggaccttttctaatggcttctcttgttagggag

SEQ ID NO: 469416 - DNA, 703 bp, Homo sapiens
ctcctcgtgttcagggaaccgtgaacagctgggtactgacagggtgaggatgggggatgatgcttggaaagtgatgcttaacggaatgccagcaattgaaaatgccattactagaggactaacactgaagctgccagcattggcccccttaaatcacagagtgaaagcccccatcttcatagcatcctggaaggaccgagttcatagcagcccggaaggagcaagctccctcactgtgcatctgacatcggctcctaaagctctcccttcattctgctccagacatgagggcctccttgtttgttccctaacatgtctggctagcttccacctaggactttcgcatttgccattcttcagcccagatacacacaaggccaattccatcacctccttcaagtctttactcaaatctcattttctccatgaagcttactctgaccactcttcttaccattgcaacccacctctccctgcagagttgcaccacaagctcctttattccacccccaaccccagtgtgtaccacgctctaaggtatctattagtttcctggggttgacaggacaaagtatcagaaagaggcggctttaaacaacggaaattaattcatgattttggaggaaggaggctgccattgaggattctggaattgcaaaaggtcctgattagaaagatggattaaaaacttaaatgtaaaacc

SEQ ID NO: 469417 - DNA, 699 bp, Homo sapiens
agctggatctcactcccaagctctagacatgatagttccacggtccctgcatcttgctttgtgcgtccacctctgctttgtgtcttggtcaataatcctccattcactgcctttcatccggaaatgtttttcagtttcctcatccacttatgaacctcttcaatttctcttcgttacatattatcaaactttcttaacaaaaattatttacgttgattttatggatccagggggtagcagtagaaatacatgtggaaagcaaaagatttcctgccccttcccatcagacatgcactcacttctaattgggcaaaactgtgtcacatggccacccttatcttcatgggcctggggaagccgaatactacttgacttaacggaatctatcatcctgaacaaaattggagtttgcaaagaaggaaagggaatggatattggagggcatttaatttcaaaagggatatgtcctttaggattgattttgctgcagagtgatgaagatgctgcatgtgggaagcagggggctggagccacagggcacctagaaagagctgccaaatgttactttggctttttactccttgggtctcccaggagtgaagaccctatgacatggatcccttaatagaccatagcatcacgtgaccaaattatccagtcattttaggattattctatcactttcatttcattgggggt

SEQ ID NO: 469418 - DNA, 636 bp, Homo sapiens
cagcggcaaccagagagaaaccagggttatctgcaaagtcacgtaacgtatcgaaaggtgctgagctggatgaatcctgtgtccctcttggagcttgtggggaatcttgtgaaacagtctaagtgcgagctctccttccctcacctgtgttctcgtgcatctgtgctggttccctgtacagctgctgagctccctgccaagctacctgggaatggacccctgttcattttaggcgggatggctgctccgcaagccccatctgtccaaggctcacgacaggaccaaatgagaggcaagcatcagataccatacagtaaattggccagtggggctcagcagtggccttcagatccacctttgccactgactcaccagaatgtcatagaagcaccatccaaaaagctgtggtcctggggatcttaccaagatgaacaaggtcatgatcgggttttaagcaccttgagaaacacttgcttgggtgaatttcatctggaggtaaagatcaggaagggctcctattctataattcaactgaaatgaaagtaaggtattgagaccatcctttatgcgaaatgagcatgagggtagaaatattaaggtacaagataatcatttctctttaaagttcaaggatag

SEQ ID NO: 469419 - DNA, 966 bp, Homo sapiens
ctctcgggcctgcaacaggctccttcccttctcagcaggggtcttgtgatggcatgggccgctgtccacagaagagtgctctgaaccagcacatcctgctccaggcatcatccctcaacatcattccttctccttcccaattgccggaaatccatcggcctttctgctccattgatgctccttttccccctcctctcaagctcacttactcaattttgttcttctttgttgtcatccgaatggcattttggtggacaggagagaacatccaagttcccatggctctcacccctgacctgaacatgcaggaagtccacttccttgaggatcacctctctccaaatatttctgctaactcgcgagaggtttaccttgatcttctcacagaatgcaaattgacattatatccacatttctatggtatttattaccatggtcatgatgtgagggctttttcaatatgaatagtgtaaaaggggaaacatattactgcaaagagacattattgtgcagggaatgtataaacagaagagaagaaaggagcgacatgctcataatagaaactgaaagctcctcattttgtcctgattgtctacccttcctttttaaacaaccttccttttttctagctatcaatacaaagttctttttggtaaaatgaagtgcattcatgctgcctgaaagaagcttttaaagttgatctgtgcccacacaaaagaggcagcactgggtccaaccagtggaggaagcaaagttggtcaatgttcattactcatggctcgacatgccggcccccatatcattttgtaaagaatcagataaactttcctcatgataaacaactgaaataatttttcttagctgtcagctccctttctccttttcccagcctgttctcatactcttccccactcgtaaaagcaaccgagcgcagctctttggtctgataaatgggctcctttcaac

SEQ ID NO: 469420 - DNA, 749 bp, Homo sapiens
gaaggcgaataagatcatgacaaatacaaggacagaaagcagaaaaagagaaagaaaggagagaagcaggatccaggggaagaaaaagagagaaaacggaggagactctttagccaaacaagaagaagtagaacagacaccccttcaagaagctttgaatcaactgatgagacaattgcagagaaaagacccaagtgctttcttttcatttcctgtgactgattttattgctcctggctactccatgatcattaaacacccaagggattttagcactatgaaagaaaaggtcaagaacaatgactaccagtcgatagaactaaaggataacttcaaactaatgtgcactaatgccatgatttacaacaaaccagagaccatttattatacagctgcaaagaagctgttgcactgggggatgactattcttagccaggaaagaattcagagcctgaagcagagcatagacttcatggctgacttgcagaaaactcgaaagcagaaagatagaacagactggggaggatggaggcagagtggggaggacgaaggctgctggcccagggagagaggactctggagatgccgaagcacaagccttccagagtcccggcaaagaaaattaaaatatagacaaagatatgcttgaagataagtttaaaagcaataattcagagagagagagcaggagcagcttgaccaagttatgaaggaatctggaggaaagctgaccagacagcctgtgaacc

SEQ ID NO: 469421 - DNA, 675 bp, Homo sapiens
agctatgtctgttagacagctaacattgctacctcctaaatgttactacaacctgaggtctgagcactctgcccaaggtaatgttagtgatggtgaatctatgcgggtctgcagcaacctcaattcttgcctcctcagaagaaagaattcgactgaagggcataaggcagaaaagcaataaaaaaggctctacatcttcttcaacatggcagcacaggagagcaggaagctgttacactgggttggtctttagcaggcatgtttgggaggtcccctttgaagagcagcttcttggaggcatcacaggccctggctgctcccagaacattactctgtccaatgtcaatgttaaatcatcaggtccaggccttttggtacatggcatccttgaggatcctttcttccacttgatcaaattggctactgaaacttgtgcatgcgtcacgaagttctcgtgccatggttttcagcttcatcaggtcatttacggtcttctctacactgtttattctagctagccattcatctaaccttttttcaaggtttttagctttcttgtgatgggttagaacatgctcctttagcttggagaagtttgttattaccgaccttctgaagctgacttctgtcaactcgtcaaactcattctctgtctagttttgttcccttgctggc

SEQ ID NO: 469422 - DNA, 666 bp, Homo sapiens
agtgcagggccaggcatacagaagctaaatgtgtgtctggaattggttccttctggtgggttcttggtctcactgccttcaaaaatgaagccgcagaccttcacggtgagtgttacagctcttaaagatggtgtgtctggagtttcttccttctggtgggtttgtggtctcgctgacttcaagaatgaagctgcagacctctgcagccagtgttacagctcttacaggtggtttggacccaaagagacgtccagcacttgtgtgggcacagcaaggagcactgaggcctgcagctttcctctctctcctctgctccaggtgtattcacagcccactagacactatttccagagcctgcagaagccgaatatccatggtgctctgaagtcctggtatctaggagcatgttgcagcctgctgttgtgcatttcccatggtgaacatgcagaatcaaaattttctcagtggagaggatttttcagtactctggcaagatctttcaccccttcctggctgtccattgaaatagaggtcatatgggctactgattatgaaggtagtaatttttcaaacaagtaataatataatgggtcagaccagtggtttgccagtgtagaaatttgaggcattgtttaatggaagtaataaaaatgtgctaagtaccta

SEQ ID NO: 469423 - DNA, 1990 bp, Homo sapiens
acctaaaggggcacgccaaagccgtgggtcacagaagagaaccgtggaacccagtaactagtgttcagctcgattaggatgaacccgggcacttagccgtgcaggcacaacggcaagcctttagcccgatcgggagcggcaatgggcgcctcgctggatcaggagcacaatggacaccctgccggatccggagggatggaagtcagcagtgggtctgcgactgcggcaaacagcagtggtggacggccagcaaaagctcagctccagcccattttgggcaaagccattcaacaagtctccaggaagttccaaactttcccacactttcctgtcttcttctaagccctccaaactgttgcaacctctgcctataacccagttccaaagatgtttccacattttcaggtatcttttcagcagcacctcactctacaggtaccaattttctgtattagtctgttttcacactgctgataaagacatacctgagactggtcaatttacaaaagaaaaaggtttagtgaacttacagttccacatagctggggaaggcctcacaatcatggtggaaggcaaggaggagcaagtcacatcttgcgtggatggcagcaggcaaagagagcttgtgcaaggaaactcccattgttaaaatcatcagatctggaatagttcctcaccaaacactgaatctgctagtgccttgattttggacttcccagcctcgagaactgttaagaaataaatttctattcttataaaggtacttgttatagtagcccagatggactaagacaattattcttccaataatagcaatgaatatttatgtgacatacaattttgtgggctatactctttaataattggaaaaaaaaaatatatatatatatatgataaataaaggccccatgcataccatcagttatgggaaaatgtatagttaactggctcgtatttaagtaaaaaatgcatgattttggactcattctggctgctgctgctgtgaattataatgatggtaatagtttcagcagttcctaattgtgtggctttgcacaagttacttaatctttctgacctaatatcttcctttgtaaagtggaaataactattgtaaattgtagactatcatatatgcaataaccattatataaaacatataaattatgtttctaaaatcgtgctcaatgattggtagatgtcatttctttagactaacaatggattccctgttctctgctttcttggattcatggaattctcaacaaaaatttttcagacaccatttctgaatctggcaactctaaacctgaactccgcatatcagaattgcctaccttcagtgttatatcccacaggaagattacatcatttgaagtgatactgcagaaggtacctcattatttatgcatattatgaattattcttggataattgctacacatgtatttaaagtggaagtattttcaaaattatatttctacatcaaaacaagacataaactctataatattcattaagtaaaaatggtgataggaatatttattactgagaaaattcttatggcataatttatggtgctttatttattaaagaacctgaatttctaattgattttccctaaagcatgggtgtaatgtaaataactgtattacatgtttatatgtttgttcatatgttacttgtaatatttataagttaactgttggcatcaagactatttttattgtaagctcttaaaggtcaagtggtcttgtttaatttcatacatactactctagttgaatatcattgtattagttatctggctgtattagtttactagggctgcataccaaaatacaagccactgggtggcttaaacagcagaaatgtattttatgacagttctggaagtccaacctgagggtgttggtaggtttggcctctcctgagacttctcttcttggctttcaggtgtcaccttttttctgtgtcctcacgtggcttc

SEQ ID NO: 469424 - DNA, 569 bp, Homo sapiens
cagcacccccaccccaaccatatggggaataatagcaccccgtctcctcccatggcctttaagaaattggcttattggattaagaaggctggcaagtccaaaatcttcagggtgggttgcaggctagaaacccagagaagagctggtgttgtattacaagtccaaaggccatctgctgcagaattccctcttgctcaggggagggaatcaggaagcttgtctaagtcgtctgaccttggagtaaatattcaccaggtgaacattagaggaagccaagcacaatctcgtgaaagcttagacgttggaaagaaaggaagattcagagtctccaaagcactaaatgagtttggtgatttgcagcctgtggaaggcgagcgtgttgtggaaggtcaagtggagaacatgtttcaagatggacactatgatcaactatgacaaatgttccttagaaaaaaaatccccatcttatttaaaccactgttattttggtctttctcacagagttgtactgatgaccattttaataaactcttttataattcactcgtcctgaaataaaactttcttat

SEQ ID NO: 469425 - DNA, 822 bp, Homo sapiens
tcccctttgatattgggcgtaatagcatcgtcccccaacatggatattgggaataatgtcacaggggggatgtacaccttcttcgatattgggagtaataccatcctctctccccgggattgtaggcgaaatatcgaagaggttttacaacgccatagtacaggaagtcctagccagagcaatcaggcaagagaaagaaataaaaaccatccaaatagaagagacaaagtcaaactatctctcttcaaaaacaataagattttataccacagtctatgcccaaaagctcctggatctgttagacaacttcaacaaagtttcaggatacaaaatcaatgtataaaaatcagtaacattttatacagtaacaacatccaagctgacagccaaatcaagaatccaatcccattcagaataactacacaaataattaaaatacttaggaatacagctaactagggaggttagctgtatctccataagcagaacttttaaaagggccattatttttaaaaacccctcttcccttcaaaacaattgttcattaacatttttttaaaaagtatatgagtttctatgtttaaaaaaattatattgaaaatttttctctattatcaaaattatttttcagtctgcatagttttccattgtatgaaccaatccttatttggggatttccctgttgttggctgttaattgtcttttcagattttatctgctatatagaaaactgtattagtccattttcatactgctataaagaactgcttgagaggggtaatttataaaggaaacaggtttaattgactcacagttcagcat

SEQ ID NO: 469426 - DNA, 700 bp, Homo sapiens
ctccggtcttgaggagaaccgaaatttcatggctcagatggctccgggtatagcttgggctgccgctttgaggaatgcaagccatagcttggtggcttcccagtggtggtacttcacaagccttcttgtgcttagtaatactaaccagcatttcagcattgcacttgggggccattgtaaagtggaaatcaaaatcaccaatgaaaagcataaagatgaaaaaatgtggcactaaattgaccctgaaaaggaaatttggctacagcatgagcactgaaataagaatggaagaagagatcttaagattgctcattacaccaggacctgggaacgtaagaggtttggaattcaagaaaggttctttgagtaagaagcctgagggaaaatgtggaatgcagatcgagcaaactaacacaggaacagacaaccaaacaccgcatgttctcactcataagtgggagttgaacaatgagaacacaggacacagtgaggggaacatcacacacgggcttgttgggggattgttgtcatataattttgaatcagaaaaaggttcttagttttctttaaaaccattccactccgccatgctgcccttaattatgttatttaattataagtcagattagcaacatattatacttcagtggcttttgatttagagtagttacaagatatctaccgtttctcatgcttggtg

SEQ ID NO: 469427 - DNA, 879 bp, Homo sapiens
tctcctctgagctgttagcctgcgggaactggaaaataatgaggaaccaaggcactctctccctggggctacctggtctttgctctgtttctcgctgcatgccggctttgttcttgtcatcagcggtcactttacctgcagttcttcttctgctagagtccccgcagttccagagttcacgttacttcaattcaagagaagagctcaaagaggaagagaacctctcagctgcaattccaaaatcccgctccgtagcatacaaagtggaggatgctcaagaactctttatctgtgtctacacgctgtccctaaggggccactggaggctcctgtgtgaaattggtgaaggggtggtctgctttgggcagcttcaatcctctaccccagccagaggcccagggatgatccgttttcatgctgctaataaagacatacctgaaactgggaagaaaaagaggttaatggacttacagttccagaggactggggaggcctcacaatcatggtggaaggtaaggaggagcaaatcacatcttacatggatggcagcaggcaaagagagagtttgtgcagggaaattcccatttttaaaaccatcagatcccgtgagacctattcactatcacaagaacagcacgagaaagacttgcccccatgatttaattacctcccaccaggttccttccaagaacatgggaattgtgggttacaattcaagatgagatttgggtagggacacagccaaaccatatcacttaacaattcggttcttgtcactaaaataacatgcattgacatgtattgtaattatatattttcatggttaacatccactagacaatgtggaccattgagaggaaagaattatattttaatttt

SEQ ID NO: 469428 - DNA, 698 bp, Homo sapiens
agactgcctggcttctaatagatgattcagtattacctagctttatggcaatggtcaggttacttcgtgtttccaagcctcaattcgtttccagcaagttcctcatctccacctgagaccacctcagcctggactgcattgtccatatcactatcagcattttggtcaaagctattcaaccagtctctaagaagttccaatctttcccgcatcttcctgccttctgagcactccaagtctctaggaagttccaaattttcccacattttcctgtcttttgagccctccaaactgttccaaacgcagcctgttacccagttccaaagtcgtttccacattttcagaaatctgaagtggggtctgaagaattgcatttctaaaaagtttttatatgatgctgatgtggctggttcagagaccacactcagaaaaacactaatgaaagaaaatatcaactgacaaaacaggaaacttttagaaaaaaagttcaacaactaaaaaataaaaaagttcagtgctatgtttaatagtacacaaagttggagaaaacaaaaaatatgtgaataatatctaaaatagtttcggcataaggcctttagtccttaagcttccctcgacaaaccaatcaactgtaattagtaagtgattatttaacaatagtatattttctcttggtcatacatctaaacatcaccttt

SEQ ID NO: 469429 - DNA, 635 bp, Homo sapiens
caggtcttcacaggccagaaacaacagggcctagactcagaggcccagatcggcaggaaattgatctctggcgtctgtcacagaagtatgaagctctgcaaggtagagtgtagtattacggtgcaggtgcattgcggagatgacgggctgatggcaagcaaggtgaggaagccctgttctctttcacagctgaagacagagacattgcagcgacaaggacaactggcatgcctcacattcctcagtgttgaaaacaataaaaggagggggaatgagagaaaaatcaaatttctacgaagagatgtcagcagtaaatttaatgcaggtgcaatattctccaaacaaaggacgttttgtttctaccgtctgggctctgtgaaaacctgctccacctcctccttgctatgtgttttcctttttatctgtgtaagctgccacaaacagagtgaatgcagagccatcaagaggtatgactttctgaatggccccataaaatctggatctgcccatgaaacctggatcagcccagagattatggagagatagatatttggaagataattttttatgactcaaaggttataacatgggaaataagtatttaataataagtacctatccagtgcagcttcctt

SEQ ID NO: 469430 - DNA, 1436 bp, Homo sapiens
tgatcgggctcgagcaggtcctgaaggtgcaacctgcaccgatggcctcatggggagttccctatgatcagttgacagaggaggagaagactaggacctggttcacagatgtgcccaattcgccagtagcagagaccaacactgggaccttgatatggcaccattcctcgggtgatcagccagctacctggtggcaagtggattatattggacctcttgcatcatggaaaaggcaaagatttgtcctcactagaatagacacctactccagatataggtctgcctatcctgcactctatgcttttgccaagactaccatccatggactcacagcatgccttatccgccaccatggtattccacatagcattgcttctgaccaaggaactcacttcatagccaaaacagtattgccatgccctgtgattaaggtcaatgggaaactacaacagcccaatccaggcaggactacaaatggcccagacccttcaaaaatgaaggtttgggtcactccaccaggaaaaaaaccaagacctgctgaggtgcttgctgaaagcaaagggaatccagaatgggtagtggaagaaggaacacatgcagtcttgaaggtgtgctcctaccccagtgctcaattaagatgtaggggtggaggattattagaccagagggaatttccaagatcagcgagtcttctgggagagcagcagaaggataaaaacgcaaatatcgaagcacccacaataaccccaaacccctgttgttgggctgaggccctctgttcctttctggctgttgaccagaggctgtcctcaattccttgccaggtgggcctctcccagatggcaacttgtttatcaaagcatgaaaaccaagaaggtgataaagaaagtctgctagcaagacataagtcacaatcttttgtaatctatttatgaaagtgacatcccatcatcttgaccacaatctattgattagaaacaagtacagctcaccctcaacaagaggagataatatccaggtgtgaattgcacaaggtgagtacaacaagggaccatgttagaggttgtctaccacagtaatcattagagaaatttagaaaatgaagaaaaattgaaagtaggctttcaatgtgatagtcagttgctcacatttatcttgcttctattctttccagtcttggcttctatgactaagttaaacagacaagcaaacaggacttagttatgctctataaagtaaatcttatattttttaaaaagttaccataatgctgtagtgatatttccatataattacagtgctttctctttagaaacataattttaatagttgcattaaggtatatcgggtggtttattattattaaatactcttttgtggctagcatattctaattatttttctgttataaatgaagacactgagcacctttgtag

SEQ ID NO: 469431 - DNA, 994 bp, Homo sapiens
aatcaagttgacactcaaccattggaaaagcatagtatctgggctggatagcaccatctcttatggcacagaccctcatggcttccctgaggggagggagttccctgaccccttgagcttcctgagtgaggcgacaccccaccctgcttctgctcaccctccatgggctgcacccactgtctaaccagtcccaatgagatgatccaggattccattcaggatacttcattatatgtagagttgaccctggaacaacataaagaacacattttcaatgggacgtcagatgagtgggtaacagggcattggggctaccacggagttccaatgtgccttatggagctagaccctgaaggtggtagaaaggggagtaacagagatctctcatgtgcctttgaggatacctgggccacctggcaagaagccaggtattactattggatggaaaatgtcctgaggctagaaacagccagtccaacatctaagtctaaggaaaaacaagaaattttcaagcaagcaggaacattcaaaccagttcaatgtatacagatacaaatatatgattgttctgtcttcagatgcaaattgagtacaaaaagaaaacccagcctggacttcattaggtagtgccaaattgttttccaaagtggttgtaccaacttaggcttctatcagcaatgcattaatgccttatcagacatatgattcacagatattttctcccattccataggttgcctttccatgttgctgattatgctctttgatgcacagaaaatcttaatgttggtatcatccagtttatctattttttctttggttgcttatgcttttggtaccatatccaagaaatcattgccaaagccaatgttataaagtgtgttttacttttaatgaatgtttttctatttcaagagacctagatagaaaatagtttctactggcaaataatggaagataaaggtggagtcaagacaggttaggactactgtgt

SEQ ID NO: 469432 - DNA, 564 bp, Homo sapiens
cacctggagctgcctgccccactgtaccagccagcagactgtgcacagtggccagaccccatgctctctccctcacacacccctcactgctccatgcctggcttgcccttggcaggccctgccaggccaagtgggcagaacaagctaagcaggcccgagcaaaagtcaagcaaaggcaccactggccacagagatttccagccagaaaagcaacaccccaaagatcccataaccatagcaaaggtggcagcccactcacctgggctgatggctcagtgtgactgggatttgggtgtgatgggggatgaaccaatttggggggaattagttggcagtgccaggctacgatatttgggagcttacgaacaagtgggccatgacagtgtctctcacagctacgcttggaataaaagcaaagatcctgcacttcactatactaatgccaacgtggggagaactggtttctttacaacccagagagcccaatggaaagtggtattctttgtctccgcaaaactaaaataacaagtgtttcttgcagggtacatgtgcacaatgtgcagg

SEQ ID NO: 469433 - DNA, 694 bp, Homo sapiens
gtcacttccaccacattctcttgggttatggcttctctctaccgcataatgttcggggcttcagtttgggagacttgcatggctagaatgtctcaaacaggcaggtccagaccgtttgctcttttgtgctcccagcacctaaatgttggctcttttgaagcctctgatgtcccgcatgtgaatgtcttctctgtgtgctggcatgacatcttaatccacagacatcttctgttctaccatgtcctcctagaaacccagggcagtaaccaggtcacatctgttgagaacgccctgcatcctcttgacctccaccttgctgggggcccagacaagggtcatgggaaaagtcaaggtctctgtgtgttccctgcagagtctggagaaggagcatggtgctcgtcatcccaagcctgggttggcagtgccacagcatgtttcctgggggcaaacgtatcattcacaactgatccagccactctttgtcttttgattggacagtttagtccatttatattcaatgttattattgataagtagaatgtcatagagtacttagtcttttcagactggcttctttcacttagcaacatgcttgtgaggttcctccatttcttttcatggctttggaaattatttctttttctccttgaataatatcctgtattatagatgtaccatggtatttttatgcatt

SEQ ID NO: 469434 - DNA, 857 bp, Homo sapiens
ttatctggatgtgtccatcaagtgtcatggctttaaagaccatacatctgatgactatgacatctgtgtcctcagacctgatgtgacttcatcaccgtgtgaacatgagagtatacttacacaaacccagatggcatagcctactacacacctgggctatgtggtatggcctattgctcctaggctacacacctatacaacgtgttactctaccaaatactatatgcaagtggaacacaatggtaggcatttgtgtatctaaacacagaagagagggacggtttgatggcattgctccaggggaagattacttccccactccattcccctttcagctccccttcctgctgagtaccactttcatcagcaataaaacccccacatttaccatctccaatttgttcacatgctgccacggggccacatggagttttactcctgccagcacccaaaagcactcacctcggctcctgcacccactcgcatgtgctcctgctcctgcgaggggtggaatgaagcaggaccaagtgaatggagtccatccctgctggcaccaacacacctgtgcactctagttcccacctgcgaaggggtcaggtaaaatttcctgcttcagaaggaatacactctaaaataaccataaaaatatagtatattagtttgcaaatattttctctcattcttttgctactctgtaccttttaagtgagggcatttatactgttgacattaaaggttaatattggtttctgaggttttgatcctatggcgaagctgatagctggttgctttgtcatttctattgcatggttattttatgcggtctgtgagctatgtaacttgtgtgtttttgtgtt

SEQ ID NO: 469435 - DNA, 834 bp, Homo sapiens
aactgcccggatgtacaggatcctggaaagctgctctctggcccagtgttctggacccttcaaatggcaattgatcctctgtgggtttatctgcagggctttccaatgtcccagagctccagatgccagccctgccgtctgctagctgcaccaccttgggcaagtgacttgagctctctaggccttagctttctcatagactctggaaaggaggaggtgagagcagccatggctgacacctccatgttgggtcccctgagagccatggccatcttgggtttgacgcttgcacgtcagcctaaaggatgcatgatcctggcagctgctcaagccactttctttgttcttccacaaaaagcaactcctcatcctttaaagtttgatcataagattgcaattcatcttatgggtctaattgtagttcttttgctatttctaccacatcttcagttacttcctccactgaggttctgaacccctccaagtaatccatgagggttagaatcaacttcttccaaattcctgttaatgttgatattttgacccgtttttgtgaatcacaaatgtcctttatggcatgtaggatggtgaatccttttccgaaggttttcaatatactttactcagatccacaagaggaatcactatggcagctatggccttacaaaatttatttcttaaataataaaacttgcaagtcaaaattacttcttgatccatgggctatagaatggatgttatgttggcaggcaagaaaactacattagtctccttgtacatctccatcagagcccttgcatgaccaggcgcattgtcaatgagaagcaatatttc

SEQ ID NO: 469436 - DNA, 554 bp, Homo sapiens
ccgccattggatagcaatggccaccttgcacccaggtgaagaaggggaatcagacgaatcagtagacagcacaaggtcaggcccctctgtcgcaggtctgctggagtttgctggaggtccactccagaccctgtttgcctgggtatcaccagtggaggctgcagaacagcaaagattgttgcctgttccttcctctggaagatttgtcccagaggggcacccgccagatgccagttctggagatgctgccccatggcccatatttggagctgatgtgctgaaggatagagaggaagagaaagctgtagttcctcaccagagccaagcagcccctctgagagggggcctcatggggactagaatccctgcaaatttgacctcctgctccatggcacctgcttttcctcaggctccagcagaggaaaagtcacgtgggtcaggccctgcagcaggcggctcaggggaaagcttgagtggaaacaggctggcttgtgctcctgttctcgcttgatttgcttcttttcttctttgtccatctctgacttgcagccttt

SEQ ID NO: 469437 - DNA, 908 bp, Homo sapiens
atgcgaagccacctcttgcatcagcatgacctggatactatccttatgttgccaaaggaatgtcgtaaaaatggaagaatgcagcctgaatttaggctacatgaactgttgcagatttcatgtagatctcttggaacattttaaactgccatataagaagtgtaaataccctgagaaagcctattccatgaggaagccaaaatttgtcatacagaaagaacatgtaaagggaaagagagattttgtccaacctccattgtctcagtcattcctagcacaaatagatcaaaccagttataacactcccttaaaccaatgcttaatccagaacaaggccctaagtctctacaattctatgaaggcagagagagatgaggaagcttcagaagaaaaatcggaagctagcagaggttggttcatgaggttgaagaaactcatctatctcgatcacataaaagtgcaaggagaagcagaaagtactaatataaaagctgcatcaagttatacagaagatctagctaaggtaaatgatgaaggtggctacattaaacaacagattttcagtgtagacaaaacagccttctactggaagaaggtgccatttaggaattttataactaaagagaagtcaatgtctgggttcaaagcttcaaaggacaggctgactctctttttagtggttaatgccggtggtgacttttaagttgaagcaaatactcatttaccatttcaaaaattgtaggtcctttaagaattatactaaatctactattcctatgctctctacacagattaacaaagcctgcatgacagcatatctgtttgtgctatggtttactgtatattttaagtctacttttgagacttactgctcagaaaaagtcttttcaaaataattgctgttgatc

SEQ ID NO: 469438 - DNA, 957 bp, Homo sapiens
aaaccacttccaaccgggcagatggagcgtgggtggggggaacatcagggggtggcatatacagttgcagtgtgcttgtggggcctgcccacagtgacagatctggaagactacaaggccttctgtgggtcctcagtgctgctccctgcagttgctgaggattggatttctatcacagactataagccacttctggattctgagacaaccaaccttacgggggacatcaggcctcaaatggtggtggatatagaagcaatcccagaagggaagccaggcaaacaggaagaggcaactcttcccttttatgtgatttgcaaactgagcaaagcttcccagaaagccttgaagatcctacagttcttaacagcgacccaagagttagactgtaacagttcaggatgttgtggtggggcttcatggcctgagctgccaaaattgattaaacatttctgcagtatatggtatagtctgacctgagaaagatgtggattaccgtagtactcgaacatcgattcctttgcatttttcagagaagagcctggaattctacaatatctgtaattatatggacttcttttgtaaggagctctttgtagtttaccagatagtcattttatgcctggaattgaagtgtaataaacttagtcttactgaattgatcacagatgatatacttaaaggcagtttactgtttagtaaggcattctttgggtcttctcattcaaatgatagactgtatcctcagaaataagtgttttaatatgtaaattttcttaactatcagagaagtcatttcattaaacattttgaattaatatcaaagtgggatattgataggttaggaagataaaggaaacaacctttgtagtctgtcagtttccctcacaaattactaatgttttcctaaagttagcctcagagtccaccttatgttgtacatatataacattttct

SEQ ID NO: 469439 - DNA, 913 bp, Homo sapiens
cagaagagacaggaacccttcctgctctaactggtttctgctgcagctccggccgcgtggctccaagattcactgccatggcctgagtccgagaacgtgattaaatctctgagccgttcagcctggagatggtgggcgcgtgtgcagcgggaacgatgacttacaaaggacacgatgtgcgaaaaagccacaaagagtctcccttgggcaggtttggtgggagatgtttgggatttctggtggaaatcacagagccctagagctgacaggggcatggaggggcgcgagaggggctcatggtccctagggaataagcgttctgcgccctgcggcactgaaaataactccgtgacagggagcaaatcatcgcatctttatgagtatcggttcccacttttaaaaatggagataataataatggcacctctcctactacaaaaaggttatgctgagaaacaagaagagtgggctgaagtagcaaaaagaagaggctgtaagaagagagatgcatttttatcttgggccaagagggagcggatccacttctcaggcactgtggtgaggatttggggtggctggggtcagggtggggcatactcctccttattacttcctgtgctcagaccacagccctcagaggggcttagaagatttaagggacatgaagagccagccagagagccacagacgaggcagaggagagggacagaaatagatgcacacagaaagatgacgacagagaaatacatacagagagggagatagacagagccagtgagagacagaaatagccagttaccaagagagacagaaagattacaaagatagacacaggaagagagagagggaaagagagaaagagatgggggagacatcataatcatagcaaatacttatatcacacttattatgc

SEQ ID NO: 469440 - DNA, 562 bp, Homo sapiens
tatagtaggggctgaagattacatctgggatgatggtcattcatgtcccaagaacttgtagcactgcaggtcaccttgttgcacaatttgcggaccatagcgctcttctttttctccatttgccagttgaatggagagaactttgaggatttggaggatagtgaagacaaaatggagcctgaatggaaatgtggagatttcgagaagaagaagaagcgaagaagaagggaagaagaagaagaaagaagaagaagaagaagaggaggaggatggggaaggggaggggaggagggggagaaggagaaggagaagaagaaaaagaagcagaagcaacagcagcaaaagcagaagaagcagcagcaacattcacaaaaggagcagagcatcaccaagaacccaatacatggaaattccaaaaacactgaattaattttgaaagattttaaatgagagaaatatagtgagaatgctttctaaatgacctttgtttgatttaaaattttagctcaaattttaactctttaggtacagcctctaattcagatttcagatttttaacatg

SEQ ID NO: 469441 - DNA, 627 bp, Homo sapiens
gagaaatttttttcttttggacctgaccaatggacaccaagactgcctccaagtctctgccacgatgaccattctcatacagcttccctcatggactcacacacctgcagtggaattgaagcatccaagttactccatatctccaaagccacagccgtgctgggtgatgagagctaggagacagaatcttatactattatatcccaacctcgactattgcaacctggtaaactatgcaaattctatcccaggcctcagagatgagggagaggaagatgggaagaagaaggtgcttgatgaattttggtggtttgctgttactgagacatgggcctattggaggcacagaggcctgatggtgagaaaaccccagttaccacaaagtcagggaaagctctgtctgaggccctcttctgtgacttggaggcctatctcagaaagctctacttcctggaaggactatcagggtgttaaagtgtcctcgctactagagagaggactgatccttttagtgcagaaaagcatcctcatccacttatgagcctttcgtgtagtgtttaaagaaagtgttgtcatttaagctgatttgtggcccatcagaagactcaatatccccaaatttggatt

SEQ ID NO: 469442 - DNA, 1974 bp, Homo sapiens
tccaactccttgcacacctgctctctcacagcttctttctcagtctaggccagcatcaccatggtagatgccttcctgtgcacctggaagctctcagacagcaagaattttgatgactacatgaagttaatcggtgcaagttttgctatcaggcaggtggctagcatgacaaagcctaccacaatcatcaaaaagaatggggacattatcaccttaaaaacacagagcatgttcaagaacacagagatcagctttaagctggggatggggttcgatgagacaacagcagatgacaaaaaggtcaagtccattgtgacactggatggaagcaaactttttcacctgcagaagtgtaacgggcaagagaggacacttgtgccagagctaagtgatgggaaactcatcctgacactcacccagggcactgcggtttacactcgcacttatgagaaagaggttattagttattgacttaatttctgtaatagatatatgcctattcacaatatctatttccctttgtgtgagtttcccatatattccatatatttccccttgtactgtgtgtctttcaagaaattggtccattatatttaagtgtcaaatttgggggggtggggcatagaattatctataatattcctttgtcaccatttgaatgtccatgggataagtagtaatgacacttttttcatttttgatataaggaatttgtatctcctctctttttcttcatttgtctggctagcaatttgatcaactttattgactttttcaagaaaccgcacaatttccctgtgacaaatgtaccaaaccaataaaagatgttgatcatagtgcaaactaggtaaggatatatgggaaactctgtactaacaagttttctgtaaatctaaaactattctgaagtaaaaggattgtttaaataaataaaaatagatacaagcaaaattcatatatttgatgtacacagttcataagacacatgtaaaacatatcgacattgacaagaaagtttgaaattgaggtatacttatacttcaggaaaaggcatgggtagaaatacaaatatcagtagcataaacaagatattgataccacatacatcaaaccaaataatataccttattttcacagtccagtgagatacttattaattttctgaccacaatacaataaaactagaaactgacaacaaaataaaatttaaaaagtatcttcctggaaataaaaatttgatctataaataattctttcatcaaaaggaaagtaaaacttgaattatacattctttaagaattaatggcagtaggaatactccatagaaaactcaaaaaatatagccaatgtcactttcaatagaaaatccattacttttaacattgttatcacataagaaaaatttcaattaaatcaaaaaagcattcaacttaagaagctaaaaaaacaaaattaaaaaggagtaaataataatcagaaataaattatttagaaaaaaataaaagcatcagaatgaataagatgtaccattgaatagatgttaaaataaactaacctgtgagaatagaaagcacaactgcataatattgggaattttttagagagtttataaccctacatagagatcagattttttcataaaggaatactgtgtaaaaaacttatgactataataattgtaggaaattaaaattaacagaatttgctcaagaagagatagaaaaactatttttttaattgaaaacacaggtaaagatttacaccctgaaagtggataaggcctgattaattttatagaaaagttacaacaaacattcaagacatagataatctctgtgatatttatgggttttagacaaagaaaaaatctgaaactttcccatttttttaagacttacatagctctgatcccaaaactcgatcatgacaacaaacagaaataactgccttatagttttgttcctgaatatttat

SEQ ID NO: 469443 - DNA, 551 bp, Homo sapiens
tcagataactaaaatacctcttagtctaggccatcaccaataattctaaatgacaaatgtttcttctaacaaccccacaatgtcatcccttaccacaaaagcttccttcaacttaatctctcccactctaggttcccacgctgcccctaatcccgctcgaagcagccctgagaaacatcgccctttatctctccataccgccccccaaaactttcactgtcccaacactttaccactatttcattttattgttcttattaatataagaagacaggaatgtcaggcctctgagcccaagctaagccatcatatcccctgtgacctgcatgtacacatccagatggctgaaaccagaagtctagtttccctcaacaacccccgcccccgcccacaacacgagcaatggctttctgctcagtcctggttgacttcccttcctgcgtctctacggaggtcccaccatgctacacattctgtccctcctgggctccataaggataaacatcaagtgactcaggaagaaatattttgtggttgatatattttaaaac

SEQ ID NO: 469444 - DNA, 624 bp, Homo sapiens
ctgtctgtagcctcagtgcaaacgatgataaatgatgaagagccggacaccaagtggatagttcccttgacttcgaccctctttgaggggtgggaactggagttacttacttcactcagcctgcccctggttacttcttgtaagagggagcctatgagcaagcaaatgtgggaaccagagggaacaaatgctggaactagtcagtcgctcctctctggcaggagcaggctctgtgcagttcccacagcagcatcccagcccctgccctctcagcacccaacttacaagagccctctggggaagtcaaggcaaggcactgagtgtgtcctggggacctgggctcaggacattcggggcacctggcagggctgttgtgtggagcaggaggctcttctgaaagtggccctgcccctcctcctgatcaacaagactgccctttggaatctgctgttaaccaagtctaaagttatcttctgccccctttccctggcctccttatctcttgtaatatgttcataaaggcagaatcggatgaaatgaatagcctgtgctgccttctttttatttatttatttatttattattatacttcaagttttagggtacatgtgcacaatgtgcagg

SEQ ID NO: 469445 - DNA, 541 bp, Homo sapiens
acccaacagctccgaagagacagcaaccatcgagaacgggccatgatgacgatggcgtccctaagtgataaaacgccaggattctcaccctcctgtcatgtgtttccctctccaagacgtttctgctgtgagcctgactgccaacctctgttcccaggggtgaggctattgccaagagaggatccaatacaaaaagcaagtcaagccaagagtgtacctgcagagtgcacacttcccctaaacactcaaagtattgggctgttcttgaaagcagctgtcttcttggatcatgatgatgaggccaaggctgaagctccctattccctcttttgcctattttatgagcccagcaccatctgggatgatatttggcttttgaacctcactaagaaaacaaaattagccctggatgaagttattacattgcaaatatctgattgtcattcagagttttctgtgatctaatcagttctcatcaagttcatatcatccaaaaagcactctgaggatagtgtgtcttgtaagaaatagctcaccttca

SEQ ID NO: 469446 - DNA, 1070 bp, Homo sapiens
cactgtgagctgaggactactgtaggtatggaaatgcacctgtttccgaatgcctttgccctcctcaaactcccccacaccctcctggtgctcagtcatgaccttgccctctacagattcaaaacgctcttcaagacctttccatcacagctcctggagcctctacttctttccatttgcaagccttcaggatactgtaggagccccttagagcagcgattttcagtgtgtttcctggaccagtggcatcagcagcacccgaaaacttgttataaatattgttctcatgccctgtctagatctactgaatcagattctgggagtaaagtaggccccagccccctgagttttaacaagtcctccagggcagtgcagaagggaaatgtggggccggagcccccacacagagttcccactggagcactgcctagtggagctgtgagaagagggccactgtcccccacatcccagaatggtagatccactgacagcttgtaccaagtgcctggaaaagccatagacactcaacgccagctcgtgaaagcagccaggagggaggctgtaccttgcaaagccacaggggcagagctgcccaagaccatgggaccccaactcttgcatcagtgtgacctggatggaggacccagcccctgccctccttgtgctcctgagtttacagctttcatagctcagctgtttcacttcttctggcggccattccaggaggcaagagacacctggggagcacctgtgtcatctcttcctcctccttggggaaccacaaacttcaccagctcagtgaaagcaaaccaaggattaagtgaaaacaccagcaaacaaaatcgataaatcagtaacttaaagaatggaccttcgaggcctgctgttcagagtgctttgccaagtgacgtaagagccaatgacttgagatgcagaagaaaagttgggaatgattttccttagcgggaattcatttattttgctggctgaatagtattccattgtgtatttacaccatattttctttatccactcatctgttgctggacacttaggttgatttcctattt

SEQ ID NO: 469447 - DNA, 768 bp, Homo sapiens
aagcaaatggtatagtagacccaagggagtaaagaggagcgagaggatgagagagcctggaactggccctttagggcttctagtatttaaaggatggcctctttgccccaacgcataagctatacagatgtgaaagtgcttttgaccccagaagtgacatttactccacatagtcatttttcggttattttatgtgtccccagttcattattctctagaggagaaagtaaagtctcagaaattgggttctttgttcagatgttcactttaccactagagttggactctcccattactgtgccttcttgccctttggtcccaagaatggacatgcacagatgtgaattcctccactacatttggcatatgggcactggccaagtgttgatttttgttgctgaactaaaatgtcccttttttgcttatggaggtctgagctaagtatttgtcatttgttattcaaagacttctgactaacagtatctccaacgtagcttctttgggaaaccaaatttaaaaaatggcaggaaaattaaggtaaaagacaacatgcttgccctttttgcaggtgaagctttgatgatagggtagtgtataggtcaacatttttgtgatgattttaagctgacttaagttttgtgcattgtggaatgagtatctgcaactcataggcacattttacctttgtgtgcttgtacaatgatcttcaagcacataatcccctggatctggttgaagtgaaaattaaaatgatttcttacaatttgt

SEQ ID NO: 469448 - DNA, 737 bp, Homo sapiens
gaatccctggcatttaggagaacagatgtgaaaccaggcggcccagaggaatggaggcagtgccctgggcctgaagattgctagttctcgtccaggtcccttgggagacccaaagctcttccagtttgtggcttctatgacatactcctcaatcttcaaccagcttcctatgtggaatgtggggactggagcagtcatcttgcgctatgagatggaggctgtgctgagaatgcttggtatccgtagttttcatccatgggtggttttgccccgcagaagggatatttatcaatgtctgaagacatttttccttgacataaacgaagcgtctagtgtcaaggccaggggtgctactaaacagcctccaatgcacagggtagcccacatagccaagaattatgcagccccaagtgtcaatagtgccaaggttgagaaaccatacttcagagataagagaagcaaagacagggtggaggcttctaccctggtcccctggggcaggccattgtttgcaaagggcacagagagtgagcaggggcaggggctggtcctgcagctctgccccagtgatgtcatcgagccctggaactcggtgcccttcctggaagggcttcgcctagatggagactgacctgacaggaatcggctccacctgtggacgtacggagttggactttgtcccaaaactgtgcctgtgacatacattcctaccttcacaaggctccttcatgccaatc

SEQ ID NO: 469449 - DNA, 1005 bp, Homo sapiens
gtattttccattatagaaactgtatctgggagacaaacgggatatggctcaagccatcctgcatccacaccacttccaagcccgcatgctccactggaagccatcatcttcctccactccagcaaacagaccacattgtaatgatcccaaggaccacctgacgcagacctggatgagaaaagttgatccaggaaatccaggactagggagctggccggcagtcggatcagctgggatatctgttgatggagggctgtggaatggggggaagagctggccggcagtcggatcagctgggatatctgttgatggagggctgtggaatggggggaagagctggccggcagtcggatcagctgggatatctgttgatggagggctgtggaatggtgggaagagctggccggcagtcggatcagtggggtatctgttgatggagggctgtggaatggtggaagagctggccggcagtcggatcagtggggtgtctgttgatggagggctgtggaatggtgggaagagctggccggcagtcggatcagctgggatatctgttgatggagggctgtggaatggggggaagagctggccggcagtcggatcagctgggatatctgttgatggagggctgtggaatggggggaagagctggccggcagtcggatcagctgggatagctgttgatggagggctgtggaatggggggaagaactggccagcagtcacagagcagatgtaccgtgagaagcctgacagtagagactgggcttccctcaacaatacttgccacggagggatggtattttcccacttgagagcctccatttcaggttgtgctgatcacagggagagagagaaagactctttagaaacagagcaatatgtgaagccactaagaagaatctaaaggtttccttctaattaaagggattactctgccacgtttaggagacagaaaaatgctgccccctaacattctatggagctgtacacatcacagtgtac

SEQ ID NO: 469450 - DNA, 1404 bp, Homo sapiens
tgggcatcaagagggagcactggtctggaggactgagagtgccctgacccttccaggacctcgccccttgagcctgcccctcccgtgagggtgatggctgagaggggctgaggaagaaccagatgacaggcaagggctgcccgggccgagaagggctgaggaggaacaggccacaggttgggtgtgtggtcaacatgggagccagcactgagctgccccgcagctcccaggggaagtggccaccagccctggacttctgccaaggagtctcccggaaggacagcagggcgggtgggcggtcagggtcaggtccacgcttgtgctggtccgtcctggagctcgccatcccgggaggggtgcgccaccgtgggtgcaggggcatgtccaggcctcagctggtgacttccagacaaaaaatgcccaagcaactctgaggcctgagggcagcctacggggagcggccacccgctgagtgtgggagcaaccaccgtggggtcgcaatttagggggcttcgttctcccggacgccagattctgcgacctgagagtctcatggtggggctggcctgccttgaatgtcaccccttgaccaacaagagcttagacggaggcttctccgccgtggctgtactgctgtcctggacgatctctgtctgttgtgggggctgtcccgtgcactgtgacatgttcagcagcatcccagccctccacccacagggttacagtagcacccccaccctcaaccatgacaaccaaaaatggcggagcaagctttggctcccacactgctgctggtcaagtgaggcaagcactgaggacaaggccctggaaaacttggcaagagcatcacgggttgatgggggaatccgtgctccacgcatagccgtgacggctgtgacctggctggacactgtgatggattcccaaggaggtgtgtggtggcccaggaagagcaactgccatgtggacaactcaggaggaatggagagcaaatcccttctgtcccacatacactcaaggaagctgacccgctcaagtaatggaggtcgggggaagggggttgagaacctggactccacaggcagggggtctacactggcactggtgaagcaggcagagcctcaggcacctccggccgcatcattgtgtcccggggacccagcagcccaaaagggctacacggactttccttgcagagccacacagaggatttctttcctctactcagttctaaaacaacgtctcttgctcccttcagtaaggcgacccctcccatggcacagctaatatgtgtgagtagaaaaataacagtgacacaatccacacaagatccatggagcagatttatcttaggatggaatttttcaatgacacgtgttaatgtgtgtgaacctcctttggtgg

SEQ ID NO: 469451 - DNA, 621 bp, Homo sapiens
ttttattaggaatatggttacggttcctagggaaaatgttattaatcacgacatccattcattttgccagcaagcatttattgactggttactctatgcagcaactccagaatctcagcagctgaacacagtaggtgtttcagttcttgctcctggggcatttcagtgcctgtttaagcaggcggtcttctacaaggggattcaggacccagactctttccatcttaggctccatcctttcctcaggccacccagttctgcgttggatcctgtgtgcgtggctgcagagggaaggaggaggggccacgtggaaggcttttgtgggccagatgaggcagcaaagccaaagctaattgagccactcgactatgaaaatgtcatcgtccagaagaagactcagatcctgaacgactgtttacgggagatgctgctcttcccttacgatgactttcaggaaatggcagcagcaaaacgcatgctgaggggtgatttactgcacttaaataatttagcagtataagttaactattaaaataatagaacttggtgtccatttctgccaaatatatttgaaatgacaatttactaaaatataagcatggatagtggtgatgcttgtgt

SEQ ID NO: 469452 - DNA, 639 bp, Homo sapiens
gataaaaagttcatcttgatttcaaacccgaaaatccttaggactgggaaaaaatgctttacaataaagatatgccaaaatgatttttttaaacgattatgtacaattctttgtcaatagcagatgtttttatggacacaatactttgttcagtttgaggagtcaagtagtgcaattaaaagccaagttttcagatttactattcaggtctggcaagaaaagagaaggaagtatgaactttattgaatttacatatgaaactctctgctccgtcaataagcatcctgtcttgggtggtagagaagttgggcccaataagcgcatttctcactgcaggcttcaggtcactggggctgttcctcacacttggtgcccatgggcttgtgccagtgacagcaaacaacaaacttctccctttcttgggaatatcattggaaaacatggaattccaatgtgctcagagaatatggtttagagaaacttgcaagtgaagatgacctgattcaaaatgtcaatcaactaattaaataattgatttcctattgaatatttaatatcccagcagcaattaaacttcatttaaagttacttcatacttccttggatattttattatttagaatgttacagaattatagc

SEQ ID NO: 469453 - DNA, 569 bp, Homo sapiens
aagcgccagtcagcctgctgatactaagtttcgatgaggttgaaagatttacccacagaatcccagccagtaagtggtacggtcagaatttcgcatgtgtgctctcattccgtagttcttactccctttatgctgccctgctctgagtctttgagtcatgagttctccgagtctgggaagcagatggagtttgcaagctggcttagaacttggggtaactttgcagaaaagctgccaaatgaaggagttgaagaaagggaggaggcaggatgtggtggaagttttattctgtggtccaaggaatccacaattttaagggattctggagaagaagagccagaccaaaaatggccatttaattgtgaaagctacatggatttagggtatgctgtttccagcacaagatttattaagttttatttttgtttcacttatcaagtataaacccagggaaagacctaagcaatgatattggtaataagaagtctggacaatatgacactgtctggaaatgttttgatagttgtgaacatgtgttataaatttaaaatatctaggatttacctctc

SEQ ID NO: 469454 - DNA, 843 bp, Homo sapiens
ctacaattcaagatgagatttgggtggggacacagccaaaccatatcatggatgaatgatgggatgtcagcatgcggatgtggggagaagcaagattgccccaggtttgtgactgtggtagccactggaggagaagcagaagaagacaggaatacgtggaaaagtttggaacttcctagagacttgttgaatggttgtgaccaaaatgctgatagtgatatagacagtgaagtccaagctgaggaggtctcagatggagatgaggaacttattgggaactggagcaaaggtcactcttgttatgctttagcaaagagactggctgcattgtacccctgctctggagatctgtggaactttgagcttaagagagatgatttagggtatctggtggaagaaatttctaagcagcaaagcattgaagatgtagcctggctgctagtaaaagcctatgctcatttgggtaagtaaagagaacttatatttaaaagagaaatagagtgtaaaagtttgaaaaatttgcagcctgaccatgtggtagaaaagaaaaaccctttttctagggagaaattcaagcctgctggaggaatttgcatgagtaaaggagagccaaatgttaatagccaagacaatggggaaaatgtatccagggcatttcagagaacttcacagaagcacctcccattacaaacctggaggcctagggatagaacagtgtttgggcaaaaggaagtcttgcactgtggctgagggtaaaattaggggtgggacagagagaaagttggtcatgagaggctaaataatattccatggtatttgtgtatcacattttatttattaatt

SEQ ID NO: 469455 - DNA, 3249 bp, Homo sapiens
tctttcttatcaatgccctttagaagccgcagataggaaagtaagtcttgtggctatctggcaggggagtattcaagacagcgggaggaggaggccatagaaagccgcctcttatatgctaggtacagaaggaggccagtgttccggaaaggtatatgaacaagggaaggagtaacgggaagtgctcagaggtaataaggtccacgttgtataagacagctgctgcattactttcagagaatccccggggctgcaaaaacaagctcagtgtaattacctctatatcgggggtcataagaacctttaagtttcattctacatggtactctatggaaaggattcccaatgctaaggaagagagctccaatagagagaacaatataaaaatctggaagcattatgccattgaagatgtcatcatttttatagaaaatgccatgaaagctatcaagcctgaagcagcaatcatgaaagagattgtggatgtggcaaaaaaaagggaagtgaggggtttcaagacagatcttggagaaattcaagaactaatagacaccacaccagaggagttaactgaagatgacttgatggagatgactgcttccaaaccagcaccagacaatgaggaaaaagacttagaagaggccaaaaacagagtgacatcagacaacctaactgaaagatattgctgacattagtatttttgcaccaaaccaattggctgtgttacagcagaaatactgaattaaagttccctcccttgactacttctttctctctttatttaatttaaactaaaaggatgcaagagagttaagatcttgatctagattgcactttggcttaagggaatgttgtggctggtttgatattctatccaaaccacaaaaatttgtatcagcaataagactgttttgctcatcacttaagcgtaatcataccgaacttttgttttaaagtgagtgatattagactcttccttttacttaaacacttagaagccactgtaggttattaattggcctaatttcaatattgttgtatctcagggaatagggaggtctggggagagggagaaagactgagggcaatggctggttcaaagagtagccatggagtagaatacatgtatcatttattgattgagtttactgtcttatatgagcatggttcatggcaccaaaacaattacaataggatcactgatcacagaccaccataacatcaaggaccactgatcacagaccaccaaaacaggtataataataaggaaaaagttagaaatattgtgagaattagtaaaatgtaacagagagacatgaaatgagcacgtgctattggaaaaatggtgccagtagacttgctcaatgcagggttaccataaatctccatttttaaaaagcataatatttgccaagcacgaaaaagcaaaacaggataaaatgagatatgcctatatgtgttgtggcatacattttaaaattcttctttctatagcacataagagtcttttcctaaacactggtagtatctctgtatggtatttattaaactcaatttgactaatactaaataaagtattcattatagttctaaaatcatgtaagttgtattatggttattttatatacattattcaacttttactgagattatgtcaatgccaaagcattcattgattgggtgctagtattgtcatacatattttcttgaattttatacatatatattcttctgttagtattactctttggtataaatgagtgagtattgtaacttgatttaaaaagtcaccctaaatgtggaaactgagctaagagtttagcacaaaagtcatcatcggtacagtcattagaaagtgtgcatttctgccccatgtgtgcaccttatttccaatctaaaaccaaatttatttttttttcttcatatctatttaaactcctttggtctgcttctcagttaatttaactatcaccaacatactcacccaagatattattctctatagtatcatcttgttattctcacctattccctcttctaaatttttatgctttcaaatatgtcctcatatgatcaccatatggtcaccagtgaccaaatcatttcttctatactttttatatttgcttcttcatctctttgtctactatttattgcctcggttctaatctgtttctactactgatggcctatttcaggtctgtatcaacttattctttgaaaaattttgaaataactgtttatactgaataaattgcctatgaggatggtagtgcagatgaataaataagaagagagtttgtaggcagaagatgcaaacaggacatataatctatgctccagaaatggttgttttatcctccatttatacttcaaatttcaagaacagctatgaatgtgttctgcaatggtttaatatagaagacataaacattatatttgttaagcaacaaggtcatggaagatttacctagtttgaattaaatcaatattgtttgttattctttatcctaatcccaaaagaccatacaaaatcaataagatattgatgtaactaaatcttcttcagtaagatttatgagacactgatatgagaatggaggttggctaagcagtaaccagagatatgaaatcttcatttgagttttcaaagcagcattatttctatgtgttttctttattaaactcaaacacttgcaccaaaactatatagtattatttagcattatatagtaaatcataaatatctgtataaaataaaatttgcagtaattacatgtatatcatatatttgatactataggtaacattttgtctttcacactaagctaaagttaattttataggtaaataaaaatgcatatatgtaagatgactgagtatacataaagcaaaaatgtgaaattgcattattggagaatcaataaagacaataaatggactaagggagacatttagttgatgagtgttattaaagttttaccatcataatttatgtttggtctgtgaaaaagtacttctttgaactataaggtatacattcaatatgtgttttaatgaagttttatatataataccataacgatttgtttagaattatgtattattttgttagctgaatttcgttttactttctttttcagtttactttaatcatttaatgaacattggagttgcagaataaaaatggaaattattattcattttaaggatgtttaaagcaatgttttagtattatcttttgttaat

SEQ ID NO: 469456 - DNA, 959 bp, Homo sapiens
agataaaatctcttcgtcttgatcgtctttagggtattatgaataatccgtgcacctcttcatttaaaatttattctgagcactatgcgagggtctagggatgtaaagacaagtaaagaagttcatagtctgttggtagagggagaccctgcaaatgatcaagttattaaaatcctgctagataagagctgctatagagattatggttttggggagaaagcggccacaattcccaagcttaggcaatttctggggcagtatctagttcctggaaaatccctgaaatatgtgttaaatcaatgcctagcacttaattgccgccatcacgtgggacttcagtggattgactggactctgacgggtagttcttatttggaatttcttatgaggatgcagtcagatggtggttggactggagcagcggagcgaaagctgcagacctttgcagtgaatgctacagctcataaaggtggcatgcacccacagagtgagcagcagcaagatttattgcgaagagtgaaagaacaaacattacatatgattgaaagggaccccagtgggttgctgctgctggctagggttgaagaggtgctggtggaacaaggtcagcagcaatggggctacctcaaaaagcaggggaagaaaggagcaggcactgaaatggcaggggtcactgctgttgggtttttggatggtccatctatgggttggatgcagggtgaccgttaacagtaatgcaggtgcttgtaagacacacatgcagaatatcatgtttaaaaattcaacttatttatttgctacataagatttttcaagttcctgaatgtaacccagtatcatttttatttctgacctacagcaatgtgctagaatatttaaatgcttgaactgcctgaaagatgattttaaagaaataaaaagaaagtatcttggaatttcccccatctttttagttgttc

SEQ ID NO: 469457 - DNA, 3069 bp, Homo sapiens
aaacaaagttgaaaagactggaaaatggtttattctccatctgattccaccacggctatcgccaggaatatggcagcacctttgttccagagagaggaggactcctgtaaggaagaggcagaagagaaagctggaggtgctgttcagaagccacaagaggtgggagaaaatattactagtggatcttgtaaaagactaagcgtcagcactaaggacaaaggggaatcaaaagtaacacagaaagcacttcagcaggccatggttttatttcctggtggagtgacccacaccttcattcctgaaggaccgcggcaggggtcccgcctctgtgctgccattatgttggacccattactgctgttaaaacatcgtcatataattatgcacctgtgcctgccgaaggctgagagcttgcacataaagaaagctggaaagtgttactcctacccttacaacaaaaaaaacacaagacacatcttaagtcagcaactttccataaaaccatcagagaatgaagttctaaggtaaactatcgcaagaacaaaaaaccaaacactgcatattctcactcataggtgggaattgaacaatgagatcacatggacacaggaaggggaatatcacactctggggactgtggtggggttgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaagaagacatcagtgaagagcttgtcaatggaagaaaaggctctgcaggcttagaggtatttctccagccacatccagaagattttatctaagctcttgtatagaattatcagtagtatataaatatgattaaaacattaatttgtaaatgtatgtttatattagtttctataattatttatgttaatgtgaactcttcacctaacttatggtttgactttaaaaagacatttcaaagaactaatgttctttttgtgtgtgatatctattgctttctcattctttatatcatttatttgtttgtttgtttctattaaaccttttctatttcctcccctctgcttgctttgagtttggtttgctcttcttagtctagtttatttaaatgaaatattgttattgatttaagatctcttttcttttttaatatagtcatgtgcaaatacaagtttctctttaacccatgctttagctacatcctgtgcattttgtcatgtttgatctttattcacttgtagtgttttctaattttccacccattggttatataggtatatatagtttaataaccacttaatcaacaattttccacatttattttaatgattgatttctaatttagttcagtttttgtcagaaaatgttcttcatataattttcatttttgcaaatatgtttagtcttttattgtgatgcttagtctatcctggagaatattttatgtacacatgggaaaaatatgcattctactattattaacttaggagttctatagatatctgttaaatcttgtaggttttagtgttgtttaagtcttctagttcctcgttgattatatagttgctcaagccattatcaaagagagggctttcctgattattcaatctaaatcagatgttttcctcattttttgctccttcttcataacctttatcaaaatcagaaattatgaacttatctgtgcccttatttctttacttttgtccccttcactgaactgtaacagaaataaatcatactccgaatgcatattctgcaactcaaagattttattcattagagtaaaaaagttgaagatattttaattgccatgtgtgtttcaaagcttattggtttttatattttttctccatcttttatagtgcctcacatacacctaattcaatggtagctcttgctgttatttttagagatgtaacttcttcagttctcaccaaatatgtcaacttatttttaaaacactggtttattttcattttacgtgtacattttatcagatctttaaatatttttattaaattatttaattacagtggcaaccagcagagtatagccatgaacattcaaaggagaaacacatttttctaaattctcggtagtgcgaatagaactgtgacatacagatttttataaactgtttttgatgacaaagttaactaatttcatttttattgagcatattttgttacctttatgttaagataaggttgtttaaagaccactatgagaaagagttctcaattaattgctagatctctttagttgcttcaaatatatcatactgaagatcaaatatcataatgtagaaatttgggaaataattaatgtgaagtcaggtcttgatcactctgtaaattctctatctcatagcataggaagcacagagtgtctttcttttttcttaccataagagttttttgagaaagtgaaggttatttcaaagcaatcgtccatgcaaaatcataaaaatgtattgacaatacaaaacagaaggagtagcaatttgtctttcagtaatactactttttaagaattaaataaagggtattttttcagtagtttagaatttttaccttaaccataaactcatgtattgacaataaacctacagtaacagaattttaagaataatctctttttaaattattttaatcttaatgaccacatcaactatttaatgatagtagaagtatttttaaatgtttaaaactaaacgtaattcttaattttctttataagtgttactttacaattacttatttaataaaatattcttattaataactattttcagttctttaaactttatattttttgatttttaaattaaattttaaatagacaatttcccttgacttcagaaacataaaaagctatttgggtccatatttagtttatagagattcttcatcattgagaggaagggcatctgaatgcatcatttacatttaaaattttaataaaatcaatatatgcat

SEQ ID NO: 469458 - DNA, 590 bp, Homo sapiens
acttctaattatatggtagtgatgttaccgctattagctcatttaatcatcactgaaacacacacctacaacttatgtacatggtgttgtaattccatttcacagagacacactgaatcttacatcaataaaggcattttcccaaggtcaaataacagatgtggaagatctgaaggagttgcagtgggagcccaagggagaacagacctgctccatacaaagcaggtgaaccccatgccaagacaaaataggcccaagggagctcttggccccttccactatgtgaccacacaacaagatgtcaccatctatgaatcagaaaatgagtactccccaaatgctgaatatgccagcatgttgatcttaaatttcccagcctccagaactgaattgatgtggatcattgaagtggtattcaacaagacaatggaagaatgaactttaaggcgtttcagagactataggcgctccccttcccatcacagggctagagttccagagcctgattttaaaagtggggacaggagtgcccatgggatcttggtgctggctccccatgctgcctcaaggctctgctacttgaactcttc

SEQ ID NO: 469459 - DNA, 1112 bp, Homo sapiens
gcagggccattctaaaaggcagggcccaagatggatgcagacgagctgagacctgcgagtgatgaagtctgtgtagcaccaggtctccactttgctgctcggaaggtgaaaataggggttgaagttccatcagcaatgctggttggatgtaatcagagtggcatagatttgtggagctttgaactccagagagatgatatagggtatctggcagaagaaacttctaagcagcaaagcattcaagaggtgacttgggtgctgttaagggcattccgttttataaaggaagcaaagcataaaagtttgaaaaatttgcagcctgaaaatgtgatagaaaagaaaaactcattttctgaggagaaattcaagcctactgcaaaaatttgcataaatttcagaggatgtatggaaatgcctggatacccaggcagaagtttgctgcagaggcagggcactcatgaggaacctctggtagggcagtgcaaaagtcaaatgtggggtcaagagctccgacacagagtccctactggggtactgcctagtggagctgtgagaagagggacactgtcctccagactccagaaaggtagatccaccaacaacttccactgtttgcctggaaaagccccagacactcaatgccaccctgtgaaagcagctgggagggaggctataccctgcaaagccacaggggtggagctgcctaagaccatgggaagccacctcttgaatcagcgtgacctggatctcctacatattcacgaacatgtggccggctaaactgttaatgttcaaatagggtgaaatctcagactcttcacaaggtttactttgacaattgttataaataatttgttccataattattttaccttgtgaaaactttttattgtgtgttttattcaatggaacacagttttatattaaaaattaaaacatatgaatttaaatgtgaatatctgttcaaaattaaaagtcatcataatttatgtatttccattttaatgtaaatgttaaatccgttcaatacttcgtgttttaagtaccttttgtttaattacagttaaaaattacaattacaattataattgaaatttacaatgtaaaattac

SEQ ID NO: 469460 - DNA, 858 bp, Homo sapiens
gggtcctgtgagaatctaatgccatggctgatgtgacaggaggtggagctcaggcggtattagtattacaaagggcaattaagagtggtttttcaactgccataaactgctgttctaaaacacatttttcacatctaatgagaaaggtgattttgcaaaagaaagttaatggcctctgtgctattgccttctctccctcaaacctgcacagcagtagcatcaaatgtcttgagatagatagagttgatatcatgtttgctttggataccttcagagctacaaagtgtgacacagccttggagaggaagggaaaaaatgattcagcaatggcagctgacgatgcccggctgccccctgctcttttttgcatccctacctttctacctgctgatgctgctggagccaacttggctgctcagggagagtcattggctacctgcgttttcacccattttgccatcactcaacagcaaagatttctgcctatagaaagtaaggatccaagtatttagtcagaagataaaaaaggaatacaaacatatgttaaataaaatctcataagatatttgggaacatttagggtaaaggtagataaaataattaaaaaaatacttcaatgttttggaaatgactataattttaaacatgtataactattgggtactgggtttaatacctgggtgatgaaataatttgtacaacaaacacccatgacacatgtttacctatgtaacagactttcacatgtacccttgaacctaaaataaaagttaaaaatgtgatgtaacaaaatatagtgtaaactacagagcattttacttcaaggcatttctcttcctccaaagatgaaagttaccc

SEQ ID NO: 469461 - DNA, 702 bp, Homo sapiens
cttctgcaaggacatctgcacagcaacttcctgtctaaccttggaccggcaccacccttttaattgtccatatgcaaagttcaccaattctccaagctacaattcttagtcattcttgtcaattcgacccagatggcaaaattaaaggcccttcacatcatggcacaacagtaattttagttcatcaaagattcttaccccatgctgttttttcacaattaatatttaagttcctgttgggcaagtgcttcatgaacaatgacatgtactctgtagctggaggatccatcttcttgtcaaagctgatggagaaaagaaaagtggtctgcggacatgataattacatattgcctgaaaaggtggaaggactgaaaataccccgaacagaatcttcagatggggcagcgtcccatccatttactccaactgtgccaagatattacagatctgtgtgtatcaaaagagaatgcataccatccatggtttttttgccaccagccacagtgggggatgacatcaacttcaataaaattacaaaaaacactaggtaagaaagaaaaggattggaaaaatcactgctggattttattatgattcttgaatccacaggccttaaattctgagttttctggaaaggcagcaattttatctgtagcaacattatttacagctgactacttccatcatcgtctaaaaggttgt

SEQ ID NO: 469462 - DNA, 669 bp, Homo sapiens
ttatagattattggaatggtgcagctgccaagcctgctctcgtgggctagagatgagtgtctgcagcttttcctggtgcagagttcaaacttctgatgaatctacaatttgggggtctgaaggatggtggcccctgtctcatactcacagctctactaggggtgccataacaaagtcctgcagcgtggctgatttaaccaatacattatctcacagttctggacactggaggttcaagatcagaggtgtcatcagttctggttcttctgaggggggtgaggaagaaatccccagctttcctcccagtttctggtgctcgcagcacggccttgatacggaggaggagagattgattgtcagtagtgcttgtctgccatcttgtcatggagctgctcagagcattgggttttcttcagaaagtcctcacctagaagtacggatttcactttctctagatatatagccagaagtgggattgctgaatcatatggtatttctatttttaatattttgaggaacatatgtttcatttatttttaagttcaaaagtgagatttctaatagtttaactttgtctatactttttaaacaaaatctgattaaacttttctgatgtttgtccacatagaatttgcatagaacctgtaaaggttggcatttatacttatg

SEQ ID NO: 469463 - DNA, 1384 bp, Homo sapiens
tttctgaaatacctttgaggcctttttcgacggacaaatacaaaatatgaggtcccgttccagccagtggaaacgggacacagcagtagggtggatgcgtcaggttataaatgaccctgtctcctttgtttggtgtactctcctggcaaaactgctggcgaaatctaatgccggtgctgatctgataggaggcagagctcagggtaagcaatggggagcacgtgtaaatacatatgaagcctcactcaccggcctgtcactcccctcctgctgcgtggcccggttcctaacaggccacggaccaatactttttcacagcctgagggttggggatccctgccgagtcagcgaggctggcagatgggcagtcacacacatgcctgtctccctcttcaattcccttgggagagagtggagcacaaatctggccgtggcacaattggctgttcgtccctggatgtccttcaaacagatgctgtgcttgctgggacagggcttcttgctacacagtctccaggaaaaatgtcacacaagtgaaaaaggggaggttaatgatacgaaggggtagcaaaaagttcataataataaatgattatataagattcattaagaaatgaaagcatcaacaaacctaatagtttaactactcttgaggctcaatgctgatggctatcaagaaaatatgtttatacttttgtttttatgctatccagtaggttccagaatcattaatatattatatatatgggatattagctctttcatttctatgtttctaggcaaagttttaggattttttagattaaatgcacatataaagtgccagttactttgaagtctgtcctttacttttcattgttctctcttttaaatgccagagaacattccaacagaagtttacactttaaactttcagtcattaataattacatgagtgattgaagccaatgaattaaaaaatattgctttagatcatcaaaataacaattagttttatataaggcatagattttcttcttaaagtccccccccaaaataaataaatgcatagctaagtaaactaagcactagttatattcaaaagtattttataatttttttcaaaaagtcagagctgaattaatattcaattcaattgattcatgtgtatatacactctatggtcttatttttacatgcttattctcatttcagagtaatttacttacaatagttttattttagttagatgaaactttttatcataagatgttgaatgttttgattattggtgttttcagtgatgagatgcatcaagttcaataagacaccttgagaatgtactttttcttactcaatgatcaatcttctttatattatgataatttcttcaatatctgtgaac

SEQ ID NO: 469464 - DNA, 681 bp, Homo sapiens
tctgatcaatcacctgatttatgattcttataaaggtgctattttgtgtggactttaattcaatttgctgtttctgccactttaaaaagttgggtctgctgtgtgctgtagttaaatcaacagtcttctggtcggcagacatgcagacaactgttccctcaccgccaccagtaaattcacaggtctgcaccattcccaagggttgctgtgcacagccttttctaaggagtgagacccaaatccttatttcttatgagcttcattcaaatatatattacaggggctccatgcccgtggttgttttctcagtagaattcctgaaaactgattcagacaatagtgtgtgcgtgtgtgcgcaggtaactcggtataagaactgttgtttaagaattaaattccctgaaaataaagttcctgatattactttatttacattcatttgtctcttaatggattataattttaatccatggcttaaatcaggatcttctgttatttgtgattgaggtaacagaactttacaatgctatgagagaataaatgtgatttggaaatgcaccagttctcttcatattatcatgactaagttttgttataaattttcaataataaatgtcagtgctaagatgaaaatgaacataataagagcattgcttctttgaaatttttaaaatgtgtctt

SEQ ID NO: 469465 - DNA, 812 bp, Homo sapiens
ataagaccaagaccatcagatcttatagtgttctgtgaccagcatccgtaagtcatggaatatgaggaagccctgggaatcctgaaactggagggacctgcactacttcgtagtctgtttgttctgcttatccgggtgaagatggaactggacaaaagaatacctaggggtggaccacttggtgccacacttcttcttctgtgtctccatcatatagcaatggctgtgactcatcccgatgattgggatcaattacgcctgcaacagtggaacacaggccttcaagaagagtcttcccacaaagaagaagaacatctagacacacagagcctaaatattcatgcagaacttcaccagcacaaacaccctgctggaattggtgatattacaagatacttcaggatcatcttgtatgtttgctgcctctgtccaaaaatgtgtcatttctgcaaggatccctgactccttttataggaaaatgatattagaaaccaatatattagtttttgaaatgccttttaaaattttctcaggccacactaaaaagcaattacctgtaaagaagttaatcccttgcaaatttattttgttcattatattcaatgcacatgataaactaatgttgttaatacatgtgttcagaaaagcaaacaaaaagtcaaacatctgtggctctagatgataatttagaacccttctactttctgaattgtgtaatattttaaatcccaaatggcttcagtattactccaaagattgctgctattacacagtatccaaagctaatgttaatacttctgaatagagagatt

SEQ ID NO: 469466 - DNA, 2156 bp, Homo sapiens
gtgttctcactcaaagacggtatgtgtccgggactcgatattttcaaaatcttctcagcaatggtgtgccgaagtcagacacttagggagatatttgtttttcatatgaggctacatcatattgaaatgactaagactatcaagtcacatcagagcaaatcagcagaacgcagaggctctgggagtaaaggtgaagtatgccaagaagtagggaaggtgacccaggacagaaaaagtgcaacatctgaagtgggatcgtacaaggacatggccacattgtggctggtagtcgaaaagggtgataacttcaaacatttggcaatatttggagatgttttcgactggcacgacctggatgtggaagaagagctaccgtcctgcaatatatttgtacaagtgaaaatggagactaagtcctcaccagcagaaagaatcatactaaaagatctaccaaataaattcttcaaaattacctacgtggaaactcagagataaagagtaaagtaagaaattcaaaaacttgtaaacaagttgtgtgcatttacagaagaatctgtaatggttttcacaaaagtaaggatgtgattctcaaattacacatagtaccaaaatacaagataaaactttctgacgcatttggggatggaaatgtatttaaattgtttggaggccacgtggagtatttacaaaattgacccatttctaaaccagtgcttgtctagcattggaaatttttcccacatcaggagacatttaacgaagtgtggagacattttgattgtcatgacttggtagagaggtgtgtgctaccagaacttgataggtgaagccaggaagaccgctaaacacactgcaatacacgataccaccccacaataaagaattattttacccaaaatattaatagtgctatggtagaaaatcagtcttctagcccatgaattgaattgtcatcaaagtataaaataatgaaattatataaaatacaccctattaacagtatgtaattaagcttaaaaaagtaacacaaaggtaactgtgaaaaatccccgtctgcttgaaaattatatactgtacttttcaatagtccatgaaacaaagaagaaaagttgatagaaatcaatatatttagaattaaaaattgtttaagatgcagatttccaaatgtgcaaaatagaattaaagttgagttcggagaaaagagaaatatagcttttaatgcatctaatgggaaaaatacagaatgaataaattaatatttaaaagttagaaaaagtgtaaggaattacttcaaagaaaacaaaggaaaccaaacaataaagagaactgaataggactgaaaaaagtatgagttttaaactatttttgaaaaaagtatatgaatttaaaactatttatgattttaaaaaacagcaaaaaatgagagaattttatgtgataaagtatctacaactggggatcaaaaagtactggaaacatttaaaataagagagaaggcaaaacaaagcagtattagaaaacaggacatcatcatagactctgcagtaattgaaaagacaatgagaagacattgtagcaaattttacataaatcatgctgaaaattgaggtgaaatgaacaaatttctagaaagacaatttacaaaatatgacagaagtagaatatttaatcctttatcaaaaataatgaataatgaatctaaagttgaaacctttttatttagaaaactgaaggtatatgactttgctgctgaaatccaacaaatgctaaggcaagatataatgccagttttacataaaatattgatagaaaactctaataagtgataatacttccagatatataagttcaaaacaactttacagtttaattacaggaaaggtaaatcactgacaaatatcggtcataaataataaattataaacaaaattacttttgcagtatatacaaattatgctatatcatgatcaagtaggattcatttcagaaaggtaatattatttaacatcctaatatcactcagtgcccatgccaacattcattttgttcttccagattgtagagccaaactttaaattttctcgttatcaaaatgaactattatattcacgctgtcatttataagctgagcaaaatgagttgctcaggcagtcaag

SEQ ID NO: 469467 - DNA, 558 bp, Homo sapiens
ggtaatggttgactcacagcattcacccaggatgacagctttcgtgttcatcgttagtcaccacttatccattcatccatcaagtatggaccgagcagctcccttgtgccaggccctgggaattcctaaacttccagccagtgttggccgtgatcaaatttctcctcgagatcctggctgtgccttccacttgctaaatctctcagcccagctgtggcctcctgggatacggctcctccttacctacgagcactgtcactactgtggccacaccactgtcatgatggccaccactactgttaggagtatgatgatctctcctctggttattattaccagccccatgaccacggcacacatggttactgctaccaccattgctactggtattgctactgttattgctggccagagattatttaattccacttatcacagaatggcccagtgagaagcagactgtttgaattctaagtgggttttatgatttcagagtagttttaagacctgcaagagtttgagaaacatcagtgtttttgaaaatacaatgaatagaaa

SEQ ID NO: 469468 - DNA, 695 bp, Homo sapiens
agctccagccatggctaaaaggggtgaagccatggctaaaagaggccaaggtacagctcgggctgttgcttcaaagggtgcaagccccaagccttggtggcttccaccaggtgttgggcctgcagaggggaaatgtggcgttggagtgcccacacagagtcttccctggggcactgctgtgatcagagggccaccatcctccagaccccagaatggtagatacaccaacagcttgtgtagtgcacctggaaaagctgcaggcactcaacaccagcttgtgaaagcagctggaggggctgtaccctgcagagctacaggagtggggctgcctaaggccttgggagcccacctgtttcatcagcatgccctggatgtgagatatagagtcaaaggagattattttggagctttaagatttaatgactgccctactggttttcaaacatgcatgaggcctgtatcccctttgttttggccaatttctccctttcggaatgggagcatttatcgaaggcctgtacttgcattgtgttttggaagttaaatatataaagtcattttttcccattattagtgatgctatgtttgatcacttaagtggtcacttgcagtaaggtagtaattgcaaattctatcagaaaggtacattttccctttgtacttacaggtcattcttgcattgctatgaagaaata

SEQ ID NO: 469469 - DNA, 503 bp, Homo sapiens
cagcgtcgaaatgaaggtggctctatgcagccaggtggcagtggggctggagaaatgtggacagtttagagtaatgataaggagtcaatcaactagtcatgggcaggagagtcttaacaaaggctctgccaaagacgacatccagcaggtgcctatcttttggattaatgagcctccctccctcagcaggctctttaaaacagggtatagcttttcaaagccaaaatccatcctgactcacattctaccacatgctgagttgatgacaccagaggcagggattagagtgatgcttctacaagccaaggaacaccaggggccaccaaatgctggaagagacaaggaagaattctcccttagaggcttccaggttacttggaacctgggatgaatctgttaattactccatgcctcagttgcttctgataaaaataatggtagtgacacaggattttcttctcagtcattttgcaagatgcaacaccccacccaggcctcactca

SEQ ID NO: 469470 - DNA, 1092 bp, Homo sapiens
agataacacctaatgccaacaaagcagtgagctgtgaggattgagctgttttcccctttctctctctctctctctctctctctctctctctctccctctccctcctgctgccatgtaaaacgtgccttgcttccccttcgccttctgtcacgatcgtaagcttcctgaggcctccccagccatgtggaactgctgtaggtccctgagaggcacttcaatgatgaggtgtcctgcttggagatctgataccgcagaggggcaggagggagagggagatggagtctcatggcagcaatggggcccagctggggccatgcagggggaagaggatgtctcagcaattagcaaactgatgcgagtccagggggcatgtcacagacctgcagcagtgcacacagacctccataaccgtgcgagagcttcagggagacatccggaaactctgaaagtcattgagcctcctatggttcctgctctcctgccgctggctttggcaaagagagtctctttggtggcagcagtcgggggagaatggaggaggggggatgattctggccattgttggtactggattctgggagcagggcatggcagaggccagtactcttggaaggaggctattgatggatggcagtcagttcctagagcgctgtgcaattacagtgtaacaccagcctgtggcaggctcctggagaggaagccaactgcctcccttctggccaaaaaccagcttctgagatatgggtgctcaggtgggaaggagacctgggcccctggcaggacgatgcttcacagtaaagaacgaaggctggaggccgattcctttagtgatggggacccgtgaattaaagaaacaaaagacacaatttgtattaatagttacgtgtatgggagttgagagaagagaagtaaaactcaaagaaggggtcagacactaggcctgaatatcattttgataaaggaaaggggctttgggcttaaagggataacaaattgtagggaaatgacgaggaaatatatggagggaaacaaatggaagaaaagggttattttaagttcctgtacctgctgctctggggaaggcaggcatat

SEQ ID NO: 469471 - DNA, 774 bp, Homo sapiens
gtgacagctgctggctgttttccagtactgcagggctccctgcagcagcagacgagactgtaatgcagaatttggagttgattgacacacatggtctcctcactgcggtgctgggttactcttggaatcagcaaatcagtggtcctggcagccaggacttctacccccgtctctaaaaacagtggaaaggggcaggaggagatcgaagagcatttggcaaatcctgtgattctcaaaaagcagcagcactgcctctctcaactcatctaccagaagcaatttctgcagctcacctgctacctccttaattctttcacgattattgctatctaccacaaatataagatattgggtatttgggaagtaatacttccggagaggcctaattctatcttgaccaccagcatcccatactgtgaaacgaatgtttttatagtctaccgcttccacattgcagccaacgttcatacggaatggtcgtcttgccagcggcatccaatccaaccatcagaatgtgcatctgcttcttgtcaaagaggtgggagaagaaagaggagatggtgaggcccgtgtctgatttgagtcagttgacatttggttaactgttttctattttcattggctaggaacactgatgttaagatatcctgaatccttgcatataggcagcgagtaagagatatcatggcctgatagcatggataaaccttctttaaaactctgatcttttcccttaggattttcatcttactgtgtttttgcttttggttgtgc

SEQ ID NO: 469472 - DNA, 532 bp, Homo sapiens
ggagtgttgctctgtcaaccaggctagaatgcatgattttgggggcccaagaggttttcctttcacaatggccatgtgcttggagtggcatctacaagccaaagaatggcagagattgtgggcaaacagcagaagctgcagcaggtatggcaagctccctcctagcaccatcagagagagcgtagccctgctgacgcctgattcccgaatgaactcctgtgatcctcttgggcctacccagataatccaggctcctccagatctgtcacaaggtccacaatgtggaccacatctgccaagttatttttgccatacaaccgaacatatccgcaggttctggggattaggatgtggggtccttggaggccatcactctgcccaccatgcagacagacagtacttgcacagcagccctgttagtgaggccttgtggtgtccttgttgagtagaggaggaaatcgaggctgagaaaatgaccactaagaagctaaggcaggctttgaatccgcctttcatggtggaaagaacacag

SEQ ID NO: 469473 - DNA, 845 bp, Homo sapiens
ttgaaataaacaagatccctgaacatgggaagggatcagagaggcaacagtcgataccaacaagccatgtctgaggcttatgtgatgcccgtgaagccttgtcgaacagctctagaaatgaaagcactgagtacagactgggaatttttgcagcagtacaggcagcctctttccgcagcagctccggtgcttggtcaaaacactcatgataaaatgcccttgatggaaaagggtgtttgtggtaattcgttacagcagcagtgggaaacctaccgaggaaccaaagtgggaaaagatgaaatagccaatgaaatggctcaaagagtaactggagtgagagtgtgcccaggtgtcttaggcggaaagctggtgaagagaattgtccggactgagaggcctagtagattcaaagcacatcttaaccacagaaaaccatcagttagaggccagagaatgtcagacctgggaggaatcctatgaccatatggtccagcctctcatttcttggaaatacgctcttgacatcatgtagcgcctggttgatggagagtgccttagactcctttatgatgtgtgctacagaccaaggtctcagaggggtcaagagcttgcatttcatggacttttgctcctgttgctgcctgataaatggttaattgctccttagtcatttcaaaagacctatcttccagttcacaaattctttcttctacttgatccagtctgctgttgaagctatcaaatgaattttttatttcattgattgaattcttcagatccaaaatttctgtttggttcttttttgatatctatctcttttttgaatttctcattcagattattaa

SEQ ID NO: 469474 - DNA, 694 bp, Homo sapiens
ggcctggaatttccaaacaacattcttattaaggggttgctgtgcattttggtcattggcagacgcacggggacctgtgttagaaagcccagcaagcggaaaattgagagctgacttgccgccaactacaattgaaaacagatgggtatatctgagccatgttcacgtatcttgttcattttctcattaaaaaaattgctgcactatttttagtctatgactcatttttcggcaagaatcacctgcaagtagatcttaattttctgctgaacttcagggaaaattcaagttcagcatggccttcaagaactttgactcctacagaaatggacaaaaaggttggcaggtgtcagtctgatgaaagggctgagatcttgactgcccttgagggatgccagtatgagatggctgtggggcaggctgtggctgcttgttggagggaggcagcattagcttctggttctcaggcctttggactccaggacttactccagcagttggcagaagaagaggtagggggcattcagatgagggctgttgtctgccaagatcaaagcagcgctgcacatgctaaagagtctaattcacagaccctcggtgcttagttgtagcaccaacttgaagcctatttggtcagaagtggccactcgagccgtcttagggctaggcaagggcttctttgtttcagaaagca

SEQ ID NO: 469475 - DNA, 708 bp, Homo sapiens
gttttgttttgagttaactgtgaatgctatttaagacatctctgaccaccatgtgtaaaatgacaacatcccctaacatgaaacaccccaaagccccttgctctcctttattgatctctgtgccccatcaggaatgggaactgacttggcaattacttggtgtcggtgtcttgttcatcgttgttcctacaacctatggagggaaatgggaacaccccgctgaccatctccttctgcctcaggcactttcatggagacagtcgagggctttggggcctgtcctacctggtggtctactcagtagagccatcgggctgaaaaggagacatctgttaaggacgtgcagttggaccttttcaagaagctgttggaggtcagggtctgagttgagaaaggagcttggtcctgtaagtcatcgacactcagttgcttctggatcccatcctcaccccctgcaccgcggggtccttctcagggaacgggccacttcccgatgctccctgggctgccatcagctgccatgaacactctgcttagtggaggctccgtggcctgtgaattagcatcaacctgaaataacaagcaggggcttcctatgagtcagccatagtctgttcagagatgctgcctaaagggtctaaatccaaaggcattaattaatttgttcccagggtccacagcatggggagctcaagcccttccatttcc

SEQ ID NO: 469476 - DNA, 1100 bp, Homo sapiens
ctgactaatctagacaagatacttaaagaactagcgtgttgtgatataagctgtatctgctttagggggcacccaagcccaggcccacgggctcttcagttagaaggtgttgagtgctggcaggactgagttcttcccttcaagacagcaggttcccttctggcccgggatgtgtctagaaatgtcatccaggcgccaggtcctggatcaaagccctcacaactgtgactggtatcctatcctgctgtggcttagccggtatccaagatacaagacaaagtcctccccacccttccctctcctctcctcaagcagaaggaaggggtctcttttggagccacaagctgtgcagcctggggttaggggaggggcgatgccagtactcccttgtcttccccagcttgtgtctcagacagcactgagttcagtgcttcacaattgctgtgctctccctcctctagtgcctagagatgctctccacaccacatcacaacggtttttcctgcctctgaagttaaaaccaggtctgctggagtttgctggaggtccactccagaccctgtttgcctgggtatcaccagtggaggctgcagaacagcaaatattgctgcctgctccttcctttagtagcttcgtcccagagtggcatctgccagaagtcagctggagctcttctgcagaacgtttaagtctgctgaagctggatccacagccgccccttcccccaggtgctctgtcccaggcagatgggaattttacctatcagcccctggctggggctgctgcctttctttcagagatgccctgcccagagaggaggaatctggagaggcagtctggccccaggtactttgccatgctgcggttgacttcatactgctgtgctggcagcgagaatttcaagccagtggattttagcttgctggactttgtgggaatgggacccgctgtgcgagaagacttggcttcctggcttcagccccctttccaggggagtgagtggttctgtctcactggggttccaggcactgctggtgtatgaaaaaaaactcctgcagctgtttatctgcccagagagttgcctagttttgtgcttgaaa

SEQ ID NO: 469477 - DNA, 2114 bp, Homo sapiens
agtggagctgtgagaagagggccaccatcctccagactccagaatggtagatccactgacagcttgcactgtgtgcctggaaaagccacagacactcaataccagtccaggagggggaattgagaaccatttattgctgagaaaatacttcaggatgactgagagctcacctaggcttcatacagcccctgatgctgaaggaaatatcctaagggcaaacttcaaaggcaatggaacacagagaggagaaacaaagatgaaggtgaaaacaactgacattgttgccaaaggtacggtcaccgggtcctcgacgtcccactgcaacagaaacagcacacgagtcgttgcccactcacattacagtttaaagcggcttcacgccgcgtgtgaaaagaaacaaatagctcaaagtgagtggctagaaaaggctaaaccctgtggtatccaaaccaaaaatccttaccttgttttcattgaaattagcaataactactccaacaaaaagggtcagtccaatcatgcaacccaggaatacaaaaacatgaatatagattccatggatctgcataaaggaaaatatggttattcatcaaaacaaatgaaagctgctcttgaagtgttcaaaggattcgatgtgctcgcttaccggccccacacgatgaataataacatctctcacttccacccagcctttcaaggagagaacttcaaacaacgccagcatagcgtttcccacattgtcgaaattaaagttccgaggattcgccctgcgattccaatacaggaatgttctgtgaaattccaataagcagcacccgaaggcaaatatctaggctaattttaaataattaagattttgataaccaaacactggaaaatcatggactatatttcttgaatttaatgaagaactgagctccggaccactgactagagtaggccccttggagcctatttaaattatattttgatcattttttccccctgctagctcatttctcaaaatttaaccctcaggacaggcaacgctctagggaaaatctggttctgtacttttctaccatcttttatgttttttaaactatagagacaatcacaagatgtgccttcataagttttttgaatattaaatagatgaggatataagaagaaaacattaaactgaaactgatttgttcttaagggcttagggctgattagtggagacggtctttaatatagtgcaaaagccccactcagaaatgcatattttggaattctgctttatatttttttatgtatgaaagtacaaatatattcttttggatgcttccaacaatctttcctttgggatgtttccactaaatttcatatattttacagtagacagaagttataaggattctacagatgccacagtttgcttgaataaggattttttacaagcaagtgaaccggttctcagagccggtgttggacttccttacctgctcattttcttttgtagaagtgctttcttagctgaatttgcagccactgaaactactgttatgttctagatcttctagaagttagaatatgtgaaaaatattctaactaaaccaagtaaaacaaaatgtagcatcaaagacttcaatagttggaagaatttatcacattaaaaaaataagtctttttcagttttaatcatgtaaagtgttttcttatgctttcttcatgctagcaaagttgcaaagtttgaaactttacctgtaactacggagtccttcaataaatcccaaatgccatctattattgtcatttttacctgctacccttccttgaattgaaaaggttgtcattttttctggttaatttgtgaaatattgtaatcttgcctgtccaattcagaaaactaagacattagatctgaccacataattttgtcagttttttacctcccagaggaggtgctccaaggccccccaagatcaaggtagggagagctgctcttcccttggggaacatgggggcaccctgaagacgtgactgagcgtctgcccttggatgtggaaatgcagaaaaagactttgtccaaaaacggcatgctgtatcttacacaaccatctctcctaaaagaaatcagaaacgtcgta

SEQ ID NO: 469478 - DNA, 544 bp, Homo sapiens
cattcacactgcaaggcagtggctctggacaggtgtggggaatgaatgaaatgggcattcaagatctcttcctagttggcgatgataaaattactccagagaagagaactaaggagaaaaccatcctggatgctgacttcggcaaaggcttcaatgaaaaagtggaggttatactgggccttgaaggaaggctaagattcctagaggcaaaggcggtactgggtgaaggactgaagggaggggaggtgagaaagaggaggagaaaagggggaggtgaaaaaggaggaaaaaggggaggcaagaaagaggagaaaaaggggaggcgagataaagagaaagaagcctggttattcgaaacagcagatcttactttttggtcgatgtatttgttgtcctcaattgctgagcgtttggagtggtcgcaggaggaggaagaggtggaactgtaaaatctgaaggaagctttgagattttcaccatttgaggtctgtttggaaatttttcaaagattcgcaggcgtaaagggagcttttctttggtgtcc

SEQ ID NO: 469479 - DNA, 595 bp, Homo sapiens
tcttctgagacagctccttaccaggtatgctagagcccattcactggatgctgccaggcttcagtccctttgggaacctctcttgggcttgcaaggcacaacaagctataggaggagaggggctggtggaaatattcaaagaggaaacacatgtaaaagggaagagtgtgttggaccatgtgaagagccacaattatagaggtcagcagactttgaaagccggccagtctgctcatctgccatcctggagggtctccaggaggggactatccagattaatttccatgaatggtgcccgaggccagttggtgacccacaccagctgccagagctcccgaggctgcagacctgctttgctgactaaggatgccccaggccctcattgccagactcagccacctcccttgagaggtgctgcattccccacatcccttcccacagtatctatcacgcattgctagctcaatggctccacttgtctccagacactggcttccatttcctctgcagatgcccatttcatggcctcatgtgacccttctcccacgtcggtcctcagaaatgtgggccaatgggttgttttaccctctatgtc

SEQ ID NO: 469480 - DNA, 2466 bp, Homo sapiens
ctttctctacaagagaaattctaaacaaagagcatttgtctatcacaaaatgttatgtggcaagacgtgcctttcgccttccaccatgactgtgaggcctccccagccatggggaacctctgtgtgcttcaaccaccatctggaccagttctgcaacacctatagaccctgcacttacattgtagctgtgttatctgaagcactaaaaacagtgagatggtcaatagaaacccatgattcaactggatatcttgataggccacctggaattaagtcttcaatgaacaatgtttatagaaaagcggattttggtgtcaaagcaaaagctactgcagaaataagcatctcttttgtacataagtctctgcctatctaccagggtagtttagagggattatggcttggagaaaatatagcaaggcctggatttcagccccatgcattccctcagccaggtgtctgtgcaaagcatgacttgcacaatccgatatagtgagctcatgtgtggatggctttccagaatgttagtttgcatgtctactagcggtgcaccgtgagcctgcctcacccatcctcttcagtgttatagtctatagtctttccagttgaaatgatgaaaaatcatatctcattgttttgttattttaccttttcttgcttacctgctttgttccatttagaatttagagtttggtatcaactgaagacttaggtcattttattttgaaaaaaatagctgtccaaatatttcatcataaccattaatgtttactgtatttagaatataaggttcaattttgatttatcttttctgtgatatgatgtaaatgttaactcttgcacaaaatttattccatttttagtatcttccccataaaatgcacttaaatagttaaaagaaaaagtcttatttgccaactgccactattacagttcttttctattatgtattagtcatattgtaattatttctgcaaattaattttggaaaaccattttatgccatccacaaaagtaacatgttaagatttttagtgacatttcattaagcatttgagttaccctgtgagtaactgacatctttgttattgtctaggaagatggcatagcccttttcattgagttctaatttgatagttcgcattaaatttatgtattttctcttataaaggctccatacatttcatgcagaagtcattcttaaaagttttaaatatttgggtaaccattggctctgtgattttccctatttatatccaaatttgttattgccctacatagataaaatatctagttttgtacatttatcttgtatttggctacatttctgaactcttaagaattctaaaagtatttagttccttctggattcatgtatgttgctattactttgccaagcttcatgtgaggcataaaagaagatacactttcttttctcttgaatggttttaacattggtctacctctaatgaaaaactatttcccagaccataggcttgcctgaggtttgcatgaacctggggatgtggaatgattggcagaaaccatattaaccagcttcatatccattataatttcaaccaatgagtaccacagagtgagttatggtgaatcacttccacagaagaaatttcctgagagatttcaatcctgttatatatgaaaattgtcagaagtaaacagcactaggtcaaaaaagttttcaacttatgtcagctcttttagcgcatacatgagacgtattttgttcatttctgtatccctagaacctagaacaggactagaaaatagtagaattcaacatctatttctttattgctgttgaatataaatttggagaagtcaaattgcctataggagaaaaataacctgatactgacaaatctataggctttggagtgtcggcagcgtctactagtgtgtatttagagggaatttttgagatgactcaagattttgagtggcattttattaagcatttgaattactttgtaactgacatctttgttattgtctagaagaatggcatagcccttttcattgaagtctaatttgatagtttgcattatattgatgtattttctcttatgtgggtttcatacatttcatgcagaagtcattcttaaagagttttgaataagactcttatccaaaattccctctaaaaacacgttagtagacattggtggttgtctgaccaattagttctctctccccttggccatgtgctcagggcaagggccaatcaccaactcaaatgaacagccatgttaatgctgtttccgccttcagtagttgtgttaggcataggcatatgacataattttgttcaacaaggcttgtgaggtagagggatcagaccttctgagaaagatctttttcattcttaaaaaggaacgttaagtcagagacatgctttacttcccagaggatattctgagtgagttttatgagttggtgaggttt

SEQ ID NO: 469481 - DNA, 2859 bp, Homo sapiens
cgcagcgaggatcaggaacgaaaatcttgaatcatccatttatgcaaaaagacacatcgcccgctaacgagtatgaaggtttgagtctccaaatgaaacgcagacatcgttctttgaagagtcaaatcattcattttgatgttgaattccctaatcaatatatccaagaacgattgatgatcgatgccgagcaacctgtctacaatattcacaggttaaggatcttagatggcgagccatatgttttagagcatacctttatgccagtccatcttgtgccgggtttaaaaaaagaacatttgttagcctctatctatgatcatcttcatcaagaattgaatgtccattttgcaggggcttatcgtgctatttctgcagataaaagtgatgaatatgatcagcaatatttgaactgtgcagaaaacgatcctgtactggaagttcagcaagtcgtctatctcaaagatggacagccgattgaatattcttccagccgaaaccgatttgatgttcggaactattctgtgctggatgtgcgttcaacttaaatgaagaggttgtgaaaaagccgtttaccaagagattgtgacagtggtaagcagtttccagtaacaagaagagatcgtgaaatcacattctattctatcctaagcattagctcaaaaatgaaaaaataactcagcataaaaagacttatgacaccgtaaatgattctaaagttagcttttaaagctagttttttgaaatcgatacagctagtcgtaagtctttttattttatgatttgtcaaattaagctagaataaaatgcttcttgtacatagctcaaaaatatttcgattggtgttctgtaattcaatgattttcttggaatatgattacgttgattgctgacactggaaataaatgtctgattcacttctctaaaatccattgatttcggcagtccattacgacgcagaatcccgttagaattctcgtttaatgggcgttgagaaggtgttccagggtccgcaaaatatatatcaatatcatgttggttactaatggctttccagttagaaaattcttttccacagtcaaacgtaatagatttaaagaagtttttagggaagcgagaaaaccattgattaagggcagtttcaatatctaatgccttacggccgttgggtttaatcgtgataatgactttagataatctttcaactaaagtaatgacggcacttttatgatgaatgccaacgatcgtatcaccttcaaggtgaccaaactcagaattgaaatcaggataattatcaggtcgatcatggattgagcgctgatactgttgttttccccgtttttcctgatggccattgggttttcttttacctttcatcggtagtgtgtcaatatcaaatattcctttagaaaataaacgataaagtgttctcataccgcatgaaacaggcctttcttttcgcccgataatgacgtcaggcgtccaaccaagagtgactttctctttaatgtaatctacttcatgagcaggtaattgaatgacttttctaccacattttttcttattttctttatactggtgccaataatcaagagcagtcttgccttgcttgaacttattgactacactataaatagtttgtatagcacgtcccattcggttagcgatttcaaccggcttattatgttgaagataatatgattctatcattgtcagttcgtctatggtaagatgtttgtaggtcatttatggtcacactcctttgttttctttcgtcggaaatacaatttgagtgtaccattaaaatgcccttttgtttttctaacttgattgtacaattcgcgttatttaaaactttgcaacagaacctgtggactgatcagaacgtccagtttgattcagttcaacaatcatttgtttaaaattttcttcatatcgggtcataaaaattcatcctctcgtagataagtttaatttattcttgtctctacgaaaagctgtctaagatttgatactaacaccaaattagcagtgtcttcatcttccaacaaagcaagagcaagatttaatttagcattttcgttctcaaaactcgttttaaattctggttcttttaaccttttttctaaataatcatcaaatttaatggttggcattttttctcctagtagcaagctatttgtatttttcacacggaatatggtatactaaaggcaagaaaaaggagctatgcttgaacatagcaacaatgatagaaccgttaaaaagacggtgacttttgaataaatgttttgaaccatctaattccctgccaaagtgattagatggttactttatgtccttatggtcaattatcagcaaaactaacgtcgcaaaagcgatcatcagttgaattgcttcaaaagttgacacttgcttactcccttctagggataaagctatgaaccataggcatcacccctttttcaagagattagccaccatcttttcacttttctactcttctattatatcatacgctattagctaatttcttcaataactagtcttttctctaataataatttatgcattaaattatcagctttattttcatttccaatgcttggactataatctttaagcattgcactaatctttttagacaaatctaattccatttccaaattagtaacaccatcatataatctataataaaaagctaatgttacatcagaactatataaatcataaaaatcaaatatagtttgaaaataggaataatctaatttactcaatgaatgtccaaaaaaagcaatttcattaatttcttcttttcttggcaaaataagctcatcactctttttgctatagaagttt

SEQ ID NO: 469482 - DNA, 716 bp, Homo sapiens
tcttggagaatgacagtggattatcctaagcttaaccaagtgacttcaattgtagctgctgtaccagatgtggtttcattgcttgagcaaattaacacatctcctggtacctggtatgcagccattgacttggcaaatgcctttttctccattcctgtccataaggtccaccagaagcaatttgccttcggctgccaaggccagcaatataccttcactttcctacctcacgggtatatcaactctctggctttgtgtcataatcttattcgaagagaacttgcttgcctttcgcttccacaagatattgcactggtccattccattgatgacatgatgctgattagatccagtgagcaaaaagtagcaaacacactggacttattgacgtccctgaaggacagcagtgaagggaaatcttcccagtgggcagaagtttgagcagtgcacctggttgtgcactttgcatggaaggagaaatggccagatgtacaattatatactgattcatgggctatggccaatggtttggttggatggtcagggacttggaagaagcatgattggaaaactgatgatgaaatttggggaaggtatgtggatggacctctctgaatggtctaaaactgtgaagatatttgtatcccatatgagtgctcacaatgggtgacctcagtagaggaggattttaataatcaagtggataggatgaccca

SEQ ID NO: 469483 - DNA, 601 bp, Homo sapiens
gaacccctatatacctttgttgcctcacttgtataaacaggatggcacagtgtttgctctattttgtttggattcttttactcagtataattatttttagtctcatcttcgttgagtcgtattccactgcatcacagtttctttatccatccattcctctgttgatgggcattagagttgtttccaggtttcagctgctgaagacaaacttcaacacgacttttaaggcaccccttattttagaaagcacctcgggtgccggcgccgctccatgtctcttccattttacagacaaagaccattcagagatggtcatcaacaagaactgcagtgtaggtacacaagaggaaacatgggccatcgtcctccacctctctctttgcatttcagtgctgtgcattgataccatgggtgtaattggatggatgcagtaaatgtgaattgtaggtagcggtatcaaaattgccatacgtggcagactctgtgctaaatttgtgcattctatagtttggtgtttctatgcaaggtagcaactaagcttcatttcctgaaactcagcaaaataaataaaaaaacctttctgcataggaaagcatttcca

SEQ ID NO: 469484 - DNA, 4768 bp, Homo sapiens
tgcctaactttctgaaaatgctgcctaaagcatcaaggtaataatgggacaagtgtgggctctggctcattccaccttggaaccttttcacactgatgatgaggaggaaggagagtataacgaattaacagaagatatgacagagcaggtttctttcccacctaaagctaaagtggcaaaggagggagaggtttgtccctacccttctgcaccccctcactattttgaagaaaaagagtggcctgaccctccagatctttcttttcctgaggacactaggaaagggaaatcccctgatcccttgcacttcctggagccacaacagttggggctggacctggcaggtccacctcctggttccctgatggcagacacaaacaccagtgccaagaaagaatacactgggtggccaccaggcacccagagggatggaacagagagggccttgatgcactacaatctcagaggagccggctggtgcaccaatgacacatgccaatcagttccaggttgcgaagccactcctggctgcaagtcttgccacacagggaaaactgccactatagcagctctcctcctgcctcaggcaagcaagagggtagatcacaatttcagtgcccactgctcaggcactttccatagttctggctatggaggtccctaccccactccagagaagattccagtatgacaattatatgatgcactttacccttcttagtacttgatttactctatttttgccaacattgtatctaagtgaaaccaaaggctttgcttttgaatctctcccaaagttagagtaaaagggctaagataaagacttcactctctatgaaacaatgttctttcagtactgttttctttcttcaatcatatttctaagaatcgtgcttttgaaatttctaattgaaatagtaaaatgtgtttcagctatttttaagaaaaaatatagtactttgtattgaatattatctatatttttgggttcgatatttttcaatgctagattaatgcgggaagggtagagagagtcagaaaagaattaacgatgtaaaataattcataatatacattgtttttcctagttctacttttgtcacttttgatactgaaaggaaggtgtatgctttcaaattcagttatacttggagtgtaaagctgttgcagggttgaaaaaaagctatggtcactgctggttgaactctccataataccaagtgctattatatgactggtgatatttttataataatataactagaagttgtacatgcattttatctatgtttaaagtcattactctggggtcctgtgctcattatgtttccagttaattgactgcacaagtttctaaatggatcaaaattcccataaaacctttttcccataaaacttttaagtccaaaaatcaaggtttgcaaaacttggtttccttagtcattactaactaaataattgcaatgagtttcatgcaataagggctatactttcaaattagtttgggggaaaaaggccaaatagtaaattggatgtttgcatattaaaggcatagctcaatcctgaagaaaaagaaatctgcttatacttttttaaactcagcatttcataaacttgtttgataatagatacctttataaaacattatttaatatagcatataacatggattattagtttctgcagctcacagtttgaggaacgttgatgctgcaactttccagcaaatattgtctgcaaattacctatatataaacagttcaatattttaatattttaatttacaagataattggtgttaattatctgcaagcgaagctcagaatactaacttttaaaagtacaacttttccaagttttgacaaacataggcctcacttatcacttattaaactagaagaaaaaagacatcatagacacaagtgagatcacatttcaactaaaaagtattaccttttaaaggtcctacacaggtgcagtggggattaaattccaacacttgaactttgggggctgtcaaaccatagcacccacgaagttctcaaagagggcttctttttaagatgaaataattcaaggatggatattaacagaaaaaggggccagaagagggaaaatgttaaaaatgtagaaagcaaaataaacaaataatgcaagctctttgtaagggtcaagaatgagttgaatgtaagtggtaagtaaactcatttccagtgaatatacatcaatcatatctttggagagctacttggcagtataaaacaagaacctcaatattgattatatctttgaccaataactctatttttgttaatagaaactaatccaaagaatagagacttttctattgacaaagttataatcaaataaactgttgtcaaatcacattgttatttgtaacaaattccaagtgtctttttgctacaaagagaaatactcattttttaatattttgttaatggacaatttgttaatattaagtaatactgaacaatcaacattttggaactttaatcaattgtactttcaacagaaatataatagcgttctaatttaatactggtttctgcatttatgtgaaaataaatttttaaaggggctgtcaccctggatttaaagtaggtcttttaacatttttattcttgttctaattatcactctaatattaattattatgtctttccaagcttgtcctaacaatgcaataataatttattaatttatctttatcctagggattcaataatcttaatagacttaaaaaactgccatatcatatccatctaggttgcaggatctaagttttctacgaatttactttttattaggacagtgcatttcaatgacatttactcatgaactactcaggctgagttccttggtcattaggtcaatatttttacatcttacataggatttgctgccttttatataaatcttattttaatgttttaaagtctgatgttttactccatttgttttaaagatttacatggctaaaagtacctaatccattgttctgtcaacataatatatggccctagtttgttggtgtaattgaaaacctctccttggtaagggaataaataggatgctgtgagtcaaatattttatatgacaacatttctagataaaacatttaaatattttaaagcactaaatattataattaaattgttttcaaatgccttttaatatttagaagatacaaatatccacatgcacaaaaaattgcatgtacaaatgggtttgttgcagcattaaatgattaaatagtatcattatgctatttaataccatgtaaccattataaaatcagcaggtagatttatgatatttacataaaatatccctacagtattctaccaaaatatacatcaagatatattttacattcatacagtgaaatgctactacacaataaagaggaatgaattattgatgttctccacaacatgaatgaattttaaaatcagtagctgagtgaaagaagccagacaaaaagagcacatactatatgattcatttatataaatgtctagaaatgttaattaatctgtaataaaagaaggtacatcaattattctctggggaaggtagtggagggagaggagatttatgaagggtaaaggaaatttttgccgctgatggaaatgttcactatcttgattgtggtatgtacatatgttaagactgattaaattgtactctaagtgtgtgaggttggcactctttatacttcaataagattagaaatcaaaaaaaccttaagaagcaaaacactttaggatgtttagatttaggtattttcctggcctaaattccaagagaggaatctttgtcacttaggtacaatctactaaggtatctactctatttagaaaacaatatcatggaccatctgtagcctgcagttaactaaaattacagtttatgatggaaatagccaacatgatctgatgaaatgcatatcattggatcttggtggtagaagcgtatttattcacatatataacttagccacatagaagggttattatatttcattgtaggggggaatgaatggggtcttaactgatcacaactaactaagagctggaagaggtgatgttagcagtcccattatcagattgggtaagtatggtaaaactgtaaaatagctctataagtcccttcaaataaatagttgaagttaactattacttgatgaggcttctaaattttctaaattcacttactaactgtagatcaagcctttccaagattattattcaaacttttgtggcttccaaactttttaaagcaatagaccctttaatcaagcaaaatctcactcaaaacaccaacctcaatcatcacacttgttgtaaataaaagcagaatattttaaccatatatttattgtataagattacatttttaatccttgaaatgagtaagaataatataactaaagaataataaccacaagatttgcaatatatggtttgtggatgattgttgctgatatttcagcctcagcatctatttctgtatcttgtttggatggcagagtttttagaaattcaagtttcatacagttaagcagtttcaaatagtatttttattagttctcattgaaagcagagtatactctccaattaaactggtcaagaagcttcagatgatgctgacaaatgtttgcctctaaggtgaagcactaatgtccaacaactgaattcactgcttaccaaaaatttaggcaagaagcaccaaatatttaaagtac

SEQ ID NO: 469485 - DNA, 737 bp, Homo sapiens
tctgcagcttcactcccgaagccagcaagatcatgagcccaccaggaggagcaaacaacttcagatgcgccaccttaagagctgtaacactcactgcaaaggtctgcagcttcactcctgagccagcgagaccacgaacccaccagaaggaagaaactccgaacacatctgaacatcagaaggagcaaactctggacacgccacctttaagaactgtaacactcacctcgagggtccgcagcttcattcttgaagtcatcagagccctcttctccaggtctgctggagtttgctggagatccactccagacccttttttcctgggtatcaccagcagaggctgcagatccaaagattgctgcctgcttcttcctctggaagctttgtcccagaggggcatccaccagatgccagccagagctctcctgtatgaggtgtctatgcactgcccagagaggaggaatctaaagaggcagtctggctacagtggctttgctgcagctgtggtggttccacccagtgtcaacttcctggcagctttgtttacacttgtattagcccattttcatgctgctaataaagacatagctgagactgggcaatttacaaaagaacgagattacgagatttaatggacttaaaagttccacgtggttggggaagcctcacaatcatggtggaagatccccttcattcttttaaattattttaatctctttgctaaatttatctgatac

SEQ ID NO: 469486 - DNA, 2527 bp, Homo sapiens
caccagtaatgcatgttttctaaaccaagaattcttgaggttaaacctacggttattggaggggtttgaatgtctgtggatgtgcgttatgtttgtgtgggttgcatcttttttagggaactggggtattggaaactcatccaggatatgtactcatcaatacaacataaccttgaaagtgaaagaagagagtgcagaggcagaatatctgagagggagaggcagagggcttgggctttctgtgtctgcatctgatgactacacagggaggacagacagcaaggggaagaacaccacagacccctattgctcatctagtgagcatgcagctagaaaatcaggggaggggaatgaagagagatggcctaagcatatgggaactcatggttttgtttccaaatatagtgatttggaatttaaaccagattctcttttggcagcttcttactacagccccttggcaaatgatgcctgtcctctaaaaggttgctttacacttttctccacttatggcttctagagaacccatccaggtcttctgttagagttccactacttctgcagattcaagtaaccatatatgcatcctttccccacccctactacagcacagctagaactgaatgtagttcgtaagcaaactgttccaaccatagccttttttttttacccttccccaaatgaggatgacatatcaggccccataagtcccaaaccacacagaatgcttttttaactcgtagtctacctgaaatctccccacttagcttgaaatgcgaagggaacagcccccttcttttttattttcttcttctcccatggcggcttgttatattagcatctctctctgaagagatttcctgttttttttagcgtacactcttttataaagtagttcttgccaccttttctttttccatatttctttgcctattcttcacacttgtacacatacagtctgtccctttgcatatatagtttcaaatcagctagtccagtactgtaaaaatgttgttgatattctgtatggaaagttataaatttatatttatttttgaataataagaatcttcataattttaagcagtcctgtttatgaatatggcatgtttttccattcatttagatctttcatgtacttcagtataacttcataatttttaataaaagtcttacatatcatttagtagcttcattcctgtgtgctttatagttttaggtttatatggaatctttcaaaattaactctctcacttaaacataattgtaaattattctgacattgaaatattaatttatgctgaagaactttgctgttaactgctttatttctaataatttctagagtctctaagatttttctgtccttcatagataataataaatttgtttaattcttgtaccatgcatttattttttcagatttattaaaattggccagaatctgctacccatcccctcccttcaaagttaaagggaaattatgctactgagtatcattgtatttctgattctattaaaaatatgtctgaaatattacctgtaaattaaatgacactttgagtttgtttattgttatgtttgcttcatttccttaatcaattaaagattaatttttaacctgttttgctaaagcaaaattttttaccttactttttgctaaggtaaatttttcttttgatcacaaatgagtttttattaggagtatttttttctaagttttaaaatatgatcatatgctttttctttaaatatatcaatttacattgtgatgaatattgtgttaaattaatcactttttttacattaatacactttacattcttgcaatggagttttattgtcttatgcatagatatattgataaataggattgagcaaaatgtaaaaataattgtgagaagaaaatgagtttaggatagctggctttttagaatattgtgttctatacaaattctctcacaactcagtctccctccgttgttgcattaaatatgtatctttgactttaaaaatatatatttatttcaaatgcataaaaccattctatataatagataacccatttttattcaagcacttgagattgacataggtcaaacactcaatacttggattttaaacttggatattgattatggattagccgtttagatcattttctttaattgcttcaattggaataactatgtatttttctctatggatatcagggaattaaaacattcagacaagttataaatatacaatgcagttgcattatgaaggcagaattttatgattatggtaattaatgaaatatactgtcagtaagtttgaccagcttcgctgaacgcagcagcatttgccagggatagcatgaccatattagcagccttgctacccactcattatctaaaatataaggcttgaatatgattcatacaattaattgtcaatttcttccaagttatttttatttatatataatgttaacagaagtataactgttctacctataaattttctctgaaactcttagcatgtc

SEQ ID NO: 469487 - DNA, 1052 bp, Homo sapiens
caggtggagctgcctgccagtcctgcgccgtgcgctcacattcctcagcccttgggtggtcgatgggactgggctccctggagcagggggtggcgctcgtcggggaggctccggccacacaggagcccatggagtgggtgggaggctcaggcatggcgggctgcaggtctcgaggccggccctgtgggaaggcagccaaggcccggcgagaaatcaagcacagtgccggtgggccagcactgctgggggactcagtacaccctccgcagccactggcccgggtgctaagtcccccattgcccggggccagcagggctggctggctgctccgagtgcagggcacaccaagcccacgcccacccggaactccagctggcccacaagtgctgcacacagccccggttcctgctcgtgtctctccctccacacctccctgcaagctgaaggagtgggctccggccttggccagcccagaaaggggctcccacagtgcagtgggggactgaagggctcctcaaatgccaccaaagtgggagcccaggcaggggaggtgccgagagcaagcgagggttctgaggactgccagcacgctgtcacctctcaagagcacagtcacttggacctggagacagagagagttatgttgagaaatgcaatcagactacaataactctaaatggagggaaccaagaagatctttgtaattagcacattaatcagaaatgtatgagagtcatcttgaccactgtcaccagcattgatgttactaatcttttatctattttcccatgtgatctatggaaattatttaccattgattagcttttccctgataaataacatggttgaacatattttcatatatagtacttattgaacatttaaaacgacaatcgctcttattctttatattcttgtgatagcctttatcatcttttctatttggttatggtcttttacttatgaatttgtagtaactattggtattttaaaatatcattccacttctttttttcctgaatatgtttcagacactttctcctagttactct

SEQ ID NO: 469488 - DNA, 473 bp, Homo sapiens
acagaccttttcatgcccacagttcagcggggcctgagttcttgtcctgtgtccaggaagaatgaggttacacagacaactagagagcccctcttctgcaggtctgctggtatttgctgggtgtccactccagaccctatttgcctgggtatcaccagcggaagctgcagaacagcaacgattgctgcctgctccttcctctggaagttttgtcccagagggtcacctgtcagatgccaaccggagctctcctgtatgagtgtctgtcaacccctgattggagggaatctcctggtctgtgggttgcaaaaacggtgggaaaagtgtagtatctgggccctgtcctttacggcgctgtctttcatggcactgtccctcacagcttcccttggctagcggagggacttccccgaccccttatgcttcctggttgttttattttttataccaggggttgtagcaggaagctctat

SEQ ID NO: 469489 - DNA, 564 bp, Homo sapiens
agactggctccagtccctgacagcccattatggtgtcagcactaggccctccacttctggctgaagccctgaaaagacaaactatacctgagggacccagacgcagttacagcagaaagccaggacacagtgaaggtcttcccactacatgggtggaggtcacattcacacccatgggtggcactgctaggggctgccaggattcgggaaaaaaagaaaggaagaaaaaaggggctgcctattcactctcagtcacatacccctggtttttgctggaagagagacaaactaagggatgcttttcccctcttccagatggttactccaaactatccatgatagaccagggactggatgagaatcccatcgccttcctggaaaggttaagaggggccttggtaaagcatacctttctatctcctgattcagtcaagagacaactaattctaaaagataagttcattactcaggtggaccctgatgtcaggaggaagctgcagaaacagcctatgggaccagatattactttagacaacctcctgaaagtggtcacctaggtctttt

SEQ ID NO: 469490 - DNA, 700 bp, Homo sapiens
ctcccacccctgaatgccgctatggggttagagcccagtgcccaactcctgcacctgtccaactgcatgctctcccttctgtatgggaaagccttcttccttggcaatacttactgtctcagtgattggctttctgtgctacgagcagcaggactagaccaaagcccctgtgttttggtaacagattttggttctttgattgggaagacattgcttgtggcttggttgctgtgggccagaagtcccagaagtgctcctaagcagttgcccacccaatttcggctggaggtgagtttctgtctctctctggccccacaagcgctgaccctaaccacgttcctgattgccttggatgaactgactttgaaatttgacatctgcatcccaatagaggcttatctaaggtttccaagtaaaaaaggagctattgtccaaggctccacttgcataccatttggagtttcatgacctctaggggtccttgataaagacaccttatggtgaggactcgaaaaaaggcaagaatagcaagcataggtgagactaccaagaggatatccatgggaggttaattattggcactaatcttttgtggtttttagcttgggatctttgatttcatcacactggaactttgggtgctcttctgggtcaaaagaggtcctctctggctgtgtaggtttgcactagtgttagcagt

SEQ ID NO: 469491 - DNA, 1676 bp, Homo sapiens
agaaacttttattttcctttctgtctgaaaaggctcacttccaggaattcatttgagtggttgtcagctgggataagtggggaggagccaagatggccgaataggaacagctccggtctacagctcccagcgtgagcgacgcagaagacgggtgatttctgcatttccatctgaggtaccgggttcatctcactagggagtgccagacagtgggcgcacgcaggtcagtgggtgcgtgcactgtgcgcgagctgaagcagggcgaggcattgcctcacttgggaagcgcaaggggtcagggagttccctttctgagtcaaagaaaggggtgacgggacggcacctggaaaatcgggtcactcccacccgaatactgcgcttttccgacgggcttaaaaaacggtgcatcacgagattatatcccgcacctggctccaagggtcctacgcccacggagtctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcgtgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacagggcagggtattccaacagacctgcagctgagggtcctctctgttagaaggaaaactaacaaacagaaaggacatccacaccaaaaacccatctgtacatcaccatcatcaaggataagtggtctacccaataacaagcaataatatgccagatacagtggctcatgcctgtaatcccagcactttgggaggccaagaggggcagatcacttgagttcagcagattttcaggcagactacggaaagttccacctgtctttctcatacttatgataaaatgtgagaggaggggagataaacttaacaaagaaattgttcatttttcaagtaaagtgcagagaaaatatgaagaacacaggatgtgttgtgttagaaacatcattcctgtcctctccatgttgcttacattaagagagattcagaagaaaacttcaaggtgggtgttttgggcagaacatttgtcccttcagttcacagctcttcaaatcaaagcaatacatgaagaaatacaccaaagtccctcttccacaagtgggtgttatctaaataaagagatcctggatctggagtttttgcctaatgccttcatgaaaggaggctttttgagttacatataaacaatttgcaaaatttaaagagcttcttttttaaaaagcaaggcactgttttaagattttaaagttttttttttttttaccaattaatgctttatatgactatcgtattactttacagcctgtgacaatgaaataaatgacagattttcccaagtatttgttcatgaaactaaatactttggttgcttcttcacttttccccttcccag

SEQ ID NO: 469492 - DNA, 967 bp, Homo sapiens
accatggtactaacagctacaatggcacccttgagagaaataagctcctcaaatgctaccgcaattcccttgcagtttgatattgagggtggctgtcactgcctggtacttccagccaacctcatgagccaggcgccccagataggcaaactttcttgtaggcttcagacgcacgaccttgagggcagcaggaaccaccatccgctttttcttgtcgtagggcggtgggatgccgtcagacaccttgagacggtccaaagcggcctggcctcgcttggtcttgtggggcagcatacctcgcaccgtccgccagaagacgcggctgggagcccggaagtggtagggacctctggaagggctggtgttcatccgcttgcggaggaaagccaggtagttcaacttgtttctgtagaaattgccagaaatgttgatgccttcgcagcatacgaccaccaccttccggcccagcagtacctgtttagccacgatggccgccaggcggcccaggagatggcctctaccatcaagcaccaggacctgcacctccgccatcttcggcagccgcttgggaaagcttcaggttcctatttagtcaaccatcttctgctacccttgctcctgctgacaaccactgatatgatttttttactcgatatttttttactcttgtagaggttatataattggaatgatacattatgtagccttttatgcctggcattcttcgcttagcataatgcactttacaaacctatgttttctttaattttcaatcaattcatttattcagtgaatatttactgagcatctactatgtactagaatatttaaggtatggataagtgaataaagaaatttagtaatttcttgcattgtttactgaaaagcatactactcatacacattctataaattattttgttcaaaataagtaattttaaaatgctatgaaatgtcaacagttctt

SEQ ID NO: 469493 - DNA, 1651 bp, Homo sapiens
tcatctcctgcggtgaactcaagcccaagcaaggcacaggcaggggtgtcaccagccagagatggggtcagggctagtcgtgtttgagctcagactctccttgggtgggtcttgatgtggctgctatgggggatgggggatggggctgtaaaagccatcttgtttcttgttccccctacaactgggcaacatctgtgttattggaaacccaagggacagccccatggaagccccatggtagttgtactggaagctgctctgcattcccatgtcaagagccatcaagaagatgattatgaaacgtattccattgcccaaggtcctacaacagacaatttcccattattttccacaagatccaaaagagcattcttgatttcaatcaggaatgtttggaaactggaatttttgcttcacttcctggtggtctctgtaaagtttctagctaaagtagtgaaagaaagagcatctgactgttggagatcaaaaggtggtaactcagcatctgagagtcaatcaagggacaggacggtaacccagagaacagcaacagcagaaaaccactactaccttaagctcaaagattataaaacagggggagcccactgtccaaagtcattcaaagtaacctggtagcctgaaaagctgcacagagagctaagtagaattctgagaaagaagatttagtgaaatcaagtaagttatacttagtaaacatagattaggtacttaagaatacaataatttttatccattaaaaatattgagtgtttacttaaaccagatactggtcaaagaactatttctaaaattaatccatcctcacaaaaaccctgttgatttaatatatggtatagtacaagcactatgtttccacattttgtaaatgaagaaattcaaatttagtgaatttcaattacttacccaaattttcagcaatggagtagctagcacacatggcatttaaaacttgacttgacttaaacaaaaccacataatcttatatactataatatactacagaaataatgctagtactctagttttttaagcataattgagaaagagagctacagattgggaatggaaacttgtgtacatctactctaaaaggaaaggtctctaacatgataactaactttaaaattagctaattacagataattagaagagtaatttacctacaaaattaaggttattagaatatattgtgatctaagaagaaactcaaatattttagaaagaattaaagtttacaaatgcaacagtagaaaatctcatctttacaatataaagtgtggctggacaatttagtttatttcccttcaacttattttaattaggagactttgtgtcaatgttgccttatgtttgctattagcgttcatctgagtaactttagattttctgatgaatagtgcagctcaagtgttctgtaatattcaataataatgtcatcccatgtggtaaaattcccatgtagatgcctatgcatatgtccaagtatatgacagtagttcacttgccatcacatcagataaccttttcaactctaaaagaagctgttattactccctagcttgcatctttatgtatctctcactgttgatgacaccaaagacctataaataatttctaaatgatttgtatt

SEQ ID NO: 469494 - DNA, 972 bp, Homo sapiens
ggcgtaggaagcgccaagagcgagccagggctgctaacacgttgtcacctttcaataagtttatataattgtgttcttatattatggtctacacactaccttcagcagtttctccagagtcctctgctaaaggggatccatcaagatcctacggcctttctgctgcttcctctatccctgtatttcatttggctctccaaattgactcagctccaggtaacgtcggaaacttctcctgtaaacaaaccttcagcttttccagtgggagtgtgtgttcaggagagaaggatcttcctttcctgcttccacggttggggtactcacaagtttggggaggtctcccgggtcttgtaggagcagtctgcttcattcagagggtctgtgggtcctctcaggattgctggtttgttgttgcagtcgacctggagctaaaattcacaataaacactggcattccagaaagtaaatttatttttcacttttggttttagattactcacttttggtaaactgtttgtgctatatatttctggtgaattgttaactgatgagtctcataaaacacagttaaatgctacaaagacaagtctcttggctttatcaaatatcttccaaaaattgtgaagccaaatgaatagatttatcccgtctcctctcaccccaacataaaagggggaaaaaaaaaaaaacaaaagtatttatcttattgctgcataatagccttatactgtccatacatagcctcttttacatctagtatattttattgaaatatacaaaacatttaaaaattgtaaaatatgctaaaaaaatacagcaaaatgcaagttatccgtcaatgtcaccctttggaaaaaaggaagctattctacatatttcctctgaatttgctttgaaatatgaataaattcccatgacattttggtaaatgtattttccttaaaaagatgctgtgaatttctggaagtctac

SEQ ID NO: 469495 - DNA, 809 bp, Homo sapiens
aggggcagagctgcccaaagccatgggagcccacctcttgcttcaacgtgacctggatgtgagacatggagtggaaggagatcattttgaaactttaagcttttactttgctcaggccatcggactaggctactatgtgccccgacctgcatggagaacagtccaggcacttttctatgaggtgggtgttctctcctgtgggtatgtaccagcccatgcttccacagactctccaaagcctggagacaacaagatcaaggcctatgagatagcaaagatggcaaactgcctcttccactgggagctgtgtcccagagagttgcagataagctactggctcaacagtcacagtagagggtggctggagatggagactcaggccaggaggacacaccaagaggggagatatgggattgaggacctacataacaaagagtctgaccagttttctatagggttaagaggtctgctccagtcgctagttacgctggattttctaatatctagagatatcaacagtgaaaactgcaaaataacaaagatggtggcctgccccttcctctaggagctccatcccaggaaattccagacctgttcctggcctgaacacactggtgagggtggctggggaccctagtcaggaggttctgactagtgaggaggaataagattggggacctccataaaaaacgcagtctggttgctttttcatagaactgctgtgctatgttgggggtctgatccagctcacagtcacctgagactctccaaaccctgaaggtgacaacgtctaaggctgtgaaatactt

SEQ ID NO: 469496 - DNA, 648 bp, Homo sapiens
gcagggcactaggcttctgaacagtgcttatgttgactgacatgggaatatcactattagcatcaaggaaattgattcatatcgtgactgaaatacccattcaagtattgtatctaataactcaggctttagctcaaggctttgtgagtactgtcacaaggatccctactgaaaatcgtttaagcaagaacacctacatcctggaagagaaaaagggtcaaaataactggaatgcaagaaagaatggcatgaagtcaggtggaaagcatgaaaaccttgaagaagggagttataccactcaaaaatgtctcttcaaggaccttggagcccaccctttgaaacagaaacatgcaggaagatggctcttgctttctaaccttcccatccctgtggaaagaaaaatcaagcctagttttacactgaagtctctgtctgctactacagtagaaggtgaataaaatctgtctttatagcctttaacaactttctagttttgtttctcccatgtgattttaatgtttatagtttattatagactaatttggttcttggtgcatttaggggtaaagatgctgtatgagctccttggttataaatagtctttgtgtactggctttctgaaatgctgcttgtagtagttatgtattc

SEQ ID NO: 469497 - DNA, 479 bp, Homo sapiens
catgcagggatgggagcagtgcagtcagccacctcaaggacgcagggcacacgggatgcggggcacaggggtcccacagccgccacagccactccgccactcccacagctgctcttggcaccaccactcgcatctccccactgcagccagtgtgatggcggtggcagctctggacggctggccactgccatcataatcaaggtagtgtggatgcctgaatttctggtgaagcaggaattgaatacagtagagctgcttgtgatgcttggccctcattcagagagcccagagcagcctgtcaccagtgaaaagaagcagaaaggaaagacacaaaaggttataatttatatggaaccacgaaagcttctacacatcaagtctgtggtcttctgttatatcagcacaaatgaactatgagagtacccttagcattttgtattctcagtagtagtattgttaaaccaactttgtattccagg

SEQ ID NO: 469498 - DNA, 747 bp, Homo sapiens
aagtttcgaaagcgcagcaccagaaactaaaactcttctgccacctagcgaaaagggacatagtagaaagacacacaagaaggtaatatgatggcagagggagatttgagtgacatgaacatcagccagacagaagaagaggaggaatgtggctgcaagtcagtcattattgacagctaccagcagcaggatctgtcctcatttacacgtgtccacagcaatggcagtacagcagcgtgcatgttcattggctgtggcaggctgctaatggccagtgtgctggcctctgtgtgggtattcacagcaaaggcattggcagcatggctcagggaggacgtcactggcaactgtgcatacatttgtgctagtagtgatgttagcacaggagcagggcactggaaggcgcgggattgtgtgtgccctttgtgtgcattcatgtggatgacagtggtcactcagggtggaggtgggtccactgttctctgtgctgttttgcactggcagtagtgttggtgcagggacagggtgtggaggaaacagaagcttattatccttccttctcttgcaaggaggtctgtgcttcctcattctttattctgatgactgtgtcattgacaacatcatcaataaacacttatcattaagccaacaaaattatagctgtaaggttaaaaattgcatcgttacacatggattcctcaagtgaaagaatttacagttgttcatatcccatgaatgtttccagaa

SEQ ID NO: 469499 - DNA, 768 bp, Homo sapiens
gaagaaatattcttaacgactaaagagttatgtcccttatcaatgttgcattgggtacatgcacaggtttgttatatagtgtgtcaaaaagtgaaagactacagaaaacaaagaagaatcctgaatataagaatggaacactttaataataggctgctctgcttatatcccagcatgtggccatctactctgcctacatatgtggctgagccagtagggtacactcatctccccttcaagcctgacaaagctcaaaggagcagatcaatggcttcgtgggaaagaagatatacccgaagaattgtaattaataatgacatagtcattgaaaccaaagatctgagctcatatcaagatcctgattcctctgggaattataggatcgagtggagagcagaaaggcaagcatatacagtttatcccttagtagttcttggatccaaaatagaaattaacccactaccttcatccagtagtatttgccagccaattgtccaatacatcgtttaaggctcaacccaaaagccactttctttttgaaactttctttttaaatttttttccccttcaataaggttatttaaaaatatataataagttattattccaccatgcactagatcttattcattatatctaaatggatttttgtacttaccaatcattcccatcttatcccatcctccctgatacccttcccagcctctggaccacatcccttttctgttagtatacaatgtgatgatttagaaagctgggtaactagac

SEQ ID NO: 469500 - DNA, 710 bp, Homo sapiens
agttgtcagtgaaatacacctagggcttatgttttatggtttgcacaataattccattttgcggctctgtaccctaattatgagagacttgggagaggaagatcaaatttttcctgcttccttgatatttatgactatagacgtttacttaaagaagagtgggcatgctttgaccagaaagatagtgcagaagaaaagtgtcagtaatgagaagcaatggctgattggaattctaagttctgaaaaggacattgttatttatggagcatatacctatagaatgtcgactggctccactatactacacaaagttggggaattggagtctattgtcaaggaacacacaatagtgcgttctctccatttaggggtgcctttgaatgctgctgagcaaaacatgacaagagtccattgcacatgggttcaaatatatacatttcccagctgtgtgacttgtaggaaaccacttaaatgttcttagcctcattctcttcttctttaaaattgatagttcatgatgttgtgaagattaaatgaagtgactttactgttaatacttatgaactctaactcatgaatttagtgaaatacaaatacccttatttgggagtaaactgtaataatatgcatctatgctgggggggaaaaaaccccaaacagcccttttgtcttttagattttgaatggcttgtgtagctcttcccctcctg

SEQ ID NO: 469501 - DNA, 686 bp, Homo sapiens
cacctggcgcagaagtggtgctgatgccgccgccgcacgagagaggagagccacgcatcaggcagcgaatgggagggcagcttgaaccctccctgttctggacgctggtgaagaagatccgtgagcactccccaagcagatttcaggcaacgagtgaccatgctggtccacgtgtcagagccataggggctgactctgggggcttctgctccaggttctttatagacacacggacagtttccatttccacaggggcccaggctatacattcaaatctagatgaattcagtatgaaggacagtggaaaaggagacagtgaattgaatgacagccatttggatatcagcagagagggtttcaagaaaacatcctttcaaatgattgcaaaacaaggggctcaggccactgtaactggggagattattgatagtgaggcattgctacataataagagagtcttccagtggttagcctagagattacagcatgcacactagatttaagataatctattatgaattataactttttgtcacttcctgaaaaatgtcagaatgaagaacagtttgcattgacccctctcttatcttttgtgcttttgtcatgtattttaatttcacatatacatgatacttcataagctaatatttgtattgttttatatggtcaatatctgtttagtttga

SEQ ID NO: 469502 - DNA, 641 bp, Homo sapiens
cccagccttctcattatggctcacaaagcacttcatggtctggtcaagctttaccttgagggctttgtgtttattcacctgttgaaactctatggtctggcaaaaatgaatgccttgaagctcccagaacataccctattctcccttattcccaggactgctcctctgaatgtggtgactagaaatccaaaatttaaaatcacatataaggcttgcatttatgactcgcgttatgtttctgttaggctgcactggtatggagtgtattgcctggcacatctggttaatgaacaaactggtagatggatctatgtgaaaggagatggagcaacctgggatggaacaccctactttaagcctatggactctgtcttgaaggaaccttgtgcacctgtgtccatatttccaggaataaaatattaacatgacattctgaactgaacagaacagatgcttattttgatcaattgcaacatcccatgataccgtaagtggtgttcattcttactggcactagtattcatttaactggttttgtgttcaatttgtgtttattcctagtatattccctgaagtggcctgccttccgtaagtgactaggcattttcattagaaaaaattatgcattcttctttccttat

SEQ ID NO: 469503 - DNA, 677 bp, Homo sapiens
tactatcagccatggtcaaccccaccgtgttcttcaacatggctgtcaatgatgagcccttgtgccacgtctcctttgagctgtatgcagacaagtttccaaagacagcagaaaactttcgtgctctgagcactggagagaaaggatttggttacaagggtttctgcttttacagaattattccagggtttatgtggtttatgtgtcagggcagtgacttcacacaccataatggcactggtggcaagtccatctatggagagaaatttgatgacgagaacttcatcctgaagcatacaggtcctgaaccctcacattcccaaaccaattacttatccatggcaaatgctggacccaacacaaatggttcccagtttttcctctgcactgccaagactgagtggttggatggcacacatgtggtctttggcaaggtgaaagaaggcatcaatattgtggaggccatggagcgctttggatctaggaatggcaagaccagcaagatcaccattgtgatccacccgcctcagccacccaaagtgctgggattaaaggaatgagccaccatgcctggccaacttgtgttttttcttaaccaccacgccattccttctgtagctcaggagagcacccctccaccccatttgcttgtagtatcctagaatctttgtgctctc

SEQ ID NO: 469504 - DNA, 602 bp, Homo sapiens
caacagcaccttctcctacctgagcaggattttcttcagcgttcaggatgatactgcttatagtcatctgccaaggaggcttcttttcaagcttagaagaagtcagtggtgcttttccggtccttgggcctgtcagtggtcctctagactcacacagggtaatgggcagcctccatggcagttcgtttacctgcagaagctggacccgctgctctgctctgcagcatctggcgattgacatgatccttctggtaaagatgagaaatgtgggatcagatattaaggtcatggttatcagcaatagcccccatgacaccctggccaaacgcatatccactgtcaaggtggtgggacattcaccagctcaggctccagctcttgctcatggcagatcttctgtttttgtgtggttgggcaatacctgagatgccagaagggacaccctaggcaactgggctgcaagtttttcactcttggagaaatggttcttccatgacaataaacctgggatgacctaatctgtttctgggctttttatctggactttctgttttcattggccttttcttcctcctcattatctccctccagacaagctctgc

SEQ ID NO: 469505 - DNA, 781 bp, Homo sapiens
aactgggatcctgagtgtgccagtgagatcacgaacccacggggagaaatgaacaactccagacacgctgccttaagagctgtaacactcactgtgaaggtctgcagcttcactcctgagccagcgagaccaccaacccaccaaaaggaagaaactctgaacacatctaaacatcagaaggaacaaactccagacacaccgcctttaagaactgaactgagccccattcagccccatgggagccccactgttgtctctgcccctggactctgtgagacaaatttttctttttgcctaaaccaacttgagcaaattgtggccaaacagcccctgatgaaggcaagtgtaaattgttatttctcacctcttcgtgtgtgtgttgtgtgtgtgcgtgtactgagggagggactatttgaccttattcccaaggccttccccttggtatatggagatgataaattctttcttacaattaggtcatgtgttacacaccagcagcataagccatggggtatcatttctgagacaccccaaaagccctttgcatgagctccccccatgcctgggcttcagtttcctcaccctcagatttccctaaaggcctttttttttttaactctaaacttctaggatttgggttcaacaagtttagacagaaaggaagatatggaattgaaggaaccgtgttatctaatgcattttcaaagagatttgtttgatgagagtgcttgttagaaatacctaagcagagagcatcaaatctttgacaaaatatatattc

SEQ ID NO: 469506 - DNA, 631 bp, Homo sapiens
cacccctgacatcaggggcatctctccaatgtaccatgtcagtaagcagtacatttttattgtggaaggcactgaaaaaaattgggatttctttattactggagctggcattaccctaggtgtgaccagatggcatcttaatatgcgttcaaaaagaaaggaagaaaagaaagaaagaaagagagagagacagaaaagattccatagtgaactaaagttgagaaacactgaattcagcaggcttcatgattgcaggatgttacaagcttttaatatgttaagcttcagtggattctgccaaatggtttccaaagtagttgtacaactacacttccaccagctgtgtttgagagttgcagttgtcctgcttccttgccaacacaaatttcctccgttttcctcttggcattctgatgggtgtactgcattgtagttttggttagcaattctcttatgattaattaaccaatttactgtatttattgtctggagatcatcttttgcgaaggatctaagtcatttgtccatttttctattgggttttctgtatttttcttattgatttctaagagttatttacatattctggtatggactcattacaaaatttctccaaggcctgagcactact

SEQ ID NO: 469507 - DNA, 690 bp, Homo sapiens
aagagaaagacacacagcttttcaggggctcacgtttagatatgaatgacagccaatgatccccaacactttgtgtcagaggctcttctgttccacaaaaactgtgtgacgaatgccaactttttagcagggaccatctcttccagattcgcaaagggtgaaaggaataatgagggaactagtgttggctccctagtatgtgtcatcactgaagcaaatagagaagttagaaaacagacgatatccaccaccaaaaggagaaaaggtaggtacagtgatgggtcgactttcaagaggggattgtctccagaggtgcgagtggatgtgagttgcacttcagaaaagatgatgtcgctacagggtgaagagatgaaaaggagcaagattgaagagagtgaggaggttcttgtgtcatcccagagacaactgcctcataaagctcccctgaaagggccagacatcaatgccctctcacctcccctccacctaagttgtaaacatcaatatcaacatctgaaaattctagagatgcttcagctgcttgactggagcaattatgttagtgacacagtagaattcccttaaaggctctcctttatcttaaaccacttgtccctaagcaccccccttctcctaatctaaacgccagagtgttcagaaagcagtagtgatggaaagctgtatgtaaac

SEQ ID NO: 469508 - DNA, 610 bp, Homo sapiens
tgagattatatcaccatattttcactataccttttctgtgtttagatatgtttagatacacaaatacttaccactgtgttacagttgcctacagtattcagtactgtaacatgctgcacaggcacacccctcaccaaggtagagctgccacaggtagtctaactccagagaacaacaaacccctttgctggggggaagggatgggaggaggaacaagacttgagaggcggctgggcagaggacacagaaacctccgttctactgtgaggcccgaggaatgcaaatggaaagtaggactcccacttatgagatcttgtagaaaagaggcccagagaatgggcagtagatttgttcaaggttatacagctagatggtgtgaagacagggcagcactgtggtccctgggtcccttgtctgatgttgttgccgtctctgcgttagtgctccctaatgggtctgtggtgtgcccggatgtaagggttggtttggagcatttccagcctggctctctggacgtggaacttgctggactttgggatttttctgtcagccattgataggagcagagtgttgttgtgttttgtggcagaaaccacccatggaagtgatc

SEQ ID NO: 469509 - DNA, 648 bp, Homo sapiens
cctgagctaacacgctgcagagagatgagccagacgaaaaactcttatcagaatgataagtcgtagaagtcgaaataaactaagatacacttcaaaggagaaacacctgaaagactgggctccttccattaatccaagaaaggagaacctgtttgatggagcccccagtaatgcctcattttaccttatggctgaagacaagggctggccaagagggggtgtttctcaggcctgggatacaaataatttctcagctgtcctggatgtgggtctgctgggggtagtccacagggctattctagctcaggatgtgggcacactgctgctcagctggcctgggtggtgcctgccaggggaagcccagggggctgcttctatgacccaggatgtgggcacaaggctgcttggctggcctaggggcatgtcttctgggagtagcccatggggctctttctcaggtccaggacatgggcattcatggctgattggctggtctggaggtgcatccgctgggaatgggtacaggaatgtttctcgggctcatgaaaggttgcacagctgcttagttggcctgggagtgtttctgcggggggtggcctacagggctgttcctcaagctgggacataggtatgtggctgcttatttgg

SEQ ID NO: 469510 - DNA, 1252 bp, Homo sapiens
aggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactgtcctgctaggacctgcttccagaagagttgatcccagccgtgaaagtgcatgatgccttcagcgaagcaggcaggaaaggctcaagtgatcctcctgtatcaccctgggtatcaaggccattcagtggaaaagaacagtctcttcagcaagtggatgaagttagatctcttcctcacatcatacagaaaaatcaacctcaaatggaagaaatatctaaatgaagccgaacacttgataaaaagttcatcagcgtaaataagaagaatcccctccattacatacaaaagaaaaaataactggagagatcatctctgctctaagcgtgtttttaagtctctgcagtcttggaccaagctcgttttattccctactctacgagaatctcaagagcaccaggattctgtttggagttgccatggacacagagttcttaatccagtactggcttattctcaatacgagagaaagttgtactgaagacacgagacctgagacttgtgtcattttagcggctgaaccgaccccaacttcttctgagcggcagtggcgccagaagcagtctggctttcagggactcagagttcctgagttcgagagcctaccagagtggcccaggggaggcgagaatcctatttgcgacatggaggagatagcagcagacaaggagcagtggagccctgggcagaaaggaatggagctaatggaacatggacttgtccctcaccgtccagacctctgtcaacatgtgagacacaacaatattgaaagtaggccatttaataagtctatgagggtttctaagtgtcctagtgaaaggaagagtcagaagcctctcactttaaactaaaagctaaaaatgattgtgaggaaggctagacttcttgcaccagtcagacaagttgcgaatgcaaaatac

SEQ ID NO: 469511 - DNA, 628 bp, Homo sapiens
cgttcccctccctgtgtctgtgtgttcttattttctagatccttgaggatttgccacactgtcttcgacaatggttgaactaatgtacagtcccaccaacagttcaggcccctttgctgcaggtctgctggagtttgctggaggttcactccagaccctctttgcctgggtatcaccagcagaggctgcagaacagcaaagattgctgcctgttcctcctctgaagcttggtcccagaggggcactcgccagatgccagccagagctctccttaatggcagacaaccctcccccgagcaagctggtgcatcccaggtcaacttcagactgctgtgctggcagcgagaatttcaagccagtggatcttagcttcctgggcttcctgggggtgggatttgctgagctaggccatttggctccctggcttcagccccctttccaggggagtgaatggttctctcttgctggctttccaggtgtcaatggggtatgaaaaaaaatctcctgcagctagctctgtgtctgccaaaatagctgcccagttttgtgcttgaaacccagggtcctcatggcataggcacatgagggaatctccctatctgtgggttgggaagaccatgggaatagc

SEQ ID NO: 469512 - DNA, 495 bp, Homo sapiens
catagtatctgggccaggtgacacagtccctcatggcacagtccctcatggcttcccttggctatgggagggagttcccccactccttgtgcttcccaggtgaggtgatgccccaccctgcttctgctcaccctccatgggctgcacccactgtaaagggtaccacaagggatagagaagcaatccagggctcaggagcagctgcacttccaacacctctaagggagagggttgaggagggaacacgtgccagaacgcagaaggaagagtctgtggagtccactgccttgagagctccagcaactactcaggtgaccttgcagggaggagatccagaaacaaataccctgacccactctcctctttcctccagcttcttgcattccacaagttacttcctccttcctttgttctcctctacctttgcctcttttaaaaagttgtaagttgctagccaatcgggacaaatacagaatacgacgtctcactgttgcc

SEQ ID NO: 469513 - DNA, 531 bp, Homo sapiens
acagcacaagcccgggagcaggaaatgagtcactggaggctcccagaggcaggagtctcattcacgtggctggcagggtgggtcccctccacagttgtcttggagtgtcttcacaacacagcagctgacttgccccagagcaaatcctacctgcaaaaccaaggaggacgcttcaatgccttctatgacctggcctcagctatcacacattgtcacttccacagccctccaacaaacaccctgcaggaaagtttcactaaaggcaaatgcgactgtatcctgacagtaggtcaactaaatcaaatcaatggcagaagcttcttgcccagaaaggtgacacaagttgcccaagatgtcctagccgccaagtggcagcgccagaattggactcccgggcagatgagtcctgtgcacattcaagagacatgacattgaataataagcaccgttcactccagagatgacacatgaaatgaatctaggaggaatagctttccagattagctcacaggtactgcacattcagctaat

SEQ ID NO: 469514 - DNA, 583 bp, Homo sapiens
aagacttgaatagtcacagaaatgaggatacctgttctcagcgtgcatccgtcctgggcccagcagaactgctcgacacagcactgcacccacactgctgcccttcactgcgttcacatctgtccccagctccccaatgcccaggacatacaggcaccgtgctcagtcgcccaaaatacaccaaacacatctcttcacgtcccaccagagtgtgacagtcattatctttctttgttatgtttattcaaatgtctggcttcccactctactgcaggctctataagaacagcagcctattctctgtgtccccagagctcagaagatctgagtgccagccctgctgcagaccacctatgtgacattaggaagcccctttcacaactattaaatgccctgtctcccaaaagcgattgcatggaagaggattctactcagcaatgaaagtaaatggactgttgatgcacacaacagtgcacagacctcatgcaagcttcgccaagtgaggaaagccaattgcagaaggcacattggttgtctaataaacaacacttttctaaataaataatgcttgcaaaatgaatgt

SEQ ID NO: 469515 - DNA, 942 bp, Homo sapiens
ttaggagagagaaactagaggcagggctgctgcaaagggctatgcagactgtacacaacataactccaggagtggctcatactgtgattgatgtcaatggcatccctggaaccctcaagctaggatttataacagtcaaataccacagatacatttcaggccttgtcattgttgaccaacactcggattccttgacagaagagaccactccctcgcccttggatgagctctggactcaaaccgcatgggacaggattccagctctaccactcactagcattgtgggcgttgctgacttcatttgggtaaaatgtgagtatctcaactgtagaaatggaaggagtccacaaccttccccacacctcaaccaatctcagtttcagcctctgaaagaccaaggggaagacattggagtccagtgtggcctgcagcagcccttgactaatagcactttggcaagtgtgtcctgctttggcatccattcacatacctgtgtcaggcaccaggcgagagcacggagctggacaggtgaggccctgctctcatgcagcctctgttttcgtaaggagacagctaataaacccaacaagtaaacacacgaatatacaagataattttaggtagtcatagatctataaataaagtaaaattgggtaatgaaatgaagagtgacaaggaaggtagtcaactcaaggatagatggtcagagaaggccttggaaaagacggcactttagcagagacccgaatgaaaagaagcagctcaccaagtgaagtgctaggggcagaagtttccaggtattcttcacttaaaggaagtgtcatgcataaacatctaaggttctaaccttacctgcacatcatcagggttcagcttgtagtagttgctcaataaatgctatgaattggattgttcagctgaagaaactaggaaggctctgga

SEQ ID NO: 469516 - DNA, 776 bp, Homo sapiens
cacacaaggcaagcaggagccctctcaaaggagccggctgccagcttggtgcttacaatgggctggctgtgcaggaagaatgagttcaagagagctattgtacaacgagagatcctttcaagaatatcccacggcttctcaagaggacaaccggggcccagagaagtgggcacccagggaaagcattactgctttcaaggccctggctgcacactgtccatgcgtacatcacctactcagtgctgggtgcatgccaggctccactctgtgcccaaggagaccttcatcgagtggatggtggtgccactcacagagacaaggatggccaaggtcagcttggtcatgtcagtgaaggcgctcatgaaccgtctacatggagacctccaggaggctgctgggccccagagctgcagttttgagggaataggggagagacgaccgactgcctgccttcgttcaggtttcctgcccatcctcatgtgtcctttcagaggaggagaatttctgaacatctgatgccatggaggtggaaggagctggtatttttaaagtaggaagtattaggaagtaaagttaaaatatttatgagttttcaaggtatttatagttgtaggttcctttgtgagcttaggagcacacaagtcaatgaaggagggcttgtaggcagaggccggcctggtgtggggtgggctattggagcccaagcactgtgacggctgtccttggcagggtgggaatcagagtagggagaggaggacgaacctccccagggaagc

SEQ ID NO: 469517 - DNA, 2457 bp, Homo sapiens
aacatcggtcagcgggtgacattgcattaatttgctctggtgatgatttctgctttgctagaacgttatttgagtgtatacatacacaaccattaaaagtggccgttaccacgatgcattctgggaaagaagcagcaccaaatccaagatggcggccagcaggaggctgatgaaggagcttgaagaaatccgcaaatgtggaatggaaaacttccgtaacatccaggttgatgaagctaatttattgacttggcaagggcttattgttcctgacaaccctccgtataataagggggccttcagaatcgaaatcaactttccagcagagtacccattcaaaccaccgaggatcacatttaaaacaaagatctatcacccgaacatcgacgaaaaggggcaggtctgtctgccagtaattagtgctgaaaactggaagccagcaaccaaaaccgaccaagtaatccagtccctcatagcactggtgaatgacccgcagcccgagcacccgcttcgggctgacctagctgaagaatactctaacgaccgtaaaaaattctgtaagaatgctgaagagtttacaaagaaatatggggaaaagcgacctgtggactaaaatgtgccacgattggttccagcaagtgtgagcagagaccccgtgcagtacattcagacaccccgcaaagcaggactctgtggaaattgatacgtgccaccgtctggcgttcgcttgcagcagttactaactttctacagttttcttaattaaaagtggtctagtaaggactttttgacaagctgcacttccctgctttagtaattggtgataagatttgtcctgtagaacatatacatagaggattgttcactctcctccttttatgaaataatttttagaaattgagctgttaaaggttgtgtttgcacatgttttttggaacaagaactttaattaaaggatcaaaaagcccaagctcttgcttttgaataactgaagccagtgtctataatttcttgtatctaaaatctgtagaaactagttgtgtgatttcaggggtgcatggggccccttgggtgtctgaacagaagggggtgggaggcagagccgcacctctgcactcttgctctgctggtgtagtgggcagctgcccacccccaccccaccctgcactgcaggctctggagtcagcagattaagcattttataaattatattctaagtatatattttaaacttgtcaaaaagataaatctagcttattttacctttaacttgtaaagaaagtttgccttcttgagttctctttgtcatgggcagtaggagtagctcgcctgagtatcatcagtgaagggaaacccacacatcttggtgagcaacgagaaatcaccatgttaagattccagggattttcttctctggtcattgttgtagccagtgtcttcatggaagacctattttcgtttcattaccatatttgatgcctaagcatttaataatcagtttatgactactaaacttttgaggatcttagaatttaactggctctagaaagtggcagagaaacctacacatgattccatgtcctaacccataagacgtgagtgatacatgctgaggagggaaggttactcacttgtgaaatgaaggcattatgctggatgatgtctgaagtcccttcgcacattccactattacgtggtaacagtggcattcttagcatgttttgtgactttaattcattgattagatatttcatcaatgaccaaagttgcttcaatgctaagattagaacaattttggtgaggcttcaaagttaataattaatgcaaataaatgagccatttcacacctctgctagtatgctctcctttccaactctctgtacagaagaacaaataatagcaaacagcaatgaattaattcacaagcaaagattacttctggcaattaggaaagacagactcttttctgtttatatatacctattctgtacataaatatgtgttcacatttataaatatatatatgtaccatttttcattaaatacaaatattcccaaataatatgatgatgctaacacctataatatttgttgagcacatactgtgtgccaagcactgttgaggacttcatagacattatcaatgatttcttattttcatttatttcttctatttccagtcttaatgccacaaatgatttctcaaaatatggagatttgcaaagtttattgtaaacattttatctagcaggcacaactgttaacagagtgtaaggaaatgacaattcttaaaaaatactctcaatttatctgaacttttgatctgaactctcaatttatctgaactttctggaaaggtattcatttgagcatgtttatctggggacagggattttgtctccaccaaagctttcctcttttggacagagagaaaaaatcttggagattatggaggac

SEQ ID NO: 469518 - DNA, 736 bp, Homo sapiens
tggagagtcacgtgcgcttaggtcccaaacttaagggacctaaccctttttctggcttcctgagccctcaccagaagcggtgcagatgctggtgccatgcttggacctcctgtagaactcaggcagacacacatcggtggaagaagacaggagcggctggacattgaaaggacgtcgagaggagcacacctgcacaccatcgaccagcggaacgaggcagagtgtggctggagcacctgcccgtctagaggtttgagcagcgggacactgaagaagagagccacaccctcatcgcacgtcctgcgagggagacaagggaacttttccggtttcacttctgcttggcttgagctggcactgaagcacccttttccctcctcactgagggagcagaggggaaaagcggtgatcacggcagccgcggagtgcatttgggtctcctttcaagaaagaacttgctgctcagcgttgaagaatgcagttggccaacagcctccagctgctctatgattcttactattttgagatatattcatttgatgcctagtttgttgagggattttatcataaaaggaggctggattttattgaatgctttttctgcatctattaaaatgattacgtttttcatttttaattctgtttatgtcatgaatcacatttattgacttatgtttatttgttgcttacatctactttctaattttactataataaacatgtataattttgttat

SEQ ID NO: 469519 - DNA, 2357 bp, Homo sapiens
gctttattgctcacacaaagcctgtttggtgatctcttcacacggactcggcctctcacaatgacacgcagaagtgatggctttatgtatagcactaccgtgctgacagcaatgagctccaggaggtgggagaccagctttgcccatcttcagcgagctgcctcagcgaccaaggaggcctctggtgctccagtgatgacatctgcattccagatggaaagagaaaaagtaggggaagtgggaaaagaaaaactgtctcacaagagtgcgccatggaagctacgattctaccatgctcttgagtgtgggcagtcaagatgccacacagcatctgttctctggagtgtacagctgaaactctattcagagatgaggaagctgctgcttctgcaaatgcttgtctctatcctaagctggttcctggacactaggatgcttctgcagaaaccaaaaccaaagccaaaaacattccacagtgctccacaccagggcttgccagcaacagcatttgaggcagcaacgagatagctggtgccacttccgccatcatgttaataggcagaatctaacatatgtccagaacataactgcaagagaggttgaagctctatgtactggagaagtttagaatcaatcctgagtgttgatctacgatatcaagtacgatgggaagattttgaaatgagaaaagaagagcgataggatatgatgtaccttttacgaagctgactaaggttacagtggcaaaaagacagcgagaggatgctggaagctggatgcaagaagatgagctagaacctgagggatagaaatgaagatctttcagttgctgtctgtgaaactgattgatgtttttttaatttcctatatggaacttttctggcagtcattgtttctgcttcaaaggggggaggagaagcaggagacttttcgtagttatttcaaaggggaggggtgtgaatagtggtaagtatataatcatcaggaggggaatttataaatattataaaacaaattataaatacttattataaattcaaatattagaactatgaaaaataaattataaatataaaattatataaatgttaaatataatcaaatcatactttattacaaataagtcatgatataattatacataaattataacatttaaaatattgatatattttattaaaatatattatgaatatataaattataaatacgatatgaatcagctagaatattttaatatcctgctactgaaaaaacttatttcttaatttgcaggttagaattaaagagagggaaagatgtacttcacagctgctcccccagaagatacaatcacacagaatttcacacttttttgcagccataactcctttttgaattgtaagttgtcagaatctcagaagaaccacattggtgttatacagattttgatatactgaaaaaagacataagttgtggttttctctaattttctgtacattatttgcacagtgtaggtggccttaaagattaaagggttttttgtttttgtttttgatgagagttaattatagcattttacaatcatttgagttctgtataaaagccttaatgaaaaatcgctggacaacaatgtaaagccctttaaaaacaaagttcctttcagtgtaggaaggtcctgatttttttaatctgtatttacaggaagtaaaatagctctgaaagttgaaaatattttcataagtcacttggccacaaaacttgctctgacctgaactcatttggccatgaaacttgaccttaactgacatggggctatgattagtctttattcgtcccactgtatgtaaataatcatatatttctacacagagatattaatgtatttaattactgaagctgccttaggacgctgcagaaatattctgaacattgaagcacctctgactccaaggtttcagaagagggattatgaagttatatacttttcattttgagttctgatatattgctctttcacatttccttctgaaaataattggcgaaatgttcagaactccttgatatgagaattctgaaatagagttcaaactttaaatcagaatgaactagcaccatattcctgttttttcagttcctgttgaaattcactatgtcgaagtaaaatagaaaaagagttttaatgattaagaaatagggtctggttgaagtattgcatatttccattcattccttttcattctcagttctttcccagcacttaaaaattttatatttttgttatatattttatgatttatattggatgacataattgacatttttatcaacttattgataaaaggaagtacatttttgtggtcaaattgttcctggtt

SEQ ID NO: 469520 - DNA, 618 bp, Homo sapiens
ggaaagaggtttaatggactcacagttccacatggctggggaagcctcacaatcatggtggaaggcaaatgaagagcaaagtcacgtcttacatggtagcaggcaagaggacatgtgcaggggaactcccctttataaaaccatcagatctcatgagacttacccactatcacaagaacagcatgggaaaaacccattcccattcagttacctcccaccaggtccctcctacaacacgtgggcattattacaattcaagatctcctcagaggcagcaggagcagccaagccgatgctcatgggcctcatctttgtgtcaccagtgctcaaggttgttctgcctgaagggaaaatactgcttgagggtaacaaaaggctgaccaaagacttaaaagaaaaaattgggaatgacatgtccccggtgaactttaaaaagctctaaaatatatctggggatctagaaaaaacaaatgtatattcagggctgtgaatattcccaggaattatctgaaaaggttctactcagctgacctcgctcacctgaacttgaggctttgtgcaagcaataagtgatggctaaggcagcatagcaagcattctgctggagtgttgattaga
